United States Patent 11,549,145 (METHODS AND COMPOSITIONS FOR INHIBITING AND TREATING NEUROLOGICAL CONDITIONS) - sequence listing, part 19

SEQ ID NO: 151 - DNA, 215766 bp, Homo sapiens
ggggaacactacactagaaaacacctttttaaacttactgtggctatatgcatctatgctattctcacaggccatgggtgtctcaagtttactctcaagccagctgccatgttgtaaagatgcttgtcttagtccattgggttaaggagagttgagagtctcgcttagtgctatagttatagcaaacactatggagttagactgtgtgggtctaaatcttggctctgccacttactagctttgtgaccttggggcagtgaattacctttctgcctcagtattctcacatgtaaaatggaaatgatagtaggattttcctcgtgggtgttttgagaactatatgagttaacattgtgtttagaacagggttttgtaaggatttcttaaatacataatagagttatctccctctgggagcacttccttggaacgttttattgataaaagccaaatgtggtggttactaatctcatcatgataacattgtcatttattggatgtttatatatgccaggcatgatgggttatgtatattctgcagttcacataatcctcatatcaatcctacaaaattagcaatattattttaattttacgtatcaacaaactgagtctctgagaagtaacttgctcagtgtaatagagctcataagtgatggtgtagatatgacatatattaaagaggcagcatgatggttaagagcacagaatctgaagctaagctctctgggttcaaatcctggcactaccacttcctagttgtgtatcttgggcaagttatttaacctatgtatcagtttccttatctgtaaaatgaggataatagttatacctacctcatgggttattatgaggattaaatgagttaatactttctaagcacctaaaatggtccctagcacaaaatgttgcagaactcttccttagttcagctaaagacagagttctttgtcccacagccacaaaaattcaggcccgcagacaatttgaatggtgaacaagcagggttttatttggtgaaaaggaagaaaagggggaaacatcctgctagagcaggatgttagaatcccaacttccacacaggaaaaggaggggccaggctcctccccagtgtaaacttaacgaggctccaccttagtgggcaggctgtttggagtttctccagggaccccctcccacctgactgtctcaataataaatactttgtatgtactagctcgttattattactgctattattatttttattagttagagtttaaagaaaaagcagcagtaaaaaaggagagactgaagttgccaataaggaagggaatacatgtatttcaataaatgccttaataaataaataaatcttcaggaggagagaaaaggagagttgtctcgccacaaagatgagcagaatagaaaacagttgatttctaggcgaaggcagatgattaaactcctgggagatagattcatttttacaaggtagaaatcaagctaatcctttagaaatgaagaaaggaaggtagaattggaagcctgtggaggcaggggaggtctggggacacttggggagtcaaaccacagagcacgcactagacatagccaagttgtgttttgtcaatgcttgatcatggctgaattccttgtggctaaaaaaaattatgcctggtggaggggatagctcagcagcctagtgacagcaacaagttcagacatggttgaatgggatggttatgatggtaagtagaagtgaaggagcgtggaacaaggaatcaggagacttggattcattttttaactttagtatatcaactagcttgtatgacctcgaatagttcgcttgacctttggatctcagttaattcacttgtgaaataagagagctacatcagtttatctctaacattacttctaattccagaatgtatgaccctacagggccgattctagcatctagctgcaccagaaaggagtcaattgaaatggcaagagttaagaaagtaatgggaaggcccagggaggttgggatgcaggttcaataaaagtgaaggtagatgagggaactcgtgtcagtctctcagtctttctgcctttaagatttttcttttctgcactcaaaattctaagactagtttgtcttttttttttttttgtagcaaatatcattatggctattgtgaatttaataggctatgtttgacacacacaagagtaaatgttattttagttttacatatctaaaatgttcattaacacatcagaaataaacagttcacttgtagggagttattttttttcttttaaacagaacataacaaaagagtattttatgctttcccgtgcccataataacattacattttggagtagctaactaggttgcttgaacacgctgttacagaactggttaatccataattcagcaggttcttggcttccaagttgccttattgacaagcctgaagaaagtggatggaactaattagcactcagcattataaaataggaagaattagataaagcagcttcaatattaaactcagacccctatgaagatattccctttagttatggggattttgaaatgatggacaggctaaaccaaaactcataatcctattacagtctcctacacccacctaataagcttcaagagccgtttccttggagtctgggatattgccatcttcctctaggcttttctgtatatagcttataaattctttacttgtttccactaaatactttgttatttaaaatagcataaaagagagtatataagtatatatacatattgaggtattttgactgtaataatacccttggcctgtagggaacttcaaattattaataatttcagaggaaagctttttaagaaaaaagctccaggcttagctgtaatgaggcatttgaaaaggaggaggggttatgtttatgtgcgtaatgaaaatattgaaccctttgggatgttatgaaccatggtgcactaataaatgatcttcccatttcagtgttccagcagacatctttgtacccctgatgtactcttgcaaaatgcctatagctcacatatccttttaaatatttctatctcctaacattcgttactgtgggtgggggtgcaacaggataaatctgatggagaaaggaggacaatacaagaagcagacaaagttggtggtttagaataatgagcccattttcagctgagctgtgtagttcatatgaattaattaaccccttacaaacatttgtctgacaatccaaattctcattcagttcaatgggttttataattatcatttaactaaatagcactaagaactgtttatatcctgacattaaggaagctttgtcgaattctttttctgtaaatcatctgaagttgtttacaatttgcagtagtcttggtttgtgctcaggttgctgttttgctgctttaaaaaatattttcagggtgctaattatagaatatgctctagagtttggttagctttgtaagagtagaagacctttgtaaagaacgttttcacattttaattggaagaatgtaggcttaagctattatctgtcatgttaaacaaaaggaatccgatgatgctcaatggatatagaatgattaattactcattcttaagacctgtgccatttagttcctggtgataagatggtgataaagcactttttacccagaaagagagaaatgagagtattgtgatgaccatgctgcaacagagtgtgagaacacttaaaaaaaaaaaaagtttgaaatgagaagcatctgggacctcccttctatgctgttgtgtatgtaattgcttttaattttgtacaaaaagttaaggtactattaataagcattttacttcattgagtgtcttctgattacaaggaacaaaaagctatttaaactgggtgttcattgaacagatacagagaggctcaagggaattcagggcaggatgtattatacacctagacctagagccctggaaatgggatctttgctctcctttcaaggtggctctgtggtccttcacatcatgagttcatgggcctttaatctagtgcttgaaacgagacttcacttatcctcatctaactgctccttctacctcctgacaaagattcttgggtcccaattctatgttcctgtgacaggaatgttatctgaatccttttttttttttttttgcaccaggccccaagtctttgacaagcctaggatggttcccctgtaggtcggggtccttccctgattcaatcagctattaccattttatttatttgtttatttttattattatttttttgagactgagtctcactctgtcaccaagctggagtgcaatgaggtgatctcggctcactgcaacctctgcctcccgggttcaagcgattctcctgcctcagccccccaagtagctgggactataggcacacactaccacacctggctaatttttgtatttttagtagagacagggtttcaccatgttggccaggctgatcttgaactcctgacctcaggtgatctgcccacctcagcctcccaaatgctgggattatgctcccggcctctactatttgtattatataataacaaatttaatcctcacaaaaatcctattaggttaagtactattactatattcccttttatagtgggggaaactgaggcaaggagaggttaagtaacatttccaaggttatgtaactccagggtctgtgatgagttaggagatctggtttctaatgcttgacccatcactgtgcgaatgacttgaagtgaatcacttaatctccctgggcattcagccattccatgaacagtttaaaaattgtttttctaattttttttattgacaaactaaagggaggaatcaggtccactgccacattgtcataggcactgcttggttgtatggaacagaaatctacataaggtagcttgagtgaaggggtatttatttaaggatgtgataagcaaccttgtggacatccaaggataggaaacaacagtgagaccacagagtgtcttaggctggaaccaaaatggaaaagttagaaatataagttgctctcaggccgggggtggtggctcatgcctgtaatcccagcactttgggaggccgaggcgggcagatcacaaggtcagatcgagaccatcctggctaacacggtgaaaccccatctctactaaaaaaaaaaaaaaaaaaaaaaaaaaaaaattagccgggcatggtggcacacacctgtagtcccagctaatcaggaggctgaggcaggagaatggcatgaacccaggaggcggagcttgcagtgagcccagatcgcgccattggtttcctttgtttgaacatgactgccacaactatgatacagtatgttgcttacttcaagtgcctatctttatgtgacatgggtctctccaagttcagattcttgtgacagaatctgactgatccagctagcctgtgaatttgtttcccttaagtcaggtgttcattctgtggccaatcagccagagcagagataagatcacatggtgataggactgtcaccttttccaggcacttgatgaaagagcagattctctgagaagggtatgggaagggctggcaaatagactgatgtttgctacacccataatcctagcactctaacacaattttaaagcatattgtgtatttctccatagatcatcattttggctacataaatatatatatatgtatgtttttgttgttgttgttttgttttgtttttgagacggagttttgctgttgttgcccaggctggagtgcaatggcacaatcttggctcactgcaacatctgccttctgggttcaagcaattctcctgcctcagcctcccaagtgctggaattacaggcatgcaccaccacgcctggctaattttgtatttttagtagagacagggtttctccattttggtcaggctggtctcgaactcctgacctcaggtgatctaccctcctcggcctcccaaagtgctgggattacaggcatgagccaccgcgcccggccatggctacataaatattttttaagcacttcactgtataccagggactttactaggactacactagcttcaggccctccatttcctaatttgtaaaatgaactatcctgtcttgctttagaattcacccacacacacacacacacacacgtttatgcgtttatctatattatactgaatacaattgtcctttcatatccgtagattctacattcatggattcaatgaaaggcatatcgaaaatatttttaaaaatgacatctgtactaaacatgcacagacttttttcatgtcccctaaacaatacagtataacaacttttacatagcattaacattttattaggtattttaagttgtcaagagatgattttaagtatacgggaggatgtacataggtgatatgcaaatactatgccatcttatataaggaacttgagcatctgctaattttctggtttctgaaggaagttctgtaaccaattcctcatggatacctagggatgatggtatattgcctttgttaccaaaccaaccggaattttgtttgtttgtttgttttgaggtgaagttttgctcttgttgcccaggctggggtgcaatggtgcaatctcggctcactgcaacctccaactcctgggttcaaacgattttcctgcctcagcctcccaagtagctgggattacaggcattcaccatcacacctggctaattttgtatttttagtagatatggggtttcaccatgttggtcaggctggtctcgaactcctgacctcaggtgatccacccacctcagcctcccaaagtgctgggattacaagcatgagccaccacgcttggtcccagccagaatttatttatccaaatgaatgttgtgcagtaccctgaatttgagctagagaagaaattcagtataatttcttcagttacatctagtgtttaaccaaactttagtattacccaggttacttattgatttggctctgaaatatttgttttgtaaaacaaatctattaaaagtcaaagacttgctgtcatcaaaactatttaaaaggctgtgaggcctactgtaaagatatcccaaagaaggacttcacaaatgttttttgccaatgatagaatcattccttaattctgtagctcctaaagtaactaccttgaagagcacggatcttaccaacatatgtaggttgtttaaaaaatcattcatattatgtacagaatcaaagatttaaaaaagtatacaagatacaaatacccagttaaatctatagttaggcatttgagacttaaaaaacaatttggtgggactctttactgaagtattaaaaaacagaattctatctcacatctatttcacctactgtgacccagtatctaaatatgtcagtatacttctcttcttatgctcacataggaaaaaattggattgaaatgcttaggacacactggaaactagatgaatttagagcttttagaggaaaaacaccttgccacagatctcccctgaaccagccaagttaattaatcttggtttttgttgttgctcttgctgttgttttaccatagttatgcaaaagtaatgctgcaagtacagaccaaagccccagaggaggtagttgaagttcagcaaaatagatttaccaaatccatttgtgtttgcctggttttatgttggcatttagagtctatctttattttggtagctttgtagcctgagagtgagagagaatatatgtgtataggtatgtttatatgtattgctgacaaattcaaagacatttgattaaatatgctttatgtaagaagtgaaaagtattgtgtatattttttctttttctgtggattacaatatcttcatttctgtggttactttttgcaaaagattagtccagattcatcactctagtttctaagaggaatgaaagacaatttaaagctaaattcaaattctatgtaagtagtataatctgatgaacacacccttttatcccaaatttagagcaacaaatgttttatttaatttgagaatatgagataggaaaagtccatcataaaagtggtttcagaagctcaaaatgttaactatagcttccatgcgttacagtcccgtgatgctcatttaattctaaagtaagtcactgttgtttctagaaaactagtcatagttagactaattcctttttgttgttgttcaaagatttgaaataaatgcacaaagtcttccttctttgtagtagactagtatcctggtttctgcatttttcctgaggaattatactttaagacctaagataaacaatgtagaagaatcctctaaatgtgacttgtggattccctttgtacaggacatattctttggtgttaatcatgatcctgaatcattcctgccccagccttttgtctcatcttccctattgtacatttacaaattggccctaatgggtaagaaagaaacagacaactaaaatagctataagatgaacagcagttttttaaaaaactttaaaatatttttcacactctacaggggaataagcagataatttgcatatacacttgtggctctgtgatgttttcatataccagaatttaacacctttgcaaaatcctagcagagaccatggggatacacaattagatgcttaatctaaacctggaacaatgtgatttgggctgatttgcagagagactgtaaaagctgaaaaatcagtttgacaacgttcctgctgggattggcctgcaataaatgtttgcagtggtatttggaggccatgccagtttattcagatcactggggcttaggagatgatgcctacagtaaaacttgagttcactgcttatcagggaatgtgtgaaggctcccaggctgaaggttcattaggtcagtatgtaagagctgtcaatcagaccaagctgtcaggggaatacttttttaaaaaacaaacagaagtaaaatttttctacttaggatttttccacattgcatcccttctgccatcatatcgtccatacaagagacagcccttgtgagagagtagaatattagcccattgtaatgttccgaatgtcagcctttggccaccatcacctatgagcacggctgctgctcttagtaatcattgtggtcacttaggatgaatgggatagaatggttgtccaaagtacataagtctttaaggagttaaggacttgcatcatattcattagccccagtattttaccactgtgatggaaacatagaaggtgctcagatgtttattgatctcaacatcaagaacagaaactactatatgaatctagcatacatatggcctttaccgccccatttcccattcttggctttaacaaaatttgacaaaattatttcctgtatttcttccatattgtcaagcgtgtattgttttatagctagaaaacctattatttaggtttgattttggtgtatttactgattgagcatgactagaagaatattcgaaaggtctttgtgaaaaaaaaaaaaaaaaacatcgtattacttgtaaaggaagccaagaaggtttggaggtgcaccgtttattaggttttgtgtgaacatttaacactaaaacattagttaatatatattaaccatttagatgattgtaaaacattatatccatgtggcaagtcactaaatcaaaacacaggtaactggaacagactgacagaaaacacagttggcctcatcagatacatagaaaccatagtaggatgaccaagataaacagtatagctatgaaaacatcaagttgatgatagcatagactctaattattatcatcgatagaatgtgaatgtataataaagtgaattatatagtttttgtttaactcttgttttaattagcaccagattcagctacagttgtatttatgaatctatgttaatttctaataattagaatgaattacttcttcctaagataatactcttcctagaatggaaatttagaaaatatactctattaaatatcagttgattttctttccaggtggcatccattaggacaaacattatgaaaaggccactgaccaaaatgttgatttcctagctgacacctggaagaaaaataaacttatgtttaatggaatagactgtctaaatccctgttttgagaagagttcacattcatgaatatgtattcattgctgaattcaatagattcgagtagtgaaggacatccgtatcatagaaagtcgcatctattcattaacttacaactttccaaagaaacaagcaagaatgcagcttgagatggagtgctggcaatacgcagttcattcctttattatgtgacacgtttatcatgacctgcatgataactaatgaaataaatatgagatttgtgtattatctgtggcctaatttgttgaacttctcattttaagttacagtagcacaatcctaaatcagtattataaatgagctgtttatggttttgtcttattcagtgttctaggtgcattatgtttttttatttatacatttcaaataatttttctctttatttcttcttttctgcagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgatattcattttgtctggtgctcttttctttctgcctaaggctttctgataaaatttatgctatatgccccttaataccgatttcatgatggttaaccatatctatgcctggaaagaaaatatagacttgggaagaaaacagatatatagtctacaatgaatatttctagcttgcattcaagatgactgtgttgtgcagaacattctgccaggcattaagtgggatacaaaagcagtctaacatatgatctctgtcctatgaatgtgtttttaaaatgtatactagtcattattggagtgactattatataaagacaaaagccactagggtagccatggttttttgccagttattagccatatatagtgcgtgcatgcacacatacacacacacatacatatatgtaatatataattttagtatatttaaattaatccatattttcaagaacttcattaacttgaacactcagaaataccctgagtgttttaagacataattgcaaataactcatgtaatgcgtatatttttatatctttgcatgtatgaagtttatacattcaggcttgtgcaaatgtgtttatatcatttgcctaagcccttgattatttacatgttcctatgtgggatcacagtccttcagatatgaatcatagcacagtgatttctttacatattcgtattctactattgagatactttaagaatcctgtgagttgtgtacctggaaatataaaattgatattattattaatccattcagaaatcatattgggcaatagcactactacatgtacatttagtagcaaacatagatagaatatttggagataatgaagatttcaatactgtgttaagaaaaaaaaaaaaaacaaccacgcaagagactcggctcttggctctcagctccaaagcatgtgaaatattcaacttaataagaacataactgcaggaagcacttctaggtcatgggagttgctatgcacaaaagaggtatggttgttctagctcagagaagcttccacatatattatttattgaggaagcctcattttaatgctgtatagagaagcccgaatgacatactcttcacaagtggcagtattggtattacagcattccaagggtgtgagacttagtttggaaatgaactgagaaaaagcaaataatatttcttaactattgtagaaaatggaggtgtcgctaggaaaattatattttcctctggtctttctcaccatttatttattccgctcaccaaggaccctggcttttgaggagaggtccatggctgagagaacattaaaaggaaagagtgaaagtggagaatgcagatgcatatttggattcaggaggaaggggaggttcaacaggtgccttctatagcagagttggttgttaagtcacactacccacaacatgctacccacaataaccacagaagaaaggttacacatacataggtctgttctcccttttatgctcacttaccacacaaatgacatctttgtgcctgttgttcggggtcattgcctaaaaaagttgagttgaaactggcaatgaagaaagaatgggccgggcatggtggctcacgcctgtaatcccaacactttgagaggccaaggcgggcggatcacctgaggtcaggagttcaagaccagcctggccaacatggtgaaaccccgtctctactaaaaatacaaaaaatcagccgggcgtggtggtgtgcctgtaatcccaactactcgggaggctgaggcaggagaattgcttgaacctgggaggtggaggttgcagtgagccaagatcgcgccattgcactccagactgggcaacgagagtgaaaatccgtctcaaaaaaaaaaaaaaaaaaaaaaggaaagaaaaacacagaaagagtggaggactttaacatttcttgagtacctattgttttcctggcatgttctaggtgtcatatgtacagcatctcattgcatcttcacaacattcctgagcattaggttttcttttcccaggtttacaggggaagaaatggaagattagagaagttaagtagcttgggcaaggtcgcagctggtgaatggctgaatcagaatctgaacaccagtttgtctaattctatcctgcatgctatttccttacaatgttccctttcacttaggggctcatgcaaaagatttatgatttccttcagattttctttggtcatagtgctctaaacacttgtagctgaatttttagttcttacctcaaataagtctgataacactactacatttttaaaaaatgagtgatataatttgtagaaatagtcactggaatgcttttaagagatttcaaatcatagagttgaaaattcatgctgtgctctaggcattattgatcctgagccatctcatgcaggtagatataaatcctcttcttaaagatctctggtgaaaaaacactttcaggcttttccatagtaatttacctcattgctgaaaatgtttacagataggtgtatgcacattgttaggaccaatgacataatgcccagttgcagtgaatcaagctaataaaataataatcctttttaaaattataatcttcaaagggtttccgaaaatcacttataggaagtttatgtgattttgctgtttctctaggaaaggcagttacgtttgaatatttaaatgatcaggccttgtgtgggtcacacagggatttttattttgcatttggattccctttatggtttaaatcacagatctctaccttaaatgcaaatgaatggagtgttgagaattgacataattttttaaattgccatagttatttccagggagctttatacctcagtataagtatcttatcctgtattataattgcttgcttgtttgtccttctaacaagaccatgagcaattggaggacaaggattgtgccttactcatcacagtatctctagtgtttagcataatgcttgacacacaggagtgatcaatagttatctattgagtgactgaattaatttctccaattgattctgcttagacaggcctttctcctacattcccccaaatgcaacctgctaattcacatttctctatcctggtttatgttatttctctcaactggagtgctctttccttcttttctccacttatataagtccacctagttcttcctggtacaactagttgctacatgagtcctgttctaactattccagatctcatagagtcatgtcctcctcatgccttgactcttttagcctatgggatgccccacacactttagccctttattatgtgcagctttatattatttgccaatttaaaaaatatttttgtcttgttttcccaaccattatgaaaagtagccatgtgttgtatcattttctctccccttcatagtgacttaagtgtggaagagaccgttggataacaaactatggcctataagccaaatccagtccaaaacctaagaatatttcttttttaaaaaattaattaattaattaatttatttttgagacagagtcttgctgtgtcgcccaggctggagtgcaatggcgtaatctctgctcactgcaacctccgccccctggactcaagtgattctcctgcctcagcctcctgagtagctgggattacagacgcccgccaccatgccctgctaactttttgcatttttagtagagacggggtttcaccgtgttggtcaggcttggtcttgaactcctgacctcgtgatctgcccgccttggcctcccaaagtgctggcattataggtgtgagccaccacgcccagcaagaatatttcttatgattttaaatggtaagaaaacaatcacaagggctgggtgtagtggctcacgcctgtaatcccaacattttgggaggccgaggtaggtggatcacttgaggtcaggagttcgagaccagcctggccaacatggtgaaacctgtctgtactaaaaatacaaaaattagccaggcgtggtaccaggttcctgtagtcccagctactcaggaggctgaggcaggaaaatcacttgaacccaggagacagaggttgcagtgagcagagatcatgccactgcactctagcctaggcggcaaagggagactgtctcaaaaaccacaagaaaaacaatattttgtgacatgaaaattatatgaaattcaactctccataaataaagttttttgcaacattgccacgtttattcatttacacattatttatgcctgcttttgggctacagcagtagagttgagcaattgtgacagagactctgtggcccacaaagcctaaaatatttactatctgaccctttacagggaaagtttgccgactgctggagtagatcatcaatgagtacttactggttaaataattcattgtcttatgactctattctattatgaaacaagatagtctgaaagtactgttaattatgctgtcttgccttacataaagaaaaatagtaataaaagcaacctctggagaacagattatttttatcttttagttggtgaagtataaaaattttcattttctcattctctggtaaagtgacttatagtgcccttattagttttaaaccttttcaaatatgcagaacctcttcctgcagagattttaaagaacagggtaaggccaggcatggtggcttatgcctgtaatcccagcactttgggaggccgaggcgggtagatcacctgaggtgaggagttcgagaccagcctggctgacatggtgaaaccctgtctctactaaaaatacaaaacattagccgggtgtggtggcgggtgcctgtaatcccagctactcgagaggctgagacaggagaatccctcgaacccaagagacagaggttgcagtgagcagagatcgtgccactgcactccagcctgagtgacagagcatgactccatctcaaaaaaaaaaaaaattaataatagtaataataaagaacagggtagatgattatcgttctgggatggactagataacttctagtattgtgcagcccagtgattccttgaatctcctctaaatgtaaaccttgctttattagaaatgagaaatctgatttgtggatatgaagtctccgcatcccccataactccttgattctcctttgccaggacctccccccaccctccacttttggtttaatctagttcttctaattaaatatgagataattaaagttcacagagtttaaacccagcaggtttgatttaatgataaaaatcttggtttgtcagcttttcaaggcataatcctggctgctgccttatctgacaggtagtcagcctagcaggtctgaggatgaaaaccagagcatctcatcttttcaggcatgacttgctatttatcttctgaggcataatttacaattgccctatagaaaatgggtagggttaaataagtagaaaaggtctccttttgctttggctcaattaattcatttcctatgcggttgtcgatgactaggcttacaaagtagacagatgtatttcaaatgaggagaaaatgccccaaacatagcatatttgattattgtaaattattcctttactcactgaatatgtaaagtatgtaaatttagtcctgctgtcaaaaggtagctctgtaccattagtttctgcagcagacaaggcctgctgcatcctgtactgcattttcagagagataattctaatgacagcttgagcaattgccttaatgagccagaaaggtgttcttttttattcgtgtttagctgcttagagtcatctgaaatagagatcatctgtagatattacagagtgaaaaaagacatgggttatcttattaatgtgtttctccaagcatgctaagaatgaaccatcaatcaggtatttgccaagaaaatagcttgttgtcagttctgtataggtgatatggcaacctgaaatgcaagtttaggttctaattatcatgctagctaagtaaaagagttgtcaagttgcatctataagtcattttgggaaatattgtagggcttaccaaattgatcacaaaatagcattaatattgtaaacctgaagtgaacaacataaccagttttttaaaaataaggcactctacttgagtcatcaggaaaacattagaaatctacctatgtgcatcatattatatgtaaaatttagtttaattggagctttgtgttgttagaacccaacacattaatattaacatttgagacaaatttcctatcatctgagtctttcattctaagtgaaatgtccatattttctcattaatttgggtctatttaaagatcagtcacatcacagtaacataaagattggaaaagtaatgttcacattttagttaaagtcatgaaatatatacctataattgactatggtgttttgatttggttataaagtatagctgtaccttccacacggagttaagagaagtcctggcttaacacattagtggtagaaagtgtaagtttacacttaagccactccccagccaaggatttgcataaaaaatgagtgaagttcagcttgggtttatgttagcaaaatggcaaatgtagaggcacgctaaaggtcctttctgccacccttgtatacaatacatgtctgcatcttgcctaatcttaattaaatgtctttattaaatctttattaaattaataaaatgtcttctgggtctgaggactgaaattctgaaatgtaaccaatatttaagagcttaaacagtgcttctgtatagaacttgtagtatgaaatatgacttcaaaaaagcctgagctgtagaattaattttttcaattgaatgagtaatactgctttaaaaaatatacatggccgggcgccgtggctcatgcctgtaatcccagcactttgggaggccgaggtagggagttcgagaccaacctgaccaacatgcagaaaccctgtctctacttaaaaaaatacaaaattagccaggtgtggtggcacatgcctgtaatcccagctactcaggaggctgaggcaggagaatcgcttgaagccgggaggtggaggttgtggtgagccgagattgcgccattgcactccagcctgggcaacaagagcaaaactctgtctcaaaaaaaaaaaaaaaaaaaaaaaaatatatatatatatatacacacacacacacacacacacacacacacacacacacacatacacacacacatcctttttatggcctcgtgcagtggctcacccctgtaatcccagcactttgggaggccatggtgggcggatcacctgaggtcaggagttcaagactagcctggccaacatggtgaaaccccatctctactaataatacaaaaatcggccaggcatggtaactggcctctgtaatcccatctacttgggaggctgaggcagggagaattgcttaaacctgggaggtggaggttgcagtgagcagagatcgtgcaactgcactccagcctgggcaacagagtgagactctctcaaaaaatatatataggccgtgtgctgtggctcacacctgtaatcccggcactatgggaggccaaggtgggtggatcacctgaggtcaggagttcgagaccagcctgaccaacatggtgaaacccgtctgtactaaaaatacaaaaattagccaggagtcccagctactctggaggctgaggcaggagaatggcttgagcctgggaggcagaggttgcagtgagccaagattgtgccattgcactccaacctgggtgacagagcaagactccgtctaaaaaaaaatctatctatctatctatatatatatatgtgtgtgtgtgtgtatacatgtatatatatacacacatcctttttagtttaaataatccattgtattagaaagaaaaagttacactagtgaatcagctctacagttttcagaaggtgaatcaaataattactaaattgaagtacagtaagatgaactatcatgtgaaattatatttccctataaatttcttatgaaatcttgcattgatttgtgcatgtgtgtttgactaatgaagtgaagtgtgggactactatagaatttagatttaatgcctaggtaatgggtacttgtccaattacaggtcttcatgaagtttctaatgaaaaaaacactaaagagctcttcttctcagctgtatcataaatgacaaaaatctcagctccccaggcctaagtcagtaataagtggaagagtgactcttctagttactaattcatttgtggagttttccaaagttagcttgcattgtaagtttcttataaggaggatcatttcatgagagttggttttttgctattgtcacaattgtgtaatcgtccccatagaagcatgatatgcatacacttaacacattcaatttgtaattcttcttgctagtaaagccaaaaattctatcccatgcttagacatccatggaggtgatcattataatgcattatttgtcaaattttattctttttcaaaactccaaagaaaatgtgacattctactatgtctttgaatctctgattatatacatttgtttatgttaatctataacatgttacttggtttctttgaagctctgttttctagttgatgatgctaaaatttatgttaattcacatctaggtgtacttgaaatcacctaatttgaaattgcagttcttaaacagctctaagaaatataattatgtaaagaatattttgaatgaaattttgaataaattggtagaaacatagttaattgttcgctgcatcccaaaacagtaggcttggaaagtgatgcttttctactttaattttaaatcttgtacattttataagaaaggagtaagcctatccccatattaggcaagtcagattaaatgttagttccattaattcagagaaaataagctcagttaatgatgattcaatgccagttgaaaaataaacagatatgcaaaatcttggtttcttcctgtaatttcttaccatttttttcagtttctttgttgttctgttaaatctttagttaggttatggtagaatgccgtggtacctcattgttctttaactctagtgattggttgtttttaattacattaatggtagttttttgttttttttgtttgttaattttttggtatatcaaacattttctgttaaaggagaaaggaaagaagagctttgacttacaaactgacttgaaagctattccagcaattggttgtctttgaagtaggcaatttaccctttttttcccttcaaaatcagttatactacatatttcctttttgaagcaggaaagaatgaactgtgcatcacagttctgttatctatagcaaatctgtaactcctgaatcctttcttcccgaccccacccaccctgggggctacttctctaccattagtttatggtcatcagagaattacaacaagtagagcagcacagccttgtgctttctactctaaaggtattgcttccccagacaactgaaacttgagttaagcccatgccccaggaaaagaaaggtcaggaagttattttgctttctggaaggctacagagatgagagcaaaggagatgaagagccttggcatctactccagaattgcttttgactgccagacttcgatctaatctctatggcacatcatcagcattcactgtgtacctcatacacaaaagcagaagagtagctggatttctttaaaattgtgcccttcatttgtttcccttgcatgttctatttccccaattaactttgtgagccctgggcaaattagttaacctcactgggcctcaaaggcctcatctataaaatgaatggtttagaatagatgatctttgatcccttccattgcaagcattctatgctgtgaaacctcaaggctgtaaactatatgagagtaggagccaatttttttttttatcattttttttatctccccacagggcctaatgtaactttgactgtactaccttgctttcactatgtgaagtagattttgaagacagctctaatatgtactaaactcgattagaaattagacatcccattttagttgaaagtcagcttattaggtagatgttatatgaacttgcttatttcaaaaggaaaaaaaattctgggaaatgaatcattgggatggaattaagtaatcccatttaggaaaatagtactttaataataggctatgaaagagttatgggttgaattgtcacccaaaaaggtatgtttaagtcctaatccccagtatctgtgaataggaccttgtttgtgattggaggctttgaaaatgtaatcaagttaagatatggtcatactggatgagggtgcaccctaaatccaatgactggtgtccttataagtaggccatgtgggacacaaagacacacagggagaatgccacgtaactgtggaagcatagactggagtgatgcgactgccaaggaatcccaaggattgatggctaccataaaaagctaggagagagaagtgcaacaaattctccatcagaaccttcaaaagaaccaaccctgccctgtaccttaacttcagaattcttgtgtccagagctgtgagagaatacatttctgttattgtaagtcacccagtctgtcataatttattatggcagacctaggaaactaatacagaagatgtggacactggcctaggaaaagtccccaaagaatacataaagctctggactggaacagtcatagcttgcaactaccgtaggacatctactttcagcctaggatgtcttcatattttataaaatataaatctagatagtaatagaacattaagatctttggagcaactcaccattccttacgagatcaggaccgatcttatacaaaccctgatcagctgaattaggatcacatttgttataattattaccgatcccttgagagccacctttgacccagcatatcatacccacaagcctaagagtaagctgcagaaagactgtttcttagaatggttgtccattattgactaccctcttctaccttatgcatgtttcttttgtccttttttcgttaaccatttataaagttagatgctaaagaatattgagctcagaaatagtatttccaaataaacaatgtgtaaatcaatttaagctgtttacttccccattgggaataatctctcttactttctacctatgaaaacttcacccaggctttcaccatgcatagctcagatcccatctacctcatcaaggcttcgttgaattccccatttgaaagtaatctgcttgctgtaattacataacttatactctctatgtagttctgttgacacttagcaaaaagtaccctatattatagttttgtttttacatctctgtgttttattgttaaagaaaaaattattctgacacttgttaaatatggtaaggctgacttcattcagagggactactacagtggaattttgtagtacggtagtgagattaagccaaactccacacacaagaagtaccaagtggacatttatagccatgaaccagggtgggggtcgattgatggaaaattactaagaggaaacatcaggcctaagggcattccagctaaactgacttgacaggattcttgctgaagtcagaccaagatgataagatatccagagtgaggaataaggaatttgatcagataatcaagggtgagggatctgcactaaactaacccagtagtatttttgctaaaacaggactaaatgagccagggacagagcctaagtttgggtctagttaaaaagggagctcagaagaatctgactcaagtttggtcaaaggagagagtctgtcattatctcctcaatgagattctagagaataggaattataattcatactcttttgtatctctactccctactgcccccacccccatgaaaaacagtgtatgcatgtcataaagtagtttgtaattgagtatttttcattgatggttgactaattttgacagagccgacaccttaattcaccagttaaattggctctaggcacagccttgcacaactcatcattatttgactaaatgaagacaatatattctaagactctggtacagaatttctggttaacagtggttggcataatttattctcttgcctgccattttcaagtgatgttactgctttgaactcattttttaaagtaatatttataaatataactggtaaaagtgtggcatctttggccaatgaaaagaattgctgtcagcttgagaaaagaaacgtaaagcactaagtatactagaaattgcagacatcctcacaaaagtgatggattaatgaccacatacagcattatgaaagctagttatggtttgcttaaaccagtctctctctttatggcattctcaatctttttaaacagctaggatataataacattttaaaaattaaagtatttcacataaccaagaacttgatatgaaatgagcaacattaagcacaaaacaattgaagcttcaaatactggagcaggcaagaattttaaacagcccgaatgaataaggatgcaacattgttgtgcttcttcagatgcaggaataatcaggctcagaggttagcagaaagagattttatagcaataatggctccccataccatttttctcttgtgactttgactcacaaaggtgaagctttcatttgaagatttgatacaatgcagctgccaacagcaggggggagaatttggccaaatggctggactctctcaaacatctgtgagggacagagattgagagggagagacagggagaaattgagagagatataaaaggaaaagaggaggggaccaaaaagaaaaaaaaaaaaaaagatttgcattaccaatgacaaatcaaagttgaaagtttgcctttcctgttgtcattcattgccattcatatttagaaagcagactgctgtgataattgatttgatggtccagcttgagtggaagcacttctgggcatagcagcctcagagatgccaaaaaagaagaaaaggtgggaatgaaataatgcactactttctcctcagaggcatgtggcccagtttttaagagcagaaaaacatgctctggggtggggggagtagaaacctaaagaacttagtaataaatacaaaaatgaccatatagctccagtcagataaaaataggcattcaaaccaagacaatgagaggacatattttactgacaagtgaataataggggagtgtggtggaaataatctgatttttaacagactctgtcctttgggagtaccttttttgctcttcttttatatagagacaaaagtgatttcttttctaaaaagccttttaatttttaagcttttcatactagattgatagttcagaaggagaaaaagaaaacaataattgagactgaaaagctatatatgtgcccggattatgtaaacatcactgaatttccttgaagcaataggtaataatgaagcttgtccttagatttgtgagtagaggttggtgttcagccattgcttcctgctgatatgaataagttaggaaactaaagtgccagttgaagggggcaaaagagagagagagagaaagagttttttaaagtactgaattcactgcctgacctcttaatcacaactgccaattggattgtatgccctgtcattccatttaagaacctaaacaaaccagataaaagacatagctgtcaaaacacaaattttaatcagaacctgtttgtcttttgagagaaatatacttgtgttcaaaagtagatcagtcctttaactttgttacctttctctcttttcttccctctcccttctatcttcagttctcctttcttcatttacgtacctagctagctgcctctacttatacctacagagaaagcctgttgtttggcctcattgaatgtgtcatacatatgcagctgttatgcaaatatcaataccgtcccatcacaatttctgttttcctggtaaggttctcaactacagtgagacattaaattttctgagttaaaacaacaacagcaacaaccaaaaccctcaaatgtatgacttatttttaaaagattcatccaaaattaatatggaggaaacagtgttagctgtcagtataatgtatgacagtatttctgaaaatcttttaaaaaaatcatgagaattacctgggaaacttactaaaattcattatacaatgtatacctatatcaaaacatcacgttgtaccccataaatatatatagttattatatatcaatcataaattgtttaaaaatttagagtatcagaccataccccaggtcttgaatcacagtatatagtgctcaggaatctacattttaacaagtgcccagatcatttttctacatactactgaagtttgaataccagagacataatagttaaagagcaatatttaattacatcaactggaatctaattccgtttttaccattactagttgtgtaaacttaggcaaattatctagcctttctaaaacttagtttcttcatccatgaaatgtatgtaacaatgcctacctaatagggttattctgagaattaaataacataacgaatataaaacacagcacagtagctggtgattctaatatcaatacatagtcaatattattgatattgtttatcttttatgatttagaaataggttcttttctatgggttgttcatattgcgcccttgtaaataatagtttctatttccattttatattaacatagacggtacttttccatgtctcaaggatgtataagattaaacatcaggccaggtgtggtggctcatgcctgtaatcccagcactttgggaggccgaggcgggcagatcacgatgtcaggagatcgagaccatcctggctaacacggtgaaaccccatctctactaaaaatacaaaaattagccaggcgtggtggcacgtgcctgtagtcccagctactcaggaggctgaggcaggagaatcacttgaacctgggaggcggaggttgcggtgagcgatatcacgccactgcactccagcctggtgacagagcgagaaaaaaaaaagaaaagaaaagattaaatatcatccccatcacttcatcttacccagtggggaaacaaactattttaaactaaagtagtagcacatgcttactggcatagagcagaacattcttattaataccaactctatgtaaataactagatatatacattattcacatctgaatgtgtaattaaagaccatttaggtactgaacttgatgaatgagagggaaaaatgtctgggatgtcaatgtgatactgtaaataccgaaggcaattcacagtgtgactagtagcaccacctgtctcacacccaaagataattcatcaaataataccacgtctaaactggcagattctttgtcttcatagcctaaaatagagaaaagatcactagattttttttttaaaaatctaatcccaaaacttaccagctctgttacttcagacaaacctcttaaccctcagtgcccccatctataaaataaggataattatatttgccccacctcacagccttgaagtgaaaagaaatgtggtaatgtatccaggaagcatttataaactaaatgctatacaaacaaatggtgttatttcatacctattcaaatggactgaaagtcatttgaaaatgttatcaacttttgaccgtgattgtattctcattttccaaggaagtccaaaagatagattaaatttgaattcttcattgttgtgccttgctgatttttgcttgaggtgatcacactgcattgatgcatttttacacagcttttgttgaatattccttggtccaaaagctttcagctttatggctttgaagctccaattccctgatcaatgtctgaacttgtgaagcttgaaatttgtcatttggcattgacttatgtgtaaatctgagtcaaaattcagtgtcctttaaacatctcggggcaaattttcagcatggcctcatttttactgatatgatcatgtatttgtaagtacagattgccacttttgtcctcaagagagcacaaagtggtcattgcacctgccatgaggtaattgaaggtgcaaaaaatcccacttctacaaaaaagtctttataacactcccttcctttacacccctcccttctgttcctctgtgtgtaccgaaaataaaaaaaaaaaaagaaataatgctattagcaggctatgaatagagatcagcatttcttttcaagaaaaataaactgcatttaatttgggcttctcttaaaaaaataagatacccggtgtaatttaaaataaaaatattgatggaaatggcaatgtctttcataattattattcaattgcaatgttatatactccataacttaagcaaatgagtagttttgactactggaaaatagcatttgaaagtcaattatggaacttccagcacacctatagttttagtgtcctaaacttatcctctaaagttactctagaccaaaagagtaacatttgtttttgatacacccttctttgtgccagtgttctctaagtactttttggattctcgtgctagagaaaaagagctataagaaatgaaagataaacctaacctagggttttatctgttaccagaacagtatatatgttacaaatgacttataaaattacccaggcagtgggagcacttcctagccatttcctggtgtgctacctgtggccattctaagcattgactaaaaattattcacagaccttgattttattgctagtgatatatttacacatactatttagcccagattattcatatactacatatatgcctactagcccagtgcaagtaggtagtcacttgtttacctctcagaaacagcaagctgttatttttcctttttaaaaatttggctatatttgttttttggttgtaggaagaaaacttaacaagagatctaccctcttatcaaatctttaagtgcacaatacaatattgttaactataggcactatgccatacaatagatctctagaatttattcatcttgcacaaatgaaactttatacctgttgaacagcaactccccactcctccttctccccagaccctggcaaccaccattctactctgtttctgtgagtttaactattttaaatagctcataaacgtggaatcccgcagtatgagtctttgtgtgcctgtcttacttcacttagcatatgtctccaggttcaaccatgttgtcacatatggcaggatttctttctgtgtttaaggctgaatcatattccattgtacgtacataccacattttctccatttactctattcattcactgatggacatttggattatttccctatcttggctgttgtgaataatgctgcagtgaacatgggagtgcagatatcaatttgagatcctgctgtcaattcttttttttgttttttttgttttgagacagagtctcgctctgtcacccatgctggagtgcagtggcgtgatctcggttcactgtaacctccacctcctgagttcaagcaattctcctgcctcagcctcctgagtagctgggattacaggcacgtgccaccacgcccggctcattttttgtatctttagtagagacggggtttcaccatgttagccaggatggtcttgatctcctgacctcgtgatccgcctgccttgacctcccaaagttttgggattacaggcatgagccaccgcgcccggcctcaattctttcggacatatccccagaagagggattactggatcttctggtaagtctgtttttaattttttgaggaagcttcatactcttttccataatggctgcatcattttacattcccactaacagttgtataagggttccaatttcttcacatccttaacagtgcttgttaccttttcacatccttaacaatgccttttacattttttttttgttgttaaatagtagacatcctaactggggtgaggtgacatctcattgtagtttttgatttgcatttccttgattagtgatgttgagcatcttttcacatacctgttggccatttgtatgtctactttggagaaatgtctattcaaaacctttccttattttttaaactggctatttgggagcttttttgttttttattttgttttgtttcattttgtttttgagatggcgtttcgcccttgttacccaagctggagtgcaatggcacaatcttggctcaccacaacctccacctcccgggttcaagcgattcttctgcctcagcctcccgagtagctgggattacaggcctgcaccaccatgcctagttaattttgtatttttattagagatggggtttctccatgttggtcaggctggtcttgaactcccaacctcaggtgatctgcctgcctcggcctcccaaagtgctgaaattacaggcatgagccaccatacccagctgttttgtttttttgatcttgagttatttgagttccttacgtatttgacacattttgcatagttagccctttatcagatatgcagctagcaaatattttctctcatttttgtaaattgccttttcattttgattgcttgctgtacagaagctttttagttttatgtaatctcactgtgtttttgcttttgctgcttatgcttttggtgtcatatccaagaaatcattgcccagaccaataccatgatgcttttcccctttgttttcttcaaggagttttgtaggtttaggtcttacgtttaaatctttaacccatttttagttgatttttatatataatgtgggatgaaggtccaatttcattcttttgcatgtccatatccaattttcccactaccatttgttgaagagactttccttttctcattctgtgttcttggcaccccatacaaagatcagttgaccatatatgcatggatatatttctaggctctctattctgtttccttggtctacatgtctgtttttatgtcagtcccatattttttaaattgctgaaggtttgtaatatattttaaaataaggaagtgtggcgaatccagctatgttcttctttctcaagatttctttggctattcatgctcttttgtagttatgaattttacgatgggtttttctatttctctgaaaaatgccattgggacatttaaagggattgcattgaatctatagattatcttaagtagtatggacattttaacaatattaagtctttcactgaatatcttttcatttatatatgttgtctttaatttgtttcatcaacgttatgtagttttcgccgtacaagtctttcacctccttggttaaatgtattcctaagtatttcattctttgtgatactatgcaaatgggattgctttctcagttttgttttcagtactttattgttaatgtacagaaatgcaattgatttttgtatgttgattttgtatcgtgcaactttgctgaattttttaattagttttaacagttttttgtggaatatttagggttttctctatgtaagatcacgtgtcggcaaacagagatagttttacttcttttttttttcctcccaattttaatgtcttttatttttctttttcttgtctagttgctccagctagagcttccagtactatcttgaatataaatggtgagggtgggcattctttccatttcctgatatgagaagaaaaactttgtgttttatcattagtttgatattagcagtgggcttttcatatatggccttaattgtgttgaggtaaattccttgtatgtctaatttattgatagtgtttatcatggaaaggtgttgaattttttcaaatgctttttctgcatctattgggatgattgtgtgatttttatccttcattctattaatgtggtgtagcacattaattgatttgcatatgttcaagccatcctcacatattagggataagtcccatttgatcatgatgtatgattttttagaacttagtgttgaattcggtttgctaatattttcttgggaattttcacatctgttttcatcgaagatactggtctgtagttttcttgtagtgtctgtgactttgtattagggtaatactggcttgattgaatgagtttcgaagtctactctcttaaagtctttaaaaagtgttggggttaattcttcattaaatatttgataaaattcaccactgacaccatctaatgctggatttttctttttgcagagggttttgattactgattcagtctccttgtttgttattggtctgtttagattttccatttcatcatgatttacccttggtaggttgtatatttctgtgaatataaccattgcttcgagattatccaatttgttggtgtataattcttcatagtagtctcttctgatcctgtttatttctgtggcatcagttctaatgtctcatctttcatttctgattttgaatcttttttttttttttagtataaggatttttccattttgtttatattttcagaaaaaaacaattttctgtttcactgattttttttctactgcttttctgttctctatttcatttattttgactctagtctttgttatttccttgcttctgctaatgttgggcttctcctaaatttgttctttttctggctccttgaggtataacattagattgtttatttgagatctttctacttttttaatgtaggcattttatcaccataaatatccctcttagaattgcttttgctctatctcgtaagttttgttatgttgtattttcatttttgcatgtcttaagatattttctaattttttttttaatttcttcattggcccattggtttttaaagagtgtgttgtttcatttccacatatttgtaaattatccaattttccttctgctattaatttctagtttcattccactatagtcagaaaagatactgtgtaggatttcagtcttaaattcgttgagactttttttgtgacttaacacgtgatatattctggagaatgttccatgtgtgcatgagaagaatgtgtatttcacaactgttggttgaaatgtcttctgtatgtcttttagttcctcttgctcttagtgttgttcaagtctattgtttccttattgatttttttttttgcctggatgttctattcattatcaaaagtgggatatgaattatcttaccaataccatagtgctgtctgtttcctacttcagatctgtcagtgtttactttgtatatttagatgctctaatatttggtgtatatatggatttataattgttatatcttcctgatgaattgctttcattattatgtaatgacctttttcgcctctatgtcggtttttgacttatagtctattttgtgtcacataaagtatagccactcctgctctcttttggttaccatttgtgtggaatatctttttctgtctctttactttcaggctatgtgtgtcctcaaagctaagtgttgtctcttataggtagcatataattagatattgtttatttatctattctgccactctgtgtcttttgtttggggagtttaatccatttgcatttatttatttattttattttttttgagacagagtcttgttctgttgcccaggctggagtgcagtggtgcgatctcggctcatggcagcctccgcctcctgggttcaagtgattctcctgtctcagcctcccaagtagctgggactacaggcgtgcaccaccacacccggctaatttttgtatttttagtacagacagggtttcaccatgttgcccaggatggtctcgatctcctgacctcatgatccacccaaagtgctgggattacaggcgtgagccaccgcaccaggcctccatttacatttcaagtaattattgatagggaaggacttactattgcccttttgttgattgttttctgtttcatagtctttttgtccctgttttcctctcttgctatcttcttttgtgatttgttgattttttgtagtgatatgctttggttccttcttctatttcttttgtgtatcttctatagttaatttctttatgattaccatgaagcttgcatagattgtcttacagttacagcagttctatattaagctgctgacaacttaactgcactcacatacaaaaaccttccacttttacttctccctcaccatactctgttattgatgtcatagtttaaatctttttatattgtgtatccattaacaaatttgtgtagttataatcttaatatttttgtcttttaactttaatagtagagtttaaagttatttacagtccaccattattgtagtatccgggctgggcacagtggcttctaatcccagcacttcaggaggccaaagtgggcaaattcattgagtctaggaattcaagaccagcctgggcaacatggcaaaaccctgtctctattaaaaatgcaaaaaattagccaggcatggtggtgcacaattatattcccagcttctcaggaagctgaggtgggagaatcagccgaggctgcagtgagctgtgatcatgccactgcagtctagcctaggcaataggaatgagaccctgtctcaaaaaaaattatctatgtctatatctatattatatatatatagtattctgtgtttgtctgtatgcttgcccataccagtgtgttgtattctttcatatgcttttgtgttactgttttagcatctgttcatttctactggaagaactcccgttagcatcatgtctagtggtgatgaactcccgtgccttttgtttggaaaagtctttatctcaccttcacttttgaaggacaattttgccagatatagtattcttgattggcatttttttttctttcaacactttgaatattataagctcactgccttctggtctgcaaggtttctgctaagaaatccactgatagtcttattgaggactcactttacatcacgagtcacttttctcttgctcctttaaaatttttctttgactttgtgcaatttgattatattgtatctcagtgtagacttctttgggtttgtctaatttggcattctttgggcttcatgaatctggatatccatttccttgcccagatttgaaatgttttcctccatgagttctttatataagctttttcccctgactatctctcttctcctttgagattcccataatgaatgtattggtctgcttgatgatgttcagtaagtagcttaggctttcttcattctttatcattctttgctttttgctcctctggctacataatttggatgacttgtcttcagtttcactgattccttctgcttaatcaagtctgctgtttaatcactgtagtgatttttcagttcagtcactgaaccagaatttctgtttggttatttttatttatttatttatttatttattcatttatttattcatttatttattgagacggagtttcactcttgttgcccaggctggagtgcaatggcacaatctcggctcactgcaacctctgcctcccgggttcaagctattctcctgcctcagcctcctgagtagctgggattacaggcatgcgccaccatgcctggctaattttttatttttagtagagacggggtttctccatgttagtcaggctggtctcaaactcccaacctcaggtgatctgcctgcctcagcctcccaaactgctgggattacaggcgtgagccaccgcacccggcctggttatttttttttaaataatttctacctctgttagggccagatgtggtggctcatgtctgtaatccagcactttgggaggccaaggcaggtggatcacttgaggtcaggagatcgagaccagcctggccaacgtgatgagacaccatctctactaaaaaaaaaaattacaaaaattagccagttgtggttgcacatacctgtaatcccagctactggggaggctgaggcaggagaatctcttgagcctgggaggcaaaggttgcaatgagcccgagattgtgccactgcactctagtctgggtgacagagtgggactccatctcaaaaaaaaagaaaaaggcaactcaaacaacaacaaaaaaaccagcctgagctgggcatggtggctcacacctgtaatcccagcactttgggagtctgagatgcgtgaatcacttgaggtcaggagtttgagaccagcctggccaacatagggaaaccccatctctacttgaaaaacatatttatatatatgtatgtatatatttgtgtgtatatatatatatttatatatatgtatatatttgtgtgtgtgtatatatgtatacacacacacacacagaaaaattagccgggcatggtgtcccatgtctgtagtcccagctactcgggatgctgaggcaggagaatctctttaaccagggaggcggaggttgcagtgagctgagattgtgctgctgcacttcagcctgggcaacagagcgagactctgtctcaataaataaataaatacatacataatttctacctctgttgacattctcattttgttgctgaattattttcttaatgttgttcagttgtctatattctcttgtaactcactgagcttccttaagatgattattttgaaatctttgttagcctattcatagatctccatttctttagagttgtgtattacgatttaatttgttcctttagtgtaatgtttcactgatttttcttgtttcttatacttttgcactggtgtctgcacatttgaggaagcagccacccttcccattctttctggacttgtttagacatggaaagagcttaaccaattcactaggctagagattctaggagcctctcaaaccttttctatgaatgtgtcttctctggatttgtgtgggaggattcctaattagatggatttacccctagcacaattcatagagccatgctaatgtcttctgaggcaggacagaatccagcccgaccctggtggttcactgaggccagattgttgggaacatgttccatttctctcctatcacagtggaagaagcatcaggctctgtgccttctctcaatcttgtagagctatgctcaccacagtaagctgcctgccctttttcctttgttcttaattgccctgaaacatccaagctatttcttttctatcagtgtcccatgtgaggtgagatagaaactagcccttcaggcagtgcaccaaaaggctggtacattggaagcattctctactctgtattttcccctgagaaagaaactgtgggccaaagtgatatttttcagtgctgagctgtgatggcttgggggaaggggctaatactagtaaagtgaaattgctccttactcatttcagtagagttttttcagttttgtgtttctctggtgtactgcaacctcttaaaaggattctggtcttctcataaaggtattgtggtctacattgttaagttggtgtttctatgggagaacaagagatggaactttctatttcaccattttgatgatatcagcaagctattatttaaatgagaagtttcctttacttagatgagcaatataatttaatgcaagtttgtctatggatttctccttgagtgactacattacaaaaggccatctggaattccctttctacacatcactgttaaagcaaaaaactatatttaagtggtaccaaggtatcaggattccctgcagacagtttgagatctaatataaaatcaaaaaccccttataggccactggtctaaatgatgacagtaaaaaattcccaagactattaagttttattaatgaatatgatggaaaataagatcttggaatgtgaattaaatgtttttaaggtgatgagtgggtaagaaagagaggtgataaaagtttttgaaaacttgttttcaaagcaatactattacatattaaatatacagtttaaacttttctcatcctgctgacaaatacatacctgagccaagattactgttttgtttcattttaaccattcccctacatggtaatatctatagtgaatgaccatttctggagagttttactttgatatgttagcacatcattacctgttaggtagccccaaaatgtaaataaattatacctcattccatattgtcaaaacatagaaacagcaacaaagatacctaaatgaaagaagctgtgattgtttttcaaaaccaaagaagagaagtgtaagaaaagcattgaatttaaggggcagaaactatcccagaaagttactgctagaattcaaatactaaagaaagtaatagaattatacctttataaagatcaagggtaacaaatttgaattggtaccttttttttttttttttttttttttgagaaggagtttcgctctcgttgcccaggctggagtgcaatggcgcgatcttggctcaccacaacctccatctcccgggctcaagagattctcctccctcagccttctgagtagctgggattacaggcatgtgccaccacgcccagctaattttgtatttttagtagagacagggtttctccatgttagtcaggctggtctcaaactcctgacctcaggtgatccacccacctcggcctcccaaagtgctgggattacaggcgtgagccaccacgcccagcaagtaccattttcattcttaaatttgttcatatgttaaaaaaaaagaaaacataagcatgctttagttttccatcttcacattaggtaacacaatgaatgaatgaatatagttattttctaatactctcacacagattggttcttccatgggtaaatagttctctgtagccctgaattagattttttttttttttttttttccgagacggagttttgctcttgtcaccaaggggggagtgccatagcactcaccatgtctcaccatgttggccaggctagtctcgaactcctgacctcaggtgatccgcccacatcggcctcccaaagtgctgggattataggcatgagccactgcacccagccatgaattagattttgattgatgaaaagggagataataattccaataatcttatgttccataaatgaaattttaaaactgatacatttttatatttaaaaacttcaaaataaatagaaaaatacaactttgagttgtagttttttttagtggtcaatctgatgagcttgggcccgtataaggtatgttggacaagaaaacactatcctaatcaatgttgacttaactgaattcattcagataagtggaaatattgttagatttgttgactggaaggaagtctgagtttgattagtccaaaggtgatttgaggaaaggtggtaagctgaacatgacctcccctgagtattactgaaaggaaggagaatttgaaccaaattttaagatttggccaggaccaaataagatatcattgcagaaaatctgtgctatatgtcaatgacccttcagaaaataaaaagtaaagataaaatggagttggcactccatctctggcctgtgtgtgctgcccccacccccacgcctcccttctgtctctcaagttttgagatcacccctgttaacctcctcttctcttccctggctcagccaatttgtaagctctgatcacatttttttttttttttaccacattctctttgtaccctatcttttgctttcttatagttgcttaatattgtgtaacggaggccaggcacagtggctcatgtctgtaatcccagcactttaggaggccgagtttggcggattacttgaggttaggagttacagaccagcctggccaacatgatgaaaccccatctctactaagaatacaaaaattagcgaggtatattggcacatggctttaatcccagctacttgggaggctgcagcaggagaattgcttgaacccgggagttggaggttgcagtgagccaatatcatgccactggtatattggaagcattctctactctgtcttttcccctaagaaagaaattgcgggccaaagtgtgtaagggaagggttaaaatgagtgagtgagtctctctctctatatgtatatatatatcatataacagtctttttctaattccaaggaatagaggcatgctaaagtttttaaaggtaatatagggttaagaaaatatgaggaagaaatatcacagtggtctcccagccatggctcatcaaaactagaatgttctgactacaacagtggctctggaagtctgacagcacctctgacatattgaccaccctgctggtagtcttcctttaggagcaggtttgtgcttgattccagttgtaacttactaatccttctattcttatgatttgccattatggtgtctcagctactgcatttttatttttctgtctatctaattcttcttttatttccttaacaatgaatgaactctctgttctcctttctatatcagggtatctgcttatttatggtttctactgccatgtggcttttaacatcctctctctcttagcttctgcttctgcctaacatacatatccgtttctgcatgtgtctcattaagttaccccaagaaaaatttggtttgtttggttcagagcagagattttctgctggaaaaatctctcatggcaatctatagatagttttctttggtacgtactcattatctaatctcttatgattggggtcatacgaaaccaaacattgtgacctatatgtaaagtacctctttagcaggagactctaaggtatctcagaagagagtagtacaacagagatattatttacagaatattctgtatattgagcccttacatcaggagacttgaggtactagatgtttacttttactatatatcattgaatcaaagatagtatcaatcataagatattacattaatttatttaccattgagaaaggaaaagatgctgccaatgaaatcacagcacaccaatgattgttagatgcatctcagtctcagagatgttaaaatgtgaaaaaagtacatttttaaaagatgtaatgtggtgtcagtagcatatctgagattgtctgaggatcaaagcaggtatagtgaacccccagagaagttccctgaggactgactcctagagtggggtaaatgctaaaggttacaggttggattactaatctgacagaccagagggtagtgtctagagactagatagccagctatctgtctgcaagtggagaggaggccagtcactggtccagagtgtggtttgcctcagggacttggcagatatcagaaggtagatccaaggagaaggtgaattattcctgtattgatttaaatgacatgaatatattgggaatttctgtttctcttaattcctcatttgtgttctgggatcaattcagttgtgtctcttatcttctagaatatctccttgtttattacttgtacattaactatatctctggatgtagggtcattttataaaccaaatgctgtattttgtccatgaggcacctaaaatagcacagccagggatagctaagcttacagttgtgatacattaatgaataacctctggttgttgactccctttttgttattgggagagttaatgtagcttttttcaaatttttagattcagcgggtacatgtgcaggtttgttgcataggtatattgaatggtgagatttgggcttctagtgtacttgtcactcaaatagtgaccattgtacttaatagatttggagatttctcagagaactaaaaatagacctaccattcagccctgcagtcccactattgggcatctacccaaagggaaagaaatcattctatgaaaaagacacctgtactcatatgtttattgcagtactactcacaatagcaaagtcatggaatcaacctaaatatccatcaacagttgattggataaagaaaatatggtatatgtacaccatggaatactatgcagccataaaaaagataactttaattataattatgaatcaacatgtctttctttccatttctactatgtaaatagagcagaaatcccacattaatgtgattagcatagaagaaagtcctcactgaattccccttgctctcttaccaactggctggacatggcataggtggttatctaagaatactcccatgaatcttcacagcattcagagatcagtttactctgggtttgttagatatgcgatatgggctagctgtttgttagaaccacatttcccaatgtgtttccactgaacacttattttttctgatgttgctacatgtcttgtgtaaaaagcattgggtaaaagtgctgggtaagttaaagggctctgataactctatataatgtatgtagatttctggctgaatctttgggtgtttactgctcatgggttccactgctattacagcccaacacagctggtatgatttgcaggttggtctcttggggccctttcaccttctgagctctgaaagcctaagataagcaatttttcctttgtccttcaagatgactgtggtctcagcttagactcaagagaactcgtttgaaattgaacaagagcaagcctagctcaagaggatagcaaagtgcctagttttatttgtcactgcactagaaacttcctaaggaataatttttaaaagggggccagttttgtttctgagactcaactagactttcactcatgctctgggggaaggaattcaagtctccaacattgtccttattgtacacctgtagggccagactgattatcctaaattttacatagcctaagaatgagcttagatttcaaaataaaaagctttctctgcttttgcgtagaacatttctatctattatttcagttaatttatccttgttatcaatattgaagtaccgcttgctatacatattctagacatgggtaacaatgtctagaagtacactctgatttcacaacagccattcaaggagatatatatatatatatatatatatatatatatatatatatccttgcaagtgcattctagggctgctgggacatgtgttcttaaatcctcctttgccagttctccaaatatgccaaattgttttgaaatggcattcttgtcttgtcttgttgaatctacacttctattccttccttttgctttttattccaaccttccattttctatcctttaattaaaaagatggctaatatatgggagatgttgtagtccgttgttgtctaaaatgaatttagcagacactcccccaccattccccctccccaagttcagcatcaggaataaaagtctcatcagtccttttggcagcatttaagtgaatggcccccagtggctttatgcttgctaatttgagtactctttttacgtacagagctagtcagattgacagaccacactgtacgaagatatatactagtctttgagtcatagattttgtaaataaactgagaacagtggctgaaaatcagattacctgaaagtctggaaggaaaaaggcatagaatgacctcatctagtctcttttcaaaagcactatatatatttcaaattttagagtttctagagacaattagcaggcagtagttgcaagaataggcagaacccctgtgagatgtataagctgtatgatcttcattaacttatatctaaaagtttaacaaacatatactgacattatttttaaaagacaagtatgttaaggaatttgtcttctacatagtgacaggtatcaaagtgaagaatatggccttttgtttttttcttactatatactaaaatgttgctttatattaaaagatcgtaatttatttccatgaatcaaattctgtacttaaaactgacttctgtttatttatatactgttgtgtgatagaaattctcttgggggaggcaatagaaatattacatgccttttaataaagcgggcttttaaaataatttaattcaacttttcacctcttatgaaatttttgaaaagatattttctaatttattttattttattattttttatttttgagacagagtctcactctgttgcccaggctggagtgcagcatcgtgatctcggctcactgcaacttccgcctcctgggttcaagcaattctcctgcctcagcctcccgagtagctgggattactggcatccaccaccaagcccaactaatttttgtctctttagtagagacagggtttcgccatgttggccaggctggtcccaaactcctgacctcaggtgatccacccaccttggcctcccaaagtgctgggattacaagcgtgagccatcgtgtccagccttatttttttttattttaaatagagctctccaaataatgtctgttttgtattgaaatgaatgaattcatgaacttgctttcttcgcagcatgagggactaacagctagaataaaaataatcaacctaatatttcttgttgctggaaaataattatgagaatattacacagaggaagccatgcttaaaataaaggcttcatattgcatttaaaactcaggcgggactttcaaggattctgtttagtagaataatatattgatgaacccttggagaaccaattatgttgtttcacatgaattacaaatgcatcatttagctgtattatagtcttacatgtgtcctttacaattaatcaccattaaatgttagaaatgtaaaatttaagaggcaaagaaagcatacttctttaacaaagtggcccaaacaaataccagtattttaatttgaggtctgtaacaggtctacagattttattttctcattttgcaagatcagtgtatgaatctgagttcttttaatagatttttcttgcaaaatcttattgttaattgcaaatgtaagttgtgacagtaatttttagtataccactttagacttacttctggaatttgagcaacagaaacatattattagaactttttattatttctgtagctatcttttcaaatatttccaaaacgtatggctttttaagcctttgcctctgcaagtcacaatttcaagtaggcgctgaaattctagtaacgtgagcagtgcaacagtacattgagtcttaccagtaagttttagtgaattatttaggaagtgaacgttgattcccttatgagtcagtccagcctctttctgaaaatagtgttgttcccattatgtgtaccattttgcaggaaaatattgtattccaaggaactgggtgttatcagtaattaagtaggcagaacccatagatattgaatagtttaagttgtaaatgtgataaacttctataatacaaatatttgtggacagaaaatgctgtgagatatggaagcacaaagtagaagtagcatttatgaactgttactaagttccagacattttactaagtgctgaggatactgagataaataagaaataatccctttcctcgggaaattataccagtggtagaaatactccaaagggccaacagtgaaggaatcacaatgaattgacatattatgtactaaatagatctgctcacatcctgaggtctccaggcaaggtttacatgcacttgaactgccctgcataattgctattctgctgacaaaagtataggtgtggtatggtagagctcaaaggactctgagaagtcatatagtccaaatccttcattttccagaagaggagaaccaggcccagagagggtgaagggattttctccaggtcatgtagcaaactaacgacagttgggactataatgcagatttcttgatcctcagtccaatctttcaagtggagataacctcaaacctttttgtttccccattctctactttaagcaatggcacaagaagtccatgggaaaatgaaattccctaaatggggaaaagaggaccttgatagaacgctcatgagatcaataaagaaattaaaggacagggtgaaaaaatgtttaaaagtatgtagggagcacatatagaccagaaagaaaattaagaaaatcccagtggcaaaaataagagaattgcaaagaaagggctgaaataattatccaaaaacaattctttttatgggtaaacaggctaaaatgccataggtctaattttatgcattcaacctgcttcagaattttttttcaaactaaatagtcagctatgttaagtagcctcacattaaatggaagaactctctattatttagcacatttgtatagttgcaacgtagtgatgagtgatgtgtctaatgatggccccaagacagtgtaatgccccaatgtaccttttgagctattgaaaaatatttctattatgttcagcctagttttatttttaactatatttaatattcaaaatcttggaaatgggagctatgtttataatatctctggcaattatctataaatacatctaagttgatcgcagcacttcatatcttagataggctgtatagtagagactttactgtaacgagaaagatcctgaattgttaccctacttgtcttcccagatgttttctttgttaggctttttgggatttctgatttttcttgctctttttcttataaaatgtgaaatatatagcctgtgataatgcttggctgccctgcccaattattgaccaatgtcgatccaattatgcttttaaaagtatatattatgtaaatagattattttaccttctgctgccttataaatctttttttgtacagcagcaagggaagattataatgtcattggctgtcaaaatgcccttttcatgtaagtcagctgccaggcaaggatcctacatctgttttctagcatccatataaatgtctgtgataaataagtcattgctcactggagctgcctttgtgaagcagatcctgtacttactgtttctttcacatgcaaaatgacagcagtcaacctaattgactattacttggtcagtttctgtgtcagaagtgatgccaggtaagtaggagaaatccaaacttaatgcatttctgtttaaacccagaaagatttagtaatagaaaaaacagcaccaatttcaggtttttcagagatgagtgtgttcccaaaggatgaacttgacactactgcattctttctcacaacctaaactggattcttctatgaatctctgagtgaattcttagtagacacattgacatggtataaaatacatcacacggctgtaataaacataggttagaattgtggttcagttttcagccaaatgccaggataccattttcatatgtagtctttcctaattggaaatctagaggatggggtacaaaatagtcatcctaatctgttcaaacatcaatggacaattatgtctctaaaattctcaatactttgcaattaaagagtttttgattcctacattgcagagcaggcctcttcttctgtgactgatgctgccctctcttttctatgtcatctctgctttggaatcatcatcattacggggcatgataccagtcatgttaggccatgctgctgacaatggttactttcaacaagggggagtaaccagggaaaggacatccatcattatgtaatgtaggggaaaaaacccaaagactcagaagccatgttaacaaacacagctggaagcaaggaggcatttgagtaggattacaaacatcttagattgtgcagattagtactagatttagggaaaacatgaattgaacaacctcttttgcacaaatgagcaacctggagtttgcagtaatggagccaatagcctcatcacattttgaatccatttggatgtcatgtaaagaatgaacatatgcagtacttaataaagaaaggtcaattctgccatggtgatcactgaagcataatgcagcaaatgaggtagggcttttttttttttttaactcatcaatcctagaacatttaaatttatcttttcagtaagttgagggatttttttaaatctcctgcatctgttataacctaaatgaacagcagttcaaagccaactccacacctgtactgacatactaaaaatgtcaaataatttgtataaaaatgctgagatgcagtttcactaacagtctgttttgtcagtgtcctccctatttatcagattctaagaggattgttgggttgatgtggctctgtatatttccaattccctcctatttttggattgtactgctttgattatagttaacaaccaaccttgcaagaattcaagatttgtcatagctacaatactttttccacctcatagctttaacagtggcatttgtatgttacccaaaccaaaccactgagttcatcattttcatccaaagaagagtagcttccttgattttcagcataatgtttctggctatctagtgcctttttttttttttttttttttttttttttgagatggagtctcattctgtcgcccaggctggagtgcaatggcgccatcttggctcactgcaacctctgcctcccaggttcaagcaattctcctgtctcagcctccagggtagctgagactacaggcgcacgccatgaagcccggctaatttttgcattttttagtagagatggggtttcaccatattggtcaggctggtctggaactcctgacctcaggtgatccgcccaccttggcccccgaaagtgctgggattagaggcgtcagccaccatgcccagcccttttttttttttttttttttcagatggtaaactaaaaggaaataaaattgtaacctcagctggtgccataattctttcttggcttatagtttctgaaaggtgttgaaacgattacatatttatccatgagttccaaaattgcccctctaattcaagtcattagaaccttcttccacctacaactcatttgaactgtttttcattaaaagtcatgtccaagagtcagttcgagtgtcacgttatttggtcattccagctttcctcctgagtcttgtaaccctgactatcattagtgctgtatatagttctgtccacttgtctccttttcttatccagtagttcttggagggcatcaactatgctatctttgttgttttcacattgcttatacattgtggagattgaatacatttttgatttttaacaaacgttcaatgtgctcttactaaagcttggcaatgacctagatcaggggtttgccaactatggtcagtgggccaaatccagcccatggactagagctaaaatgttgtttatatctttaaagagttgtaaaaacaaagaagaatatacagcagacaccatatgtggcccacaaaggctaaaatatttgccatctggcccttcacaaggaaaatgttgctggcctttcttccagatgctgaggatacaccagtgaacaaaaccgacaaaaaaaaaaaaaaaaaaaaaaaaatccctaccttcagagagcataaattctatttttttacaacaattttatgcagaatacgcatcttatttttgtaaatatgcacaatatttacatatagtacatactcaatatttgtgaaatgaatgaataagtcatagagtccatcatccaatattatataatattggcaaatatttccatatgatgtaataaaatgttgcattttttaaatctttatatgaagaatttttccctagataatttttagaccaaaaactcaaacactacttacttgtcaagacattttattctggtacttagtaatgatttcccatcttaatgtaacttttattcatgatgaggtcctgattatctagcctccttatgagaggtaatcataattatatttgattctgaaagctttctgaaatggtgattctttcataagagatcattttgtatacgtgacagttaaaacaatgagttagtttttcagagtttctatccttgaattctacaagtttgtgatgtttatagcttgaattcagataaaaccattttgctccacatttgaaacgacaaatcttttgcattagactcagagttgactaaaactatggcagcttttcataaagtcaggctatagatgtccctaattcccccacagagcccacagccctttgaaagtgatgatagaatactggggatggatcagagagtgctgagaggagagtggaagggaagaagggacaaagggaaaggaatccagagtgggaagagttggattcgtagagccagcagatggtgttggtgataaagaagattacgtgactcatttctgtaacccatgagtgtcaaagttctccactcagtgccatgtctccatcccattacccccacctaaataagttatctgttctaacacccatctgtccccacaccaaaccatcattaccagcaagcaatttcttgtactgtcctttatcttttaaatattaaaaattagaagtaaatgagatgtgagatctaaaaaaaaaatgacatgaccttttatttatttccactggtcttttaatctaggctgcccttactcctcatagactatacactgcctcttagatactacactgctattagtctaaatactttgctttattatggaactgctcatttcttattccttgcatagatttagggttgataaactgagagtttaaaatgcagtaatggagaatcttaattataaatgaaggaaattgaaacatactactgtatgtgctgatttactttcagattcttgacctttgtcaagactaatgagattacacatctagtatagagaatggatagaaattttaatagacctgcctaatttacattgttaggaattctgtaaaactgagagttatgccagcaaacctacatgtgctgtctttttaattgcatttctccccaccaccagcccaccctcattccctaatatctgtggttagtacctatggagtcattacttacattatgaagtgacaaacataggaaagcatggctttgttctctgaatgcagataactcatatccatcaaagtttctaatttacagagctttcctttgaaggaggctagaatgctgagtaatgatgaaaaagcaacatttgttaaatctgatttggcgcaggacttctttttctacaaagcagtctttcataataccagcttgaatctaactatttctcttacgtagtatagggggaaagaaatatcttttcttcccatcttagattcatagctaggaccccttaacaacaacaataacaacaacaacaaaaaaaaaacagattacccgactaccaagagaaaagcatacaaagttatttatttatttatttatttatttatttatttatttatttattattttttgagatggagtctcgctctgtcgccgaggctggagtgcagtggtgcgatcttggctcactgcaacctccgcctcccaggttcaagcaattctcctgcctcagcctcctgagtagctgggattacagatgtgcaccaccatgcctggctaatttttgtatttttagtagagatggagtttcaccgtgttgacgaggctggtgttgaactcctgacctcaggtgatccacccaccttggcctcccaaagtgctgggattacaggcgtaagccactgtgcccagcccaaatttatttaatatacgtaaattttatgtgacacaggaaatttaattaggaaataaagacccaaagaaacaggaaaacctgtgtgttcttttttttttttttttaaattggcattcatgttgctttttttttttttttttttttttttttactattaggaacttttattattattatactttaagttttagggtacatgtgcacattgtgcaggttagttacatatgtatacatgtgccatgctggtgtgctgcacccattaactcgtcatttagcattaggtgtatctcctaatgctatccctccccactccccccaccccacaacagtccccagagtgtgatgttccccttcctgtgtccatgtgttctcgttgttcaattcccatctatgagtgagaacatgtggtgtttggttttttgtccttacgatagtttactgagaatgattatttccaatttcatccatgtccctaaaaaggacatgaactcatcattttttatggctgcatagtattccatggtgtatatgtgccacattttcttaatccagtctatcattgttagacatttgggttggttccaagtctttgctattgtgaatagtgccgcaataaacatacgtgtgcatgtgtctttatagcagcatgatttatagtcctttgggtatatacccagtaatgggttggctggatcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattatggttttgatttgcatttctctgatggccagtgatgatgagcattttttcatgtgtcttttggctgcataaatgtcttcttttgagaagtgtctgttcatatcctttgcccactttttgatggtgttgtttgtttttttcttgtaaatttgtttgagttcattgtagattctggatattagccctttgtcagatgagtagattgcgaaaattttctcccattctgtaggttgcctgttcactctgaaggtggtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtttaaggtgtaaggaagggatgcagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctgttttggttactgtagccttgtagtatagtttgaagtcaggtagcgtgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggaagtatggccattttcacggtattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactgctgaagttgtttatcagcttgaggagattttgtgctgagacaatggggttttctagatatacaatcatgtcatctgcaaacagggacaacttgacttcctcttttcctaattgaataccctttatttccttctcctgcctaattgccctggccagaacttccaagactatgttgaataggagtggtgagagagggcatccctgtcttgtgccagttttcaaagggaatgcttccagtttttgcccatttagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttgactctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggattttggtctaaaattctcttttttggttgtgtctctgccaggctttggtatcaggacgatgctggcctcataaaatcagttagggaggattccctctttttctattgattggaatagtttcagaaggaatggtaccagttcctccttgtacctctggtagaattcggctgtgaatccatctggtcctggactctttttggttggtaagctattgattattgccacaatttcagagactcttattggtctactcagagattcaacttcttcctggtttagtcttgggagggtgtatatgtcaaggaatttatccatttcttcaagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagtggtctatcaattttgttgatccttttaaaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgatgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagggctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgccttttgttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctctcattatgatgttagctggttattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtatggtttctgccgagagatccgctgttagtctgatgggcttccctttgagggtaacccgacctttctctctggctgcccttaacattttttccttcatttcaactttggtgaatctgacaattatgtgtcttggagttgctcttctctaggagaatctttgtggcgttctctgtatttcctgaatctgaacgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggtttttctagttatacattcttctaaatttttttcaaagttttcaacttctttgcctttggtttgaatatcctcccgtagctcagagtaatttgatcgtctgaagccttcttctctcagcttgtcaaagtcattctccgtccagctttgttccgttgctggtgaggagctgcgttcctttggaggaggagaggcgctctgatttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgtggtgtcagtgtgcccctgctggagggtgcctcccagttaggctgctcgggggtcagaggtcagggacccacttgaggaggcagcctgcccgttctcagatctccagctgcatgttgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctgctgccttgcagtttgatctcagactgctgtgctagcaatcagcgagattccgtgggcgtaggaccctccgagccaggtgcgggatataatctcgtggtgcaccgttttttaagcccgtcggaaaagcgcagtattcgggtgggagtgatccgattttccaggtgccgtccgtcacccctttctttgaccaggaaagggaactccctgaccccttgcgcttcctgagtgaggcaatgcctcgccctgcttcggcttgcgcacggtgcgcgcacccactgtcctgcgcccactgtctggcactccctagtgagatgaacccggtacctcagatggaaatgcagaaatcacctgtcttctgcgtcgctcacgctgggagctgtagaccagagctgttcctattcagccatcttggctcaggaacccaaacctgtgtattcttatgcttaggtttgatgaagaagtggagggtagtggagaaatatgactggacaaaggggatatgatctaataataataaagtgtgggggacttaacaaggcctgtgttttctgattcttttctgtgtccttgtatcttcagagataaggatgttcctttcctctgaatgtggggtttgggggtacctctggaatgaaggttttatggcctgcttcaagagagaagggcaaggggaaggtgagagtgaccttgcttctgctattttatcaaatgccaaggtgacatactgttggtagcgggtcttgaaccccatcagtagcaaaacaagggacttctcactctgaaaagctggtagattagtgaattctacatctgaaggattatactcataataataaacatataaaataagccataaggccgggcaccgtggctcatgcctgtaatcctagcacaccgggaggcggaggcgggcggatcatgaggtcaggagttcgagatcagcctggccagtatggtgaaaccccatctctactaaaaatacaaaaattagctgggtgtggtggcacacgcctactgtagtcccagctactcaagaggctgaggcaggagaatcgctggaacccggaaggtggaggttgcagtgagccgagatcgcgccactgcattccagcctcagcgacagagcgagacaccatctcaaaaaaaataataaataaaaaaaaagccataaggccatgaatgtactccatcaataggtatttactgaagaaatactatgtgcttagtactgtgggaaatataaatgtagaaagcttgctctgtttacttgggtaatcaagacttataaaaaataaaagaattatatgcaaaaacaaatatgtaccaaaatgatgttctataggtttcatatatcctagaattttcaaaataatcaaaattcattatcacatcacatgtttacatttttagtgcaaaaaataggctctgtggcaataggacctcagagaaggacaagatcactatagtttgtgatactccaaaaagtcttcacagaggaggcaacgcagcttgtttatcctacagatattgtgtcatctcttttcagataattgtctgattatacctgtggctatttccccctgaatttcttactagttggtttttggttttgtttctgtttttcaggataaggtcttgctctgttgtccaggctggagggcagtggtgcagtcatggttcactgcaaccttggctcaagtgatcctcctgcctcagcctcctgagtagctgggactacaggcatgcgccactgtatctggcctgtttttttcttttatcttcttttttactcattcataataatgcagaattagaagcaatcccatgtctttgttttatctttatcgaggtataattggcaaattatgtatattcaaggtgtacagcatgatatttttatatgcatatacattgtggaatgatttctacaatcaagctaattaacctgtcacctcacatagtgatggagtccatagtgatggacctcacaggtttttttcgagttaatttttgcattgcttcaacactgcttctaccagagtccccattcaaacacatatcactatggtagttcacagtaacatggaagaaatcattacagagcatttgaactggataattttatttattcattgtggtcagacagcaagtctaattctgttgtcatttttatacaggtgatggtttaagaaaaaaaattatttacagacctcaacagcctatctcgatttctgtatttttcttatcaatgaaataataaagatgagcgcttcaaactatgcctctcacaactttcacaaagcatggcaataatctataatttatgtcactctcacctgtaaggctgagaatcattgacagaacctaaagggagggaaaaaagtcatctttctagataaagtgatgatagtttttcccagcttttaaaaaaatatatgcaaggaatttgtggtgaaatacaatagcattttaataaattgttattaacttgtattactaataaaaatttaagcctattgatctcacctgagaagcttaaaacattgaccagctaaggctttagtcacacatattcttagagtttctgagaaaccaatagcttttatgattttaaaaaatctatttacaaacatcatcttcacattcctctagccctgctttttttaaaggaaaccctacaggcaaaaatgcaatttttccaaagttggacatatggctgatgtcagaaccagcaaaatcatgttatacaaagccaaacgctgagttaaacctcccaatgctgatgttcatcagaccccagaataggtgtctgttacaggatgagcaagatgttagtcatagaagtagaactctgtggagatataactactcacctgcaaaatcaggtggctctgaaaatgaatagcactgtagcgttgggccaattcctgctgcccttggcactgggaatgcaatcttgtatggcaaatcaaatgagcagaaggcttggggccagaatactatcaagctcttctcaaactttaaatggatgagaagtcctgctcactgccatggaacatggcatggattttaagtgcctagtaggccattttattttgttctgttctttcttatttttggtaagcagagctggcagtatgagataaacttacataaacagtgagttcttgatttttatatttctcatatagatccaaaatcagcagcttcatttacacgtagctgtaaaactagaggagataaagtaatagcgtaggattatgttgaaaaatcaggatggggaagaatccccagaagagcttgacattttattaatccctactgaaaaacatgttccaaaatttttaaaaatgtccttctaatagcatatatatatgtatgtatgtgtgtgtatgtgtgtatatatatatatgtgtgtgtatatatatgtttgtgtgtgtatatatatatgtgtgtatatatatatatagttttttccatctagttttctctcagtagtgtctatttaatctagaaagcttctcaagccatgaacttctctatggattagattctgtgtattagagcgcaagtgagtatagctttagtccttgaatgagcagggaaactcctcaatgagaaaatatgggattttccaagaaattcctccagggcccttcctattcttaatcttttctctgtagctgaggataatagctgcataccttctagctcccccaattctagaaacaagaataataaagccttgacaatccatgagaagactttaatctgccctcaggattcccgattccagctcagtttctaatgttcctggatggtgactcatatctcaaaggcaattttggatttaaaatggttttccaaatctacataaagaatttctggattgtttgctgttttaaattagccaaaccaccctttctctctaacagcctgtataattgagagttggctatacattgtttgatacctgtaaaaagtaattgaacattctgaatagtgtattttgatgactgcaatttcaggtgcccaagcttgaccaggttgcttcgtttttgctcacagtggtattcagatatgcccctatttaaacaacccaataaatgaaaataatattttacaagattgataaatgaaggtgatttttttcccctcagagatctcttacttttaaaagagattcattgtattgttagtcatgtcctccgttgcattgaaaacatctgtttcaaaaaaaattcacatttatgggttattttcctcaaattattattttcctcatattgtaagtcacctggatctacaaaaataggctaaaagacagttattaccacgtgtcatattcaccagttctctcttttctttaaaaatgcttagatgtctttaaaatggtttttaagtgtttaaaggaatagtagtccatgcatagccctcagtatacctaagaagatgaagtatacttgtgactctgattgataagaatgcctgtaattttcaacagaggttactgtttcagtggtggcccagatatccatctgtcagtctttgtcaaatagcttatttgttatttttctgtagtctcttaaactgttattttttatttatttttattttttatttttattttttttgagatggagtctcactctgtcacccaggctggagtgcagtggcgcgatctcggctcacctcctccccccagggtcaagcgattctcctgcctcagcctcccgagtagctggcattacaggcgcgctgtaatttttgtacttttagtagagacgggttttcaccatcttggccaggctggtcttgaactcctgacctcatgatccacccgcctcggcctcccaaagtgctgggattacaggcgtgagccacagcgtctggccccttaaactgtttttgttctttccatacattcattccctacccccctgctttttcccaatgttccattctaaaagtgaataaaaaaattcacctaccaaatctggataacaagaatgttatttcattttactttaatctttgctattcttagaccttcttttcttcttcatcttttccaattgaaataaaaaagatttttgatgtatgtacaggctatgtttttttaaaagaactgttaaaattgtgcaacttcaaagcgtttccaaatgttgcattttcaaaaatgttttatcatatttttctttaaatttcctgttgctgtgtagtctcaatgatggctgaaggcactgaattttacattctatattgctttttgtgttccacatctagttagtagttataacttctcccacacaataacagtgcttttgtggaaataattactcaaagatgatttatttctaatgattttttcatatcatgattttaaaatatcttctaatttccacttacataaatgttttccttctctatttagatagaacacagatacatgttgattacatcctaatctatccttcatctacttcccagaaagatttcaggtggtttttgcaacaaaggcccattaaagttaaattaaaagttagagggaaacttttacacaattattccaaatatgtaaattaaggctagttactattattgagcattaaatttagctctgagcttactggaagccaatacagaaaagaaaacatgttatgttttataattcttattatctgacgaaacacagacagtttaaaatggaagacgaagtacaacattgtctttggtaatagttttagagatgatccaagaacgttcttcatgatcacttgtttcatcaacgaaccactttcatactgcctttgtgttcatttatgaaacacaattaaatattgctgttttggtctaaatgtgtctccccagaatttgtatgttgaagtctaccctccattgtgattgtattagaaggtggggcctttgggagttgattaggtcatgaaggctctgccctcatgaatggaattagtgcccttacagaagaggcctgagggagcttgtttgccccttccaccatgtgagggcacagtgagaaggtgcagtctatgaggaagcagtccctcaccagacactgctggcaccatgatattattagacgtcccagctgccagaactgtgagaaataaatttccgttgtttacaagttacccagtctatggtattttgttatagcattccaaatgaactagacaattgcatttatggaatacaatttgcaacacattgtacaaaatgatgtatattctggaatgagtcctcttcccactccttactcccctttccttacatacacattccttgcctttcctcacccccaacaatagttctgggacaggaagattttcatttacttctaaggaggtataaaatcttgatatggtttggctgcccacatctcatcttgatttgtagttcccataatctccatgtgtggtgggagggacccagtgggaggtaattgaatcatggcggtggtttcctccatgctattctcaggatagtatgttctcaggagatctgatggttttataagaggcttcccccttggctctgttctcattctctctcctgctgccctttgaagaggtgccttagccacaattgtaagtctcctgaggcctccccagccttggggaactgtgaatcaattaaacctcttttctttataaattacccagtcttgggtatttcttcaaagcagcataggaatggactaatacaaatcttaattcttcttgtaaacatttattgaacaccaactttgtgcatctttctcttttcaaattataaattatttcaaatgtacagaaaatgttatccctagaactcttaccaaacagactttatagaagtttgtgattagtaactatctgccaatagaagtcatttgcacataggtcctagaatcatagaattttaaaggtgaaaatgaggttaaagaacattcgctaactccttccttttacataaacattaaggacttatataggttcttatacctagttagtagaaaagttgatgacagaacttacgtcctctagtactttttctactataccataatatagatttgctggattatatatacattcaaactgtgcttctattcctgtatgtgataaacccaagcctcgtgtgatcttgttactctctatacagaacttacatccttgattagtatgtagactatcagtttgtttatttttttaagagatggggtctcgctatgttgcccagcctggtctcaaacttctggactcaagcagtctgcctgcctggtcctcccacagtgctgggattataagcgtgagccaccacacatctggcccagactttcaagtttcatagtgaaagtgtctggcagattaatgagttgttgatgcattcagtcaagaaatacttctgaactatgaggttcataatttgaggtttatctggttaaaatcatgactgctttcattagtgctttaattagttgaattctgtatttcagagaggcaaaactaggaactgcattttactgataaaattgagttatactatgccttttaggcaaatggaaccctcatttttttttgtccttatggtcattattaatattttgtttgttcttatttttgcttggagaaggagaactatcattgcattactgcaaacagtatatttatttacctcctgcccatgaacacttctttccctatttggagaaataagatactgtttgttcacagacctccctagtggtctgtctgttaagcagcggcagtcctgaactaagggcacaagaaaatggagctggtaatcacaagcaaataatgcaagacttttaacactttacatgacagattcaggtggggcttgcctactttattatccaaggtgttgctatttcctttcatgcctttggagatcccagaagaaggggagctagctgagtcaaacctctgtctcacagggctttcatgaacaatgacaattcatttcagcctagaggcaaagagggtgccttttcttacgagacttttgttcttattgcctggtgaatttttaaatcaaattggtggaaaattggaatgttttcctctcttttgtccttttgcatctccatacctccctccctcccagtatttttgagaccagatagaagcagatagactcatgggggattcctttgtccctaactcctatctagagtacttccttttcctaatatatatagaaatgatttgaaagaattctaactaacctcagatatggagataatgaccacgattaaatggactgaacatctcattcttatcaattccaattcataatcctattttatttaagtggttatctttgtcctttggaattccaatcagccaaaggatgccagtactgttaataataccgtatgccaagggaaattatttcctctgcttccacgactaccagggttcactttgtggaagctgtgtgataacataatccctcttacccaccacctcttttgggcaatatttgaaaaatgaaaaagggaaaagagctgggggagaaatcattcaagtaaatttacgatagtttcaaaaccagatttgctcattaaaaatagtacttgaaatagatagcagctgtggtttccattttgtaatttttttatgatctatttcatttctgttttctaagctacttaaaactgttgtaagctattgataatataattttccccaaattatttggctcctcatttcattttccctgctgtgttttataaaatttcatatcagaaataagaattaactagatatttttgaaatcatgagtaatttttattcactgtagaattagatttcttttaagaaaaagaaagctagtacagtaaaaatcagcatttcagatgtgggtggcaagaattaactagattttagagtaaaccgtagaatagtaccctcctctttgctccttaccatactttgttttctgagcatttatcaccacccgtcatgtatttatttgttcatcatttgtcttctgctccccactgaaatgtaacctccatgagagaagatgctttaactcctctagttacccaaagactctccagtgcctagaacagtgtttggcaaatatttatagtagttgctcaatatttgttgtattagtgattagcctgcatgagctatctggcttgcccatttcaagtgctgtgatgaatattctatgccggagaaatcatcctccagactggatcgttaccattatcttcatttggcattttattaccaacaagatagtaccccaggtaccatagtaaaaatgacttaagtgctttccatgtccatgtgcctttatattttacttaacaacatatattcttcacattgacatacattcattcagtaaatatttgttgaaaacttacaatgagtcagacacttacttgcccagaaatagaggcatagataagatattgcacctttactgtaactctactagaacacaaccctagaaaaaattcagaatctgtcatctccatagttgtggatttctctacaaagttgaaatttattgttgtttttgtgacaacaacatacgtttcctgatttttctgataccttttgattcatcctcatcattgatgtttctttttctccttgtacattaaatgcttttgttcaccaaggttcaaccctcacactctacacaagaatctttctgtgtgatttcacccactctcatatttttaactgtctatatgcaaatcatttctaactccgtagctatagcctacagttcttcctggaacttaaggcttgcataatgaaatgcctgctggacaattctacctagatgttcaataggcaccttcagttcatgtcaaaatcttaactctgctttttcttctaaaatctattccgtttttgattctttgtaggcggcaccaccatccagctactcactctagcagggaactgggtgtgaaccttgattcttccttctctataaatctccacatctcacaatctctgtatcctgcccgttttccttcctaaatatttcttgaatgtgtcacctctgtggcttcctaactaccattgtcctattcccatgttttaccaactgttgctgagacaactgcagcaatcttctaaatggcattccagcttccagtcttgtcccccttcaaatccctgcattcttttataattttgcccactgtgtccccctgcctggactgccctcccttgttcttttcattggatgaactcctgctcatccttttaaaactcaattcggccccatcaccggggggctatgaatatactttctcagttcttgcatggtgctttcagcatgttgttcccactgaattcccacactgctttgtctttgtttctttacctgcctgtctttcctattagatagtgagctcattgggagcatgtcttatttatctttgtagatccggcattaagcatgtcattgggaacttaataggcccttcagacatttttgaataaatgagtagatgaatgaacaaaagaacaaacagcaaacaaagggtagccttgaggtacagtataagtatatcaaagaatacaatattcttttactttagatatcaaccttataatttattaggagaaataaaaacacaaaagggcagtaatataccagcccacatgtagtctcatattccagtacagttttatctgactttgcctttttgatactgatgacacagggagcatctggggctagataaactgctcatgctctgaactatatgttgaatattttgatagaaactctttttgcctgtggcttatttgtcatatgccgcttgagtgtgaacttaatttgcatgactgcaataaatgaaaagtgtttcttatttcctactttgagtacataaatttgaccttgatcaatgtcagcaaaccaggcctctggcaaccacttcacaattttgactatccagagaagttcatcatcatctttagacaactttaccctggaatggcaggtttagttagtatcagtggagtcttgtcagacgtgtttcctaacaaaaatgacctcaagcaggagtgtgtggttttctctgagaaagcttttcttcccctgagcagatcatagcctccacaaatgtctttgaaacaggcatgcaaagattgctctatacagaagattgtgacaccgaacatgaggttgcttcgaatggttatcctaaagtgacctgccaaactgaagggcaaaaatgccactgctcttgaagtcttaaaatagtatctcttcttgttgaatccatgggaatagaaaaaagaaattgtggtcaggccatatgagaaggaatgccaaaaaaaaaaaaaaaagtcaccaaatccatttagcacttggtaacaaaaggtaagaatagacattgaatactgtactatttttagtatccattccagcatagtgctaagtatgtcttgcctccaaagtgtgttactccttctaccttctccatctctaacagtaataagcccagtcacctaagttcaaactctgagtcaactttgactcaagcttctcattgattccctagaaccattggttaccaatttagatttcattatctcttgaaactgttgtacctccaagtactctaaaattctcttatttgaacatgtccacttccttccacctttcctagtccacacccactctgcttctgcttttccgtttggtattctacaagcctttttcccattcaacttttccatctatctcatttctgtccctacccaactatgactctgctgtccaacatgtcagtacgtactcaaaagcactcctcattcattctctacccaattctcagctgctcctagccccaaccctgcaaataaccattgtccattttctcctctactgttcccggactaattaatgctggtaggcaacgacatataatagtagcatgttgatcaggcccactgcaagcgaaagaaaaattctaaattcattagttagaattttgaaaacaaaacatctgtcctaatacatctacttggttctgaaaaactgtgattactgtagttattgagaggtttctgtaacccaaatacttaactgggtcgtacatgaaaattatttttaagattaaaagtagagcatatattgtactgacagaattttctttaggatttacatgagtctaatctgatagaatggaggaatgtaattgaaaactaggaagagaaatctaggcatggaacttcatcatccaaacatttttttccctgattaaaagcaacatatcagcgtgtgtttttcaaatacaggcagtccctatcttacaaatggctgtagacagatgtagggcatattattgtttgaatcctgattacccaagtgggaaaactttgctttagatgtcagttgtttggaatccagaaagcattttcctaccaaggcagtgttataaatggtggttgggctcccctaggatagccaataatgttactgaaatactatacatttgcagtgaaacagtagtgaacacatttatcatatactactaattaaacaaaagcaataacgttgaataagatcattttatattttgggcttcaatggtggtgcttgaggaaaaacaggtttaattataagaggatgaaaaagtagatggagactgtgtgaaatctcaaaatagggctcatgagcatttttgaagacttcaaatgacacgtgttctttatcaagtctaactgattttaaaacttgtgaacttttacttccctttttgtggttctaagtgttttgtagtacaactgttgtgctatgattctggtcagtttttgactagtgatgaaaataaaacaagggaagaggataaaggaagaggatatggtgccagaggaaaattttgagaagagggggcttatatgcaaatatgaggattaaaaaaacaactttatactttagcaccacaagcattccacaagcaccagcaaccaaaggaaaaggagttctttcttgcttagttcttaggccatcctatataaatgtcctaaatagagataaaagttgcaataagttaaagaggctaagttgagccacactataaggagatgatatgtaaaccgcaaagcttgcatgagctgaggtaggaagagagttatttatttgcttttgttgttgttatttgtttttttgtcttcagttgtgtcttaatctgtttagtgttgctataaaggaatacctgaggctgggtaatttataacgaaaggagatttatttggtttacggttctgcagactgcacaggaagcacagtgccagcgtctgcttctggtgagggctttaggttaattccatttatggcagaaggagaaggggagctggcatgtgcagagaccaaatgacaagaaagagagagggaagggagcttacaggtttttgtttttgtttttaaacaaccagctttctcaggaactaatggagcaagaactcactcattaccacaaggaggacatcaagtcattcatgagggatccacctccatgacccaaattcctcccatcgggccccacttccaacattggggatcaaatttcaacatgaggtttgggggataaacattcgaactatggaaagttgtatggactatatcttggaagacggaaggatatgttggaagtgtgctaccttctaagtgtcaaaggttgagtcagagaaacatagagaaaaaaaggccaaggtgggcagatcacaaggtcaggagaccagcttggccaacatggtgaaaccccatctctacaaaaatatatatatatatgctggacatggtggcacgtgtctgtaatctcagctactcaggagactgaggcaggataatcgcttgaatccgggaggcggaggttgcagtgagctgagatggcgccactgcactccagcctgggtgaaagagcaagacactgtatcaaaaaaaaaaaaagattttagttctgttgcacattataaatggaatcctcctttgatatccttggaaaggatttggtaactacttatattgtttttcagtcatgttttgtattcacattcatttttacttggatatgactctgtactggtagggaactatgaggcaacttggctttattcaagttatataggtgtgatagatttcccaagatcacattaattgagctgtcagtgggggacaaaagagtatgattactctaaagaggaagaatagaggaggtagaagaagacagatatagagccacatagttaattctctttgctgtttaccagctgatgaaccaacaattattcaacaattttttactgtgctgtgttctaggcaatgtgctaagtgcttagagatgcagtggcaaagtacttggaatacagtagtacacatgatattacatctgccctcatatgttttacagataaggggacggtacagataagtagataaggaattataatgaattatgttaagtgctaatgtggaggtactgttgggtattaagggcatatatagaaaaatcacctaaatctgactttcagaattagcacacatcctagagcattctaaactgatatagaaagatgtgtcagagtgaaacaggaaaacagaagttaggcaagaggcaaatattcctgaaagaagaaataatgtttaagattcaatcatacaacaagaagcctagagagagtactgggaaaaaaaaatagccaaagagagatttctacttctgaaaattgtatagtaacttgtggcagaacaatgctctgccaagaatatctacataagccagataacagacaaaaagtctgtttgaaggcattggaaagtagccaagacagccagggcttgagaagttaaaatctcaagcaaggaaaactacagagaaatgaggcatatttccttttggggcatttgccaattcttacagcatgatacagagaagtcaccagaagttccagctatcttataggcttagagagagaggaaaacattgagggctgtcaaggcagtcagtactgaagggggccaaaatcctgaagagagtggatgagtagagaaatgaacttgcactcagtagttttaacctccaggcatttgccaaatccttaagctgttcatgggatgaaaaagcctaacccgtcaagcagtaagtgactgaaaagcagagtggagctttcccactcatagtataaaagaaatagaaaataatgttcagggccctccacagaggagcagccccaagaaacaccccagcatttcatttgggactcttaaagaacctaccctttaggaattggtatgaactaaatatagactgaacttttgaaagactgcaacttcacctatttgttcgttgattccttgattagattaaggtgatctacctctactccagctgcctataaatgatagagagaaccctctctggaggaaaatatcatctagtggctccaagatttctgcaaacaaaatgtctatatttaatcatgcattaattggcttatgaagaaactgaaccaagggaaaaatcagacaatagaaatagacctaccaatgagtcagctgttgacattctcatagacttttaaattagcatgattttttaaattactatgattaataagtttgagaaaatagatgacagtattgagaatctctccaaggaactggaatccattaaaaaataataaagaggtaggaggacagtgacaattagtgaaaactgtttcaataaggaaagagtagctgatactgacttatactacagtgaggtcctttggatatagtaacaaggagcacaggtactaagaagtcctttgggtttcataggtagatcgttggtgagtgcaggttcagtggagtggtgggtaaagaggccatgatggtgataaggtcagatttgaggtgagtagggaaggtgactatggaaacatgaaaggtatgatgggcttaaaattttggtccattaatttgtagtgtcataaatctattatatacgactctttaattttctctagaaacactcatcgacttgattagaaataatagagataggttgtattgttctccttccgtcttccccctttcccattccttcctctcccttccccttccttcttccagtcgttttccatttttacttccttttccactactattttacattatttttctttattcttctttccttttcttcctttctttgttttctaatagaagaaatagaaataacatttgtagattgaggagagagagcttgtatattgagagacctcgttagactcaaagcatgccatcataaatctgagatatttagaatatgtattccagtaaaatcggctaactaacttaatttttacagacatagcatacatcacagttaaaatgccttttagaggcccattctgttttacaagaccaaaattaaatgtatatatgcttatatacatactaatgtttatctgttatgtgcacatatctgtgtgcatccatgtatgtaacaactcagtgttttactgaagtaaatttttaggattgaaagaaataggtttctctagttgtatagactgcttatgagaacattacaattcgatatgtagagagatgatgattacaatttattagtccatcaccatttggaacaatagatggccaaatgtaattaaccattgaaagaaatacattttacgtgtcctaaatttcatttctaattacttgtaactgaaactctctagaatcttaaaatccattttgtcttatgaaaggcttcattgcttatccctgttgttgcactattactttagattagagtaacttcattttaaaattacatgtcaaatataatttgctattagtaacgtggaatgtgtggcttcactctgagaaaaaagcctgttcagcattttttaatatcatatacctaaacagagcttccacgatgattagatcacatctggcacaatgtagatctatttgtacttgcataatgcatgtgcatgtacacactgtgatattttacgactatttgggtacattgatttttctataaagagaactattatccacatctttttgcacagaagtacacttaaatattggcataggtaaacaacttactaaaataaaactcgtgcttggcacaactattactggtgtcacagattttacaactataatatttctgaaaagctagcttgaacgctttggaacatttttttctgagtgaatgcagaggcagtttggtgagctgtaaaacttctacttttcattttgtattctagtctaggccaaatcttaagtgtcactaaatctgattctatcttgaattgtggcccagtgtcatccccagaaggaggcttctccccagcactggctaggtaagcagcctatgtgaaacaaaggaagcggctttgccagcaagcaactattaagaatgggaaagagtttgaaataggctaacgaaatgcaaaaaagtaaatccaaagtccaaaagtagaggcagctttaactctgcactatttttatcttgtgatcctgtttgaagaaatgtctcaattcattataactgaagtaaaagtcactagcataatatggaaacaatcttaaactggtaaatattccttctccttacttaacataaaataaaacccatattaagatattagttcctcctcgtcagcaggggaagtctctgtatagactgtctgaggacatggcagttgactgacactagagtgggcaatcccagagactggaaattgatgtcaaaaaatttggttttgcccgctctgtttaatctgtaattagtcaaatttaatcttagtggataaggtatctgaattgggttcccaaaactcatctttatttctatttttttttttacattttgcaataattatgaatattttgaatatttttgaattttgaacataaaagttgcaagaatagtacttggaaatccctgtataccctttgtgcagattcaccattttaaacatttagccacattcattttgttatgcctcttaaatttttaatacttcaattactgtttcctaagagcaagattattcttgtaggtaacaatagcaaagttaccaaattcaggaaatgtatcattaatgtaatacttccatctaatcaaccatccatgttccaatgatgttaactgtctcagtgataccttttatagcattttctcctccaatgcaagatccagtccagaatcacacattgcatcgagttgttatgtcttcttagtctcctttaatgtggaacagttcctcataccattgcatacactgttaaatatgaagaaaactggtcagttattttatagaagattcctcaatttgtatttacctcatgattagattcaggttatgtacttctgtcctaactactagataagcaaagtatgtccttatggttcacatctggaggcacaaaatgtctctctgtccctcactggtaatgttaacttcgatcatctggtcaatgtgttgcctgataccttcattttataggtattattttctctgtttcaactaataagcaatctgtggaaagacactttacgaccatgtaaatatattgctctacatcaaactccccctctagccttaactactattgatgattcattcctgaaccaatctttaccacaacagttgcatgtcatcttgtattaatttcttttggaatgagaagaaaaacaataatttactctggtaattttctgaagaataccgttgatttcctttgacaatgttctaataaaggaaattgctctctatggaatcgtagtgatctgtatcctctgagtagtttactcattctaactcaaccaaaatgagcagaaattaaaagcaaatgatttttgctctagaatcaatacttatgttcacagtcagtatatatgctctgcaacaagttgtactctgggtatacatatacaaaatttcagtgttgcttaaaaaaaaagcatttttattgacttaaatggaagaattctatagttttttaactactttagttttctggaatttgtttactttaaaacttttcagcctttgcttttccatctctttaacaaattatcacctcattcatttagtcatgttctatttaatttatatatttttattcttttgcctttccacattgcctaaatccttgtggctaggattacttaaatttttctacatggttttcattcacccccattcttataaattatgtgtatcatttatttactaaatatcttggtcatgttcaagaattgaagatgagagttttcagttatcacattgaaaaagattaaaatttattatatacatataaatattatactataaaaatccttatgtaagttctgcaaatcagtattttatatatttagtgaactgcacaaaaggcaacttctattcagtgtaataaccctaattttatttcttaattttaaaattttaatcttttctacttaacattctccataaatagcttattgtagtgttacaatgaaagaaaaattttaacatcctcatgaatcctgactacttagtatatacatatgtaaggtgaaataggttaaatagcttatgtgactattttctagttacttcattaagtctctaatgccttttggataaacaaaaatgatgaaaagtaggtcaattggctacctcagccaggtgatcaagatcaacatcattagagatagtgataagacaggtagataatatgttctcttcatgcaatgagaatggcattttgcctctgtcttccccgagaacatataaccccagtctaattatgcggaaattgtcagacaaacccaaattgagggacattctacaaaatacttgaccattactgctcaaaagtatcaaggtcatcagaaacaaggaaagtttaagaagctgtcacaatctagaggagcccaaagagatgtgatagctacatgtgatgctgtatactggctgagatcccgaaacagaaaaaggatagtatgtaaaaactaaggaaatttgcataaagtatggacttcagttaatgatgacttatcaatgttggtttatttgtttgacaaatgtagcacactagtataagatatttacaacaggggaaagtgggtacagagtttatgagcactcttatactatctctgcaatgtttctttaaacctaaaattattctaaaataaaattttattttaaaagatatgtgtattgggaaagttaaatgttatatgaacagtgatgttggattcttaaaatcagaaagtccctgaaagtataccataaaatgttttttttctaattgtatttatttatttttttgagacagagtctcactctatcgcccaggttggagtgcagtggcatgatctcggctcactgcaacctcagcctcctgggttcaagcgattctcctgcctcagcctctcaaatagatgggattgcaggcacgcgccaccacacccagctgatttttatatttttagtagagacggggtttcaccatgttggccaggctggtcgaactcctgacctcaagtgatccacctgcctccgcctcccaaagtgctgggattacaggcgtgagccactgcactcggccaaatggggtttttaaatacttggtaaagaatagatcatgcccaaggtcactatcatctagctttatattttttaaataacaaagtatacaaatatatactgattattgtttcaagtactatatgttatagagaataagaataggaagtgattaaaagactatggtcccagtacatggtaacattggtgaacacaatttatacaaacaacagagaatagagtcttcattccaaccttttacacatccttagggaaagtgctatgtaaatgatacaattgctttatacttcatagggataccacacaaagggaacacttttaatatcaaaggattctaagaatttcaagaagtttactaaatgaggaattagaggaagatgcaggtaagtatatcataaggaaatataattttaaaagcttatcagtgctaactcaggctcagctattataatatgtagcatcttatggacaaggacaaaataaatctcactgaaaacttaagaccatttttcaccttgaaaactcaatgtggaattttccatgaagagcccttgtcatcaaagcactcagatatagtattgaccatatgaagccacactagtacttctggctcattggaatgaaaatatcatatgagtcagcttttaaattttttaaaaattctattattctgatcttaacacattattactacatgaaatttatcctcaacattttgactagctctttttaagtagactattgtacaggtatgacaagtatattaaaatacacataacaatttcatatttgtatcagagtatatcaaattaccaatgtcttcaaatattccatgctagaaatacctgtttgtagaatttctgtactggatcacttacctcttctttctatagcattttggcttcacacctttctcccataaatccaacagttcagttacacttttttcaagtatgtttaaatattggattgaaaatcatgtaccctgaaacctcataaaactctgtcaccaaagagcatgtcatcagattgagtgggatacaatacagacctggattatataaaaattatacgaaattgtacacaagcaattaagtctaaaatacatttctttactgctgaattataagcacggtattgtgctaggtactgtaagggttgaaaataagctgaataaaccataatctctgttttcaaggaccatatagttcattggaggaagcaaacatatatattcacatatttttattacactatatattcatatttcacaatagaggtaaaactgaattatatggacatatggaggagagaaggattgaattttactagggacatctcagaagcattaagggcagaaaaagtatttgaattgggccctaaatgaatgcaggaaacgtcagtaggtaaaaatgggctaggaggatagggaggtatttcagatagagggggcataaagatggaaaagcatgcaatgtttacaagtagcccagtgcaactagagtgagaagtcagatcctggaaggccaaatatatgactggggagtttgaacatcattctgtattagaggtttttgagtggtagaatttcaaaatcctatcttatatttgaatgtctattgggcaatcatgatagacgggaagagacagaaaccacttaagtgatgctataataaggcttgagtttatttaagtagatacgttcacttaattttaacaggttagttaggtgtggtaaacagcctctaagatagttccgaatgattcctgcctcctggtattcatgttctttgagtttggggttggcctagtgactggcttctaacaatagaaggagaaattgatgggatgtcccctctgagattaggttataaaaagaatgtggttcccttccatcttctgtgctcactctctgtctcacagatcatgagcttccatgttgtgaggacacttaagcagtttatagagtgggccacatgtccaggaaaacctggttgccagcagccatgtgaatggacttagaagaaggtcttgccctggttgaaccttatttgaaatcgaagccttgatcagtggcttgactataacctcataatagaccttgtgccagatacactacttaagctaagactaaattcttttttttttttttttttgagacagtctcgttctgttgcccaggctggagtgcagtggtgcgatctcggctcactgcaagctccgcctcccgggttcacgccattctcctgcctcagcctccccagtagctgggactacaggcgcccgccaccgcacccagctaattttttgtatttttagtagagacggggtttcaccatgttagccaggatggtctcgatctcctgacctcgtgatctgcccgcctcggcctcccaaagtgctgggattacaggtgtgagccaccgcgcccagccaagactaaattcttgacatatagaaactgtgaggtaatacatatttattgttttaagccattaaattttgccataatttattaggcagcaatatgtcattaacagaagtcaaatccaatatctagcctggtttatctttgtactaaattattgaatattttatttctatcatttctatacataatatggcttaaagattactgaattataaataaaatctagaattttctccatattgcttagtataatcttaactattatattgtgaaagctttgtgatcccttgcatttacagcttttagagaaatgaaagatacaggatttatatgtaagagaggtcttagaaacctattttgaaattaaacatttttaatattttctgttaatcctttttaggaaaaaaaaatttgtttataaagtttttactaaagttaaagaacactaactttatggattcactgcagctttgataatgaaaaaactactggaaaagaattaaagaagttgctaatcagttcattaatcaagtgtatctgctgcacattatactgaaacaaattgaaaaggatgctgtgctagccagaaactccctctcaaataaagtcaaaagtgaagataaactaaattgacttttcgtttgtggttgatttctatctaagtagatccatctctaaaacactgaataaagaaagttgccccatacatagattcaagactccactaggattctgtatcttaatactactgagaataacttgaactatatttaatcagtctgtctttagtttttgtttttcgttttgttttcatttacaacccacagaccactttcatttttaaatgttaaatatacttagaaagaagaagaaaaaaacaacatcaccttgctcactgcattaagacaactggttttgtaacccgatcaaaagaattaaatagctttctatatagcttaccctcccacaaaatctttcaatgcacaaaatatttgtcagtggtcagaatgattccagtccatcccactctctgtggtgccttaactataaaaatggcagtgaggcattgcagcttgaaaaaaatacagtcagattttcaattatgattagagtagatctcccagagaggtctccacagaaggcccaaggttctctaaagggtaaaaggagtgacaaaattctgacataaaacaatgtagtctttcctctcttttcttgataccgaccttcaaatattttggggtttttaaaagccaaattctagaagaaattgaaggttcaaaattggaattcgcttgagtttcattaggtttaagccagataccagcctatgtcattttctaaaagcagaataatttagttttaaagcaatagtacaagacgaacaaacaggtacctggcaatcacattaagactcccttggtgtagacagatatgtataacttcttttgacaggttattttgtttattcattcatttaattttggcacttaattttaaaagagcttagaaatcatagtcttttgatagatataattggtatgaatctgaaatcagtaaactaagatgcataagaaatgtaattttctttattttcttgtaactgaattaattctatcttaagaccctattctactggaaggtaccatggaagataagaaaacaaaccacaaaaaaatacacaaatttatacttacttcacatactgtccccaccatgttataaggatataatactcatccattaagacatgagttgcatgtttaccccattatagattatttaggattatgctgaatttacaagtgaaggaaatgagcaaagaaatgccactggataaacagtgttttgctttccagaagcattaatttaagtgactggcccatgattatccatctgctctatcagtgaaagatccctaaagacaatgcttgtcttctatccttgtcatactcagtacactgttcacattagcaagtatttgcccaaaattgctcaatttgggatacagaatagaaatatatgtacagtagtgagtcactgataggatctgagtgaaaattttttacatttttttaaggcttagatgaatggacacagttttctattgttttgtttacctttgtctggtttcccttcccacccccatgcacgtgctcatgtgtgtttaattaaacaaagaagagttccaggaagttgggaatgtcaaatgggaacagacaccttcgcaggagctgagaaaatatgctatatcatttatccttgtggaaacatgcaaaccagatttgaatagtttttaattgatttgcaaactttgcagtagaattttctggtaattagcaacttgctgagattaagtgaagtcatagttagcttcacagtggtttaaatcatatttcattgttttgcatgttttaaaagtcatgttgtaaattaaaaacgcaaagaaaaaatcaccaacttattaatagagaattgatcattatgcaaccaattagaagatataaataaatatacaaatcaatcacgtataaaatggtaggtgctgcagaatgttaacactgtacaggcaagtgcttgacaaataataatgagctataaagatagactagaagcaaaacagtaatgtggcagctttgttggaaatattttctagaaatgaagatgcatgaccttccgtacctttgttaatcatcagttatagatagttaaaatgttatatttacaataattctgtgacttttaaagtaattgtttatacaactacattgagcttactagtggcagtatgttcatatgtacatgtgtctctcttgagctctcaggagagagaaaaaatctgaggaagtgctagcaagcataagcagggagataagaaaaataaactatcttataagtacaataaaaatcacccatgcctcatggataacctaacttcccaattaaacatgacgtttcctccaaaatattaagcgacaaactagaattctgtttcggaagccaaggaaattaaagaaaaatagagtcaagggttaagtagaagagaagagacttaattacatttagcaagggtcccaatccacttagatacttactagggtactcagcacttgttcactgcagcatttgcatttagcacttttaaaattgggatgaaatgagttttatagatactagaggaatcattatgagatcacaaagaagtactgtgataccataactgaagctaggagaagggaaagcaaattcatatcacagaggaaagcaaacttccatcctctcaagttatctttccagtcaacattgccgcatatcacatatggtgtgcaaaaggggacagattaatgaagtactcaacaggaaggtataacaatccaaaatatgtcctttgtgactctctatccatttctgccatattccaaggaaatgcagatgtatcttcatttctatgccatgatatacttgggctgggaatgggggacaaacccagagtgattgttctcttttcctgtgttcatagtgtatatgtgcacacacatgtgagggtgagcctacacctgttcataccccatggcagtctgacttcactgattactttctagaatcttttttcctttatgtgccctggacaagagagtggacaggaaacatggtaacaaaaacaaagataaacatccttctataattctaaagaagcatttttctgtttcctcctaggagaaataaaaatgtataatttaaattaccaattaggatcatgttgggctttaaaatttttggggggtaaattgtatgagggttgcaaaaaagtcatgcagagaaagatactgaaatctcctaatacaacatgttgagaagaaagttaatgatcagtttttctggtagtttttgcatataagcctacttggaagcactgtgtaggcctaactgacgttagtgaatcagcagagagctgatttgaaatgcattatccgataggcatgagattaagcagtttgataggcatcttagagctgtttccatggccttattaatttgtaacagttgtgtggtaagttatgtcaacctcccagtcagaaagtcttcagtaagtttttcaggctccaagttgagggatgggtaagaccctgggacaacaccctagtggaggcttataggagagtttaagcatttctgaatgcttaaattctggatgctacattctggatgctacaggcccagaattccacactaaagtatttgtttggagaactcaagtatattatgggtatcttatttgtattatgtgtaagtaaatatcaacataggtttgatcatttaatcccatatcctgattttgctctaagcgaaggcagttatttgagtgccagctcagaaaaggtaattcactattacctgttaagtgtgatgaaacaggacttctcagcatatctttcttgatggtattttaggttcaaagctgatggattagctttttgccctttcacacattctacctatcagtgacaccatggccaagggagacaatccaattcacttccctgacagaattgtgggtgatggttatatcattacgtatcctggaatgcaagactctgcttgtattgatcttaaacatataagctaaactcagtagcaaaaacataaccgatatatggtggggaaaacgacaagggagtgttttctaaacccaagaaatactcaataaataggctaagaccaagatgaaaagtgcaaagaaccaacaagacaagagtagaaagaatgcggggctcaataaatggtattattctcagaaagtatattccattatctgttgttgtagaacaaactacccaaaacttaatggcttaaaatcattgttcacgattctgcaatctgggctggcttcagcctggcagttcctgccactagtctcatctgaagtcactcacaaaactgcagcccattggtccagggtagtcccattcatatgtttggtggttagttggcaatgtcagcccagcatttcaaatttcatggcttctccagaagggagctcaggcttcttacatggcgcatgtaatgttccaagaagtcaagaatggagactacacagtctcttgagtcctaggtcagaagtcacacatcattacttgtactgcattctgttggtcaaaggagttcacaaggccagcccaggttaaaggggtaatgaaatggattccacctctacatggaagaaggtgcacatagtatgtgtccatatttaaaatgtcacagaatttacaggaatatgaaaataatcatggcaaatgtggtgcattcttaggaagaatttttttttcttttttctttttttgagacagagtctcactctgtcgaccctgggctggagtgcagtgatgcgatcttgactcactgcaacctccacctcccaggttcaagtgattcttctgcctcagcctctcgaatagctgggattacaggtgtgcaccaccacacccggctaattttttatatttttggtagagatggggtttcactatgttggccacgctggtctcaaactcctgacctcaagtgatccgcccacctcaacctcccaaagtgctggaattacaggcgtgagccaccatgcctgcccaggaggaactatttttaatgtccaccattgtatagtgctcccggtacagcctctatttaacaatttttaaaatgtctctacatattttgactctcttaaaagttaataataatgagaaatatttacattgtattcattcaataaacaagtactatgatttctctatcgcgctcagatctatcagaaaccttaaatgtaaatagatcgtttgatgctttattataataattgttaaacattcttcctaagtgcattattgaccattgatagaaaagaaattgcttcatgttatacttattcatcaaaagcacaagaagtgcccttccctgtcaaactccttcaattgtcaccccagcacttcactagagatacaaataatagcacatgaaattgtagctggaagggaaggggaagactggtaaggcttatttaaattgcattccaagcatagaaaacatatcttctttccaaaaaatgaaagctagtacaatattaaatcagtaatatacatacttaaaggcatattattttatgtgatatgttaaccatgacatagagtatctcaaaccaaagtgattcaattgtcattaccatcaacaaaatgaaacttataagtggattgttagcagcctctttttagtttgttgtagagtgttcctctaaagagaggagaggccagaaatcatctcagtacacagacacagtgttgctgcatctccatttttccacaccgattttagtcttgatattacttccctgtggaggctgtctgaaagctaaaagcctatacagaagtaacttaggccaggtcatttttacttactaaaagtcagttttcctataacatgtaccacaagatgttactttaacagttttggttcaagggtcaccagactgtacagactaccagagcttcagcagtggcattctttcaggtggcactctataagttgtctgaatcattgggttaacattctcttcatgttttcatcttagaaaggcaagttaacgtatttttaaagaggtttaagaaggcttaagaaaaagtaaactttttttaatgcattgaaaaaataattttacaatttattcaattcccagagtttttattacagacctactatgtacacaagcatggtgtacccggcagctgtgagaatagcaaagacacagcctcagcctcccaaagtgctgggattacaggtgtgagccaccgcactgggccccagtagatcttttctgtgtatattttcccctactcctctcatctaccctttactccatcctaagtgaatgatgcccttttctctgactatatcttacctttcctacctctatgtctttgttgatcactttcaccctagccactcttcaaggctcgtttcaaacacagatttcttcatgaagacttttctcctgaatacacacactgctacctcaaatccaaagctatttctccttgtttatctcccattgcaccttaattcctctttgggctagagttgtctctgtatcttgtctccaccatccaccaaattttaagacctgaaagtagagacatcattttgttctatctcctaacatactttgcagttaataagaggcaaaataactgtttagttgaattaaaaatgaatgtgaggaaatattgtggccatctgctaaaatgcataggtaacaatgttggaaaagaagtggctcttttttaagtttgatgaaaaaaaaaaaatatatatatatatatatatatatatattcttaaaaaattaatcacttgtccaagatttaacagctaaactaacatttactgtatgttcattattctgcataatatgtttctcatatatgtaaaagcacattatttagtcaaaactatcatattaaatttctcccgtaattcctaagggctgtcagctgctcattaaatcttgattttctgtcaggaggaattaataatcttgcctttgagtgaatttagaagcaatgagggattgagcaggaatatttgaataccctctcggtggtaaattggatatccaattttcaacttagtcttaatgggaaaaaaagaataaattgaattcagaagctgttctttactttttaatatttcctccccacttttaactgagttaaaatggaagggtatagttctttctcagtggtggggaaaatcaactttcattcacttagaaaagtttgtcaaattcgaatgagacttaatatatggacaatctatatgactaagtctataaggtgatcctttggaaatcataggaaaattcagtacaataacacaaaaattgatttgcatgaggtttaaatcgtgtttttctaaaagcaaggaatcctgctcctccctctccccaaatgaattttgttgtcaaatactggtactaacaattattgatatcacaactcagtctctaaaagcaaactgtcctattattaccagagaggtgctaactcacattaacctaataatatatagctcttaattttcagttttcatctttcatcattttttagctactcatgtcttagatttaaagtcccttaaaattataaaaggttgagagactgataaacaggcataaaaccttgtagatttttttcccctccactctttttttctaactaagctacacagtaccatcacgtaccatccatcagtacatttagctgtcatgacgctgccaatagaagttgtccatccactaggcagtataaaattacaatcacgatcttcgctgggagtggcagctcacgcctgtaatcctggcactttgggaggctaaggcaggtggatctcctgaggtcaggggttcaagaccagcctggccaacatggcaagacctcgtctctactaaaaatacaaaaattagctgggcgtggtggtgcatgcctgtaatcccagctactcgggaggctgaggtaggaaaatcactcgaacccaggaggcggaggttgcagtgagccaagatcgcgccattgccctccagcctcggcgacagagtgaggctctgtctcaaaaaaaaaaaagttacaatcatgttctcagtgaggcagtaaggtggaagagtgtatttctttctgtgtagtatgactatatgacctcatgtgtgtcactcacttgcacttattttcaaataccaggcagcagtttgcttgaagttaactatctgttttatcatgcaacttaagaagaagttgtaacacatgcaactccaaattattcttattcataactctgttctatagtaagcatttgaatatggatgcagctcatgtgatgagcatcattctacttgacatgaaggaatgagatccaactgcgaggaccccagtcagaaagagctgaaggcccattgatgcctcaccttttctccctgcttcccccactcttgctagggatcattggcaccaccactcagactgatggtaaaacaagaaattgtcttctgtctagctcagacacatcacttgtccaactcaacccctgctttgggtacaggaagttttaatctggttaagttgaatagagtttgtcttctagcttttgctgtgctaaagcaagagaagtacaaatgtcaacaagcagaataagaagagtataacaagaaatggtaagaagtcaaggccaaaatctagatactgacctgtggataattgagaggtgtcagcaactctcttctaacatcaaacagacataataaaaacctaacaaaagatgttgaagtctgaccagcatacctcttactttgcataggtgctgtttggatttctatgcaagcctgtgcttaaaatcagccttcagattgaatgttgataacctttccttttttacatgcctcatttcagtttatggcattccaaccttttctccctcgtgacgaacacttttttgtatcaatgtgaggcaagctctgtcaattcatctaatcctcaaagaatttttgcagaataagtatgattatccccattttatagatgaagaaatcaaggcccagagaagttcaattagttgcctaaggccatacatctggcaaatgatagagttaggagttgatcccagatctgcctgattctgaaccctttgtttgatctttgtgttgttccatatcatttccctatttaagaaactcatttatatttgcactccataaatatcaagcctgtcgggactaagttgtaatgagttcagcatcaattcctgtttactggtctgggctaaacagtgctgatagtaatgctcatgtgaccactgggaaaggtccaagttcatgctctaatatctgacaacagaaactactcccttctagagaaaagagcagacctgaggataccttgtgcaatccaaagtcaaattccctattcattcattcattcttattttgtgtgtgtctctctctttctctctcttgtgcacctatgcacacacaatttttggtcgatgcacaattttaaggtcatttttaatctaaagaatttgttcccctcttctttcctgattacatggccatacagcctgccccaaacagtatgactcactctccatgactcttctgcggctctttgttgtgagttttcattttgtgcctcatttctgaatatgctctaaagagcagggatggcctttggctagaaagaatggcatgtcaggagggttccacaagccatgttgcttttctgaatcatgaaaaggcatcagcactcagtgacatggcccagttttctaatctaatttaattgaatgtacaatgatgtgggcactggagattaaatacaaccccacttctctgcaaagttcacattgcctttaaagcaatgtaatatttttttcatttcttatgaatggttctgtgtatgtgtcatgtatacttttacttgtattctctgtgcaaagtgataccttaaaaattatctgtaaaaagtctaatataacttggtcttctggaatatggcctgatttaattaattgaccaatattactttaaaccattatattgcagtgaaagttttttcttgtcacagtaggaactagagacgtgtcctaacaaagtactaacttatttgcaactgatataaagtgaattaatatatttgttacttttaaaagagagtgtattttggaattttgcagttatttgtatattaaggcccacattaagggcctgcccatttataaaatgacgggtaattttcccaagtgctgataaaatattttatcatctaaatttgaaaagaaaaagaaactaattttaaaacatttctaatttataacattttgtgactaacttactttttatttaatttatttcctttcattcccctcactgtgatccaatttgtagacaggcaggcttgctaaatagcttcagcatttgggtttgatttactgtgaagtagatcttagaaattaaagtttcaggttgaaatttgcctttcagatctccttgcctaaatatacatgtaaatttgggagtaatctaacatgtgcataaacacattcaaactattttatagctttaaaaaaattatattgaaataattttagacctacagaaaagttacaaggttagtccagattttgatacccccttcacccagattccccaaatattaatgttttactgcatttcctttattaatcttttttctagaaacacatacacacattatttttttctgaatgtttcagaataaattgcaacatgatgccccttcacccctgaatacttaagtgtgtatttcttcaaaataagaacattcttttgtataatagtacatttatcaacattggtaaatcaacattgataaattaccacttaatctatagactttatttaaattttatcagttctcccactaatattctctatagtaagagaaaaaaaatcccagcccacatgttgcatttagttatcatggctcttcaacctcctttaatctggaacagttcccctgccaaaaatgcatatcctgaatctaatcatgaggaaacatcaagcaaatccgcattctacaagataatttacctgtactctttaaaaatattatagtttttagagctatagtacatctccaagtaagcacataggcatatctacatttttaattttctctaagaaagagcaacaattcaaaataatccccaagtatgttttaaaataaaggcttctttttgaaagtcaaagacaaatgctcttagcctaaggtttcatttaaacatagaatggctatttcaaaaaacagtattacataaaatatgggctgggtgcagtggctcacgcctgtaatcccaacactttgggaggccaagtcaggtggatcacctgaggtcaggagtttgagaccagcctggccaacacgatgaaaccttgtctctaccaaaaatacaaaaattacctgggtgtggtggcgggcgcctgtaatcccagctactccggaggcggaggcaggagaatcacttgaacccaggaggcggaggttacagtgggccgggatcctgccactgcactccagcctgggcaacaagagcgaaactctgtctcaaataaataaataaaaataaaatatgtattatataagttagggacaatctggtctttcatatatagacttcagacaattggttgttcattctggagttgagcactatttctctcatgggctcttaagctaagaacatttagctacatgtcgggtatgtttcttacattctgcctcatgaccatctcccactgccatgcatatgacaaagacacttaactctgagccccaaatctagaggagagatctaaatgtcacgtgaagttcttaaaaacctttcttctgaggagttaacaagggatattaggaagattcctctgcccaaaagacctcccaaataacctctgccaactcaggctgcattaagttaaaccagatctgtctgtaaaatagaaatgagaatagctaataatatcaatatttcatacctttattttaactactcttctctggctactttgtgggttgtgagggaatggaacattttactgaggagccaggtgaatgaaagaagacatgcagagcaagaggtctttggtgagagggcctgtttgagcccctactcaagggaattaggagtagcatgagggccctgtatatccacagaggacattcatttttaatttcctctaagaaagaggaacaattaaaaataatgcttaagtatgtttttaaaaagacttttttttttttgaaagtcaaagagaaacgttgttagcctaaatttttatgtaaacatagaaggtgattttaaaaagccattaaggaggcaggggagaggtatgaaaaaatagattgaaggccacctactttacaattttgcctggtaacaccaaactaggcagccaaagcctggcttcaggtttgtcacagctatcggttatgataaacaatattaccatcacttcctggttgtagtctgcatgaatttgaaaactaaaatttgcagtgttcgggagtggtggctcatgcctgtaatcccagcactttgggaggctgagacaggtggatcacctgagatgaggagttcgagaccagcctggccaacatggtgaaaacccatctctactaaaaatacaaaacttagctgggcgtggtggcgcacacctgtaaacccagctactcgggagattgagttgggagaattgcttgaacccgggaggtggaggttgtagtgagccgagatcgtgccgccattacactccagccagggcaacaagaacgagactccgttttttaaaaaaaaaaaaaaattaaaattaaatttaaaaattaaaattaaataaaatttgcactattatgattcagtaaagcaggaatgttataattggttgttttctccttttttcctctgtaatactatttttaggaggatctaggtagatatctcactctgattattcccgaagtatgaagtctcccatactggctatttacatataacttaattcataagacttttaagaaatctctttttgccttctccttattctccagactggcattgtgaagatgagagccaacaaattatacctcaaagtctggaaaattagtcaactgttccacagttgtgcatgaaacatttctgactttgtgatttgtgaaagtagcactgactcagctaaggatcatggaaagagcatagacttagatcagaagactcattctagctggtaactgtgtgatcgtgatctgatcactaagactctgcgagccttaggagtctccccttgcatgaaatgaagttggtgaactagatgatcttcgcattatctcctaagttgtaaactcaatgattttgagtataggaattaacaaagccacttaaggggaaaaaagttcccttcatttcttgatgaaatacttattgagctatgtaccatattccatagaaaggaaaaactagatatcttaaccctactaagttgtttagtgaaaagaacatgaaaagttcagatgaaaagtcaagaagtcaacataggaaaaaacagataaactaataaactgaataagtaagtaatacagcttcaattaagtactggacttccaaatggatggaatcatacctttcagggctaaattgtatttgagaatacctactctgaggaataggtttttatgctctggaatcaacacctcaaaattcaacatttaattcatttcactcttcactcattactcttttgtttttgaatatacacatttttcttttttttttttttcctttttttactataagataaaccaaaaataaatggctaggtagatggctggagtttgcttgtttgttttaatgatagtataactgcatatagaaaagcaatatatgtgttcctatatgaacaacccaaaagaaaaataacttttaagtcatagaactttgaaggtctgcaaatagttgttgacttagttattactacgtgtattagtttgctagggcagttacaataaatgccatagacttggtggcttaagctggataaattaatttcctcaaaattctggaggctagaagtccaaaatcaaagagtcagcaggtttggtttcttctgagccctctgtccttggcccttctcactgtgccctaatgtgactatccctctgtctctatgctctgtgtactaaggacaccagtcagatttaacttaattactactttaaaggccctatctgtaaatactgttatattctgaggtactgcaggttaggacttcaacatatgtatttggggaagacacagttcagcccataatactgcatttatctttataataaggaagaaggatttatattattctactgttttgtgtgctgaatgtatttttaactttggttgtacaatttcccttacacctgcatcagcttatcacattgtgccaaggatgtgaaatgaattgcttcaaaatacaccctaattaattaaatattcacaacatttttatagcatttgatttttttccttgttaaacataacagagaattggatgttgttcacataccacagataagccaataaaccagacattttgtcatactctgtattgataagaatttttttggcatggaaatgatgtattttattgcctttaacttctaatacccccttaattacaaacataatggatgttttactggggatattgtatatgcagcagttgtttaaacctgaaatagaaatgctaagagggaaaagtattcaagtccagtgtagcccaatgctgaaagataaaattgcagcttttgacattttaccaaattattgattgtgttctctggctggctttaaaaaacttaatgcagtgagtaggttaaaaaaaaaaaaaaaaaagaagaagaagaagaaaatggctgggaaagcataaaggcaaaacagttttaaaaaagtatgagaaagcttaaggcctaactcaaatgataagcagtagattttatggcaatggtgccagacagccggggtttgtatcttgactcttcctacttaataactcactatcaggcttgatgtgataataaaataattcatgtaaagcactcagcacatacctggtttatactaaactcaacaatttctagttatatacatagatagacatacactagtacatgtgtatatatgtatatgtaccttgtatatgtatgtgcatatattaatatatgtatgtatgtattcatatacataatatgtatacatattcacattcattttcatattctccagcctccgtttggtacactacaacagtgtgtgtagttgaactaacagctggttctgctgtcatgatggctagaacagcaaagtcagccagagaaaccagcctcaaatggtacatctttctgtaagcagatatatatgatctatagcagcacgtccagtgattgcctcacagatactacttctaacctatgggggaatttttgcatagaaatccaaatcccctcctacctctcctctcagtgcttgagcaatctcttgatacatataaagctttgtaactatccttaagtttttctctggtctacatatggcctttatgcttaactcattgttaaattctcacaggacaaaggctacatacattccatatataacttcagcagcatctgctataagctttcccataccttatacactgaataaatcatgaaggctgatggaatcctgaaatgaacccataatccaataaaatgagaaaggctaaagacctaacctgctctggactcacattagtctagaagcttcaggaactcactgaaaggcaagatagaataatggttagtatatggactacagattcaggaatacctacatttgaatcctggctttgcaacttatataacttgggcaaattatttgacctctctgtgcctcattttcctcatctgtaaaatgataatcagattatatgtttcccaaggttatgaagaataagcttattcatatttgttatgtgcttagattagttcctggtacaaagtaagtgatagcacttactataagtgtgtactacataaataaaataaaataatgcctggtgtctcaacgctggcccacaaactagtctactctacacaggtcttccagaccaagagtgactataaacctaatagacatctctcaacaaggcagctgtaggtctttactgttcatgttgggttttgccagcagaccaagtgttatgaattggctttagccaagggtttcctgaagagattaaaaaaaaaaaaaaacaggctggtggaacatttggtatgtgtgtttctttagtggtttacagtctgtgtttctagtgtctgcatcattaatatatttctctttctggatttagaccctgtcattactcatctgtgtctgttttgacttaaacccatcactggaagaaagaaagaatatgggtctcaatgagttctattgcttcattatggtgataactttagtgcccacaaggaaatagttgcatacccactggctgcaaactaggtctgcattcttcaggaaagatgttatatggcagcctttaagaaatgcagtcttcttttaccttcaactttgtgtcttatttcactctacagtttttaagtgaaggagataagaagaaagagctagctgcaaaggtgagagttgaaatatttttacagagacatcattataatgaacatgatggactgtagttgtaaatagggtgagtgggagaaaacttgaagaaagttagaaacagatgaagaaaaggatttcagataaaaatcagggaaatcaatgtcagtatgggaaaaaagatagtaaggtagaaaaggaacttttaaatgaaaagaatgagtaaaagatgattttatactgattttaaataaaactctgtgtcaaagccttttgtaaataataaggttatagatgattgtcatggtggttatgtttgtttagcaaagactacattaatgaaatggctaagaagcaaaatcttaccaggttttaaatatgagtacactgtgtctattgctctaatttttgttacaaacttaccctaaaataggtcttttaggcaacaacagtaatagcgccaatcgcagttactctaccattctaccacagaccggggaacattctcatgaggactccagcattagatggcccattttagggcacaacacttcagccaaaactttggtagagaagcagtttcagtgagtcattcatgatcctaaatcttttggctgtggcctcaagatctcccctctgttcccagtgggaattatggtagagagacacagttaattgcctgtggattttatgactgtccccttccctgcagccggaatcatcatggaattaaacatgcagggaggttatcaagggactctctcttatgcggactgagaaacttaggttagaccctttgaagaattcactggactgaacatagagtctctactgagtaaaaggatctcctctgttaagttgttcatcatccatttatttattcattcaataaaaatgtattgggtgctgtatgagtttcctagagctgctgtaatatattaccacgaactgtgtgacttaaaacaacagaaatttattctctcacatttctggaggctagaagtttaaaatcaagttgtcagcaggcttgatttcttctgagggcgctgaaggagaatctgttccatgtctctctcctctctcctatcttctgttggttcccaacaaaccttggcattccttgcattccaatttctacccccattgtcacatggccttcttacctctgtgtgccctctgtgtctccaaatctctctcccctaatgacaccagtcactggattaaacttatttccaaatatggctacattcataggtaacaggggtcaggacttcaacatgtattttcgggggacacagttcaacccacaacaggtaccttttttgtaccaaatacaatcctaaatgctggggatagaaagatgaataatacgcggtctctgaactcaaaaacgtcatttaaataggggtagacataaatatacaattatagtgtcacaaatattaaattatatgtctcaacaaaatgctatgggaacacagaaaaacagggcaactaacattgtctcaggaagcccaaaatgtttcactgtgaagctgccttttgagttatagggtaaaggatattggagttcatcgattaattcatagttgtgagtatgcaaagggcattgcagaggaatggaaaaatatgtataaaaacatggtatcatgaaaagactttgtatctttcaagatagggaaggagttggtgtaactggagtctagggttagttgtagggagcggcagaatacatagaagagaataaacaggagatggtagacggcagaggacctgtacaatttcatctcaaagaattggggctttaggccaggcacggtggctcacacctgtaatcccagcactttgggaggccgaagtgggcagatcacctgaggtcaggagttcaagaccagcctggccaacatggtgaaaccccatctctaccaaaaatacaaaaattagctgggtgtggtggcaggtgcctgtaatcccagctactcgggaggctgaggcaggagaatcacttgaacctgggaggcggaggttgcagtgagcagagatcgtgccactgcactccagtctgggcaacaagagcgaaagaattggggctttataacatagaatgtctctgccaagactcttggggatgtgttttaatccttaaagtaacaataaatgtatttaagtagtagtataaaacgaagtgaaacagtagttaataaagcatcttgcaaatttggaaaggccattttgattttgagaaaattatttgaattatagaataattttaaggaaatgctttttaatttatttttaggatgcataggagctcaaactaagttaacaagattcagtcatccaaaccattgcctagtaggtgtccttaaggacccagtcttaataaacaaatacagctaaattataattggcatatcaactgtatgtaaattgaagcttataaagtacttgaggggatttgacaagtttgttctcttaagcattttaaatattactcatgttagttatactatttattatctatggggaaggagtttgctaaaccaaggtaaatgtcaatgctagttcctagacaactatcatgaattctgaattagtcactttttatttattcaacaaatatatattacttaacatctacgaacgagattatgtcctaagtagcaggaattcaaagacatgacaagggcacattcatgtcctcttataactcacagtctagttggggagaccaagatggaaacaaagaaacacattaaagtttgttgagttagataatggtggtgcatacagggtgcttgggtgaatgcagtggaagacccaactctttgttgaagaaggctttatatttagcttgcgaactttgaaggataaaaagtggttttcctagaggacaaagaaactggacagtgtagtgaggatccaagggatcaggcacaatgctttaaaaagttaggagaaatgaaggctaagccaaagtcccagaactgcaaaaaattaagtccgtgtggttttggttaggatgagaggaggcaaggtaggagatgaggctggggggttggccagcagccagtaaggggtctcatacaaaggagttagaacttttatatgatgtacgatccactgatttaagcagaagagggccatgatgaaattgggttttagaaagagacctctgggaacaatttggaagaagaaattagagcagtggttttcaaacatttctctttttttttaacacagagaaaacttttctaaagaaaatcttacatctaaccaagatagataaaataagagtgatatttctttcaaataaatattatgcaaatgaaaacaggctacttcaaactcaaaagtgtcaaattgggggttatagactacagcacctgtgttatattagactcagtatcaaaattatatctgtacacagttagttaggaattatgatggttcaactatttttcaactttacaatggtgtgaaagcactatgcattcaagtagaaattgtacatctctcatcatgctgggtagcaacattgaggcttagctcccaatcagctacacattttcagcttctgttgggtttatcagggcgtaaccccattgtaagtcaaggagcatctgtatttattaccgtactatattgagacaattctgattttctgtaataagttgtaaacaataacggttcaaatgactctccctgtcatgtcatgaaacccttcagttgcattggtctagaaatataaaacagtccgggtcgggcatggtagctcattcctgtaatcccagcactttgggaggccaaggcaggtggatcataaggccaagagatcaagaccatcctggccaacacggtgaaaccctgtctctactaaaaacacaaaaattagctgggcgtggtggtgcgcgcctgtagacccagctactcgggaggctgaggcagaaaaatcgcttgaatccaggaggcggaggttacagtgagctgagatcatgccactgcgctccagcctggcgactgagtgagactccgtctcaaaaaaaaaaaaaaaaagtctgatagtgggaaaaaatccctaacaagagtcaccacaactcacagtctttactgtaaatataggcattcaaaactttcttaaaatgctaaaagcattcatagtgtagtcttacatgtctattttatgtgttcacttttcgtttctacgtacacggtagacatggtaaatatctgttgaattaaaatgatcaaaaacaaagtaaagatttaaccaaaaaaatacagacaatataaaaccatgaagattcaaagtcaaaagtagctatagtctctagcaaggcagatgttcactggcatttgtcctctggtctgacttccagccccaatttatataatcctgacctaccagaaattgggataggtatcacttcatggaaaaagacatcatgctttaagaaagaagagacacatataaacttgtatggggttagaggagctatgtccctctctagttccattagaaattgctgttaagaagggttgggagcaaacctcttccaatcctacccacgtctcaaggcctagatcaaatttcacggtctctgtgtgacacactgatatctcaacacttcctgaaggtgacccatatgccaggaacagcactagatccagagatacaagtattaaaaagatccctgccacctctcatctacatttctagcatctgtttttactcatttgccatttgatcatttcccatctgtatacaagactttaaggcccatgagagcaaagtttctgtaagtttaattcaacctactttttttggccacaagctttgtggcaggcgccatgttaggtattaagaaatacaaagatatagaatacaagtcctccagtagcttgcagtataccatgtataaacctcagatggctactaccgtatacccctcaacagccagttagctgtgagagtaaattgtaaattctttcatgctctggccagatttaaaaacatattaatgtgtatattcttttccaactgtgtcttcttttttttttagatggagtttcactcttgtcacccaggctggagtgcaatggctcagtctcggctcactgcagcctctacctcctgggtacaagctattctcctgcctcagcctcctgagtagctgggattacaggcacccgctaccaggcccagctagtttttgtatttttagtagagacgaggtttcgccatgttggccaggctggtcttcaactcctgacctcaggtgatccgcctgcctcggcctcccaaagtgctgggattataggcgtgagccaccgtgcccagcccaaatgtgtcattttagatttcactttcttcttgagaccatgatgatgccacatgagaaatccttaagtccagctccaattatactgcatatcctagaatggaccattacattaacaagaattttcatatgctaaccatgacatgtacttcatatcatgaatgtagatggctaattttcacacattaccatgcatttcagcattccctagagttatctgaagcatctggggggaagggggagagaacctttaagttttctgcttctgagactattttgttgttattggatatcgctttgacccccttcttttagtgcttatcactaggcatctgccgtatttaatgatgtgtgtcatttcatttagtatcactgacttggatcaattcctcttccaggtttctgtactgtcttgatacatgtatttgttttgctttgaaagaaaaatcaacaattgaattgccagtgatagacatatgagtaggaccattcttaatggatatgtagagataatttctcttcctttaatgtctgtgaattatcatccactgtgatgcatttaaaaatgcaactcaacaacagtagtctactgacaaacaggtgactgctgcctgtgatgtgttttcagttgttggcttttctaagtagttacttgtcagagagaaaggaaaaaggatgaaaatatccattttgacacctcttgaaatgtgtttgttgactgtctctcttttaaatcgccctgtacctatttggcatcactaatcacaatgctaagtgactttttactttactaggcattaaacttgtgctgcttaacctttgagcatcaaacaggcctttccccagcaccctgctgtatctttagtacaaaactcctgaatcattatccatcttgaggatctgccttgccttagaggtactctgacatttgctaagacttcccattggaccttgcagacatttccagatcatgacagtgtcatttgatattttggttttaaacatcatcagagtggcttgtgctgaagaaccagaactagaaagaaaatgtaaaatgaaaagaaggctattgcctctgtgctgattgttaagatggcattggaaacatttttgtttttactatggatatagtcataaaaccatgaatatttttcaaaggatcacagtatgaaatacagagccaacggtagaatatattaaattagcccatttgaaagagggtctatctgtaaataaaccttgcagttaagaaagccaattatgataaaactgtatagttacctggtaaactactgtttataaactactttaattttacaatatcttatttgaaccttacaagaaatgtgtgaacatagtaaggtagggttactctcctcattttgcaggtgaggagactgagaattagaaaggacatgtgatggccgggcgcggtggctcatgcctgtaatcccagcactttggtaggcggaggcaggcggatcacctgaggtcaggagttcaagaccagcctggccaatatggtgaaaccccatctctactaaaaatacaaaaaaaaaaaaaaattagctgggcatggtggcgtgcgcctgtagtcccagctactcgggaggctgaggcagaagaatcacttgaacctgggaggcggaggttgcagtgaaccgagatcgcgccactgcattccagctgagtcaagatcccgccactgcactccagcctgggtgacagagcaagactccctctcaaaaaaaaaattaagaaaggccatgtgacttactcctaatttcctggcttgcatgaggctgagccagaatttgagcctaaagcttctctgagtccaaatttggtgttctctccactatatcgtgctgcttctacttatgggattgggaaatattcgggaattttaattgacaaaagtgaactgtgttcaggacagaacttaaaactaaggtagatattaagggaacaccctatagttcaatgggtgtttttctaggctatagatgaggagaatgccaaggttattacctactccaacaccaccactttgtggtacaaattaacaaagataccccccaaatctatgtatggttggcttgcacaaattaactttgtatttggcaaaaataaaaagccctcaggataatatttcccttatgtagtaaaatagctataatagaatttcacaatctttgttattttctgttgaaatgtccacaggaaaattagaattctgctaattgattttttttctgtatttataataagccctcatacaattgaagcatatctgagaaaactagaaatctattttatttatcttgtaatctgaaaagggagtgttataaaaattaataaggtttcctagagtaggaaataaaaattttaaaaatgaagtaatgataaacattaggctctttaaatatatacgaggcatatagaattacaaatcaacctggagagaccaattggagggaatgatgacaatgaaagtagatgcattttaggatgtttggcagattaatccttcagttttatcccttcagaggtatgagaggtcagtagcatgtctaaatgtaggcttatgttatttacttttcatcatcactgtgaggaagggtgaattttttaataaaaagaaaaaaactatcatagcatggagcttgctttttttaattggcagataattttacacttaatatttctctctcagctccatacgttatcagtttaattactctgaggcctcaataaaaaaattaaggaaactaaagtaggagagtttgcagtttacactcagctgttctgagttcactgaaagtgaaatgccaagctgccagggatctactgcatgaagctctcgtgaggctcctgagtgggccgagaagtggcagatgagcttcgtgtggatacggtaaagcatttagtgaaaaatgaaagtgaaagaagctaggctgcattcacaggctggcaggctttgccttctcagtttcaaacttgaaaaagggatctaggagtgactggtaaccattctgtgaaaaaaaaaaaattagctcaggaaggtgttgtaatcacaatggtccacactctgcagatcagtctcaggaaagagattggcatcctaacagaagacattctacttccttagtacaagattagggtcctccagacaggatgaattattgcaagtaattctgattgctgcttctgtttaaaaacaggctgctgcatcaggctagagaaggccctttgtaatgaagtaaaaatgggtgaaaattccctgttatgaaagaccaaaacaattagtgctcttctcttggaaaatataatagttgagtgagaagcttcaaagagctgcctggcccttccactccttttgccatgtgaggacacaatgttcatccattctacagtgtaaggatgcagaggctatgctcagtgtttttgaaatcaagaaatcataaacatttggataggataaatgcaaacctatttaccaaacccaagcatgttgaaaccttaatctgttcaggctgctctacctgagactgggtaatttgtaaacgacagaaatttattgcttacatttctagaggctgggaagtccaggatcaaggtgctgtcagatttaatgtctgatgagtgtttgctctctgcttccaagatgacacttcttgctgtatcctcacattgtgaaatggacaaacgctgtgttctcgcatagcagaaggagtagaagggccagggagctctctaaggcctcttttgtaagggcattaatcccattcatgaggatagaacccttatgacttaatcacttctccaaaggtcccacctcttaatacagctacagtaagaattaagtttcaacataaattttagaggactacaaacactcaaaccatagtaaagggtatctttgaagcattgcagaaacaaatggggaaagggaagtaccatacatgactcacagaacaacttatcctggaagttctaaagaaatagcatgtttaaaaagtgaagtgattcaggtcaactcatgcactatagatacatggttgctttgtaagagaaaccaaggaggaaaagccatcctttctacaaagcatcccttggtgactcccaccaaaaatagaatcacaaggctaaattgatcatgaatttggtattcttcatggctttagttttaaaaatatttttaaagtattaaaaggattagtattgaagatagtaatactggtaatggtttgcaaagcttcttgttcttgtcctactttggactccacctgcatttacacaaagtaccttcctgtcaaagtcatggacctagaaatccaggcttagtgcttgtggatgccatctggtatgggggtcagcttacggactttgaaactccacagatgtccaccacttattaactacatgatcttatgcaagctttttaatttcttggaggcttactcttctcatttgtaaaatggttttataatacctatcatacgggatccttttaagaatgattgacgcaatatatgcaagtcacttaacacagtgcatggtatccactaaatgctaagtaaacagcagctcttactattgttgtgagctaagtgagctatttatacaaccctggattcaaaaagttgtaataaatatggtggataaggtgagcccacattttcctaataaaactttaaaaaagttttatgaccattttgagtgtagctggacttttagaaatgtagacgaaacagtgaaatgtgtagttatgaaatttaatttgtttagttatacagatatattcaaattgtagatgatgcagaataatctcttcaggtatgatactttgcttttcctccccactatctcattttgtaaaacaattctattgaaacttcacgcgtatctctgacattggtgtttctagaagcactggagctaatttttgtgtcatctaacagttttccagagcatattacattcatgtccacctaagtttttagagatacaacactttaatctgtgtatcagagtatcaatgtcaggctttttccgcaagccacaaatactcatttgcataccactaggtccattggcttttccattcatcttgcatgtgtatattggtgatcttcgttaggtatttactgcagggaaatcttaagtaatctttcaaaggcttgtttacaatgatctccaacacttagtactatgacgtcacaccctgtaaacaattaataggtctgtgttaaatttcattatcttaactgccttccccaattttgtacgtttacatcataagcatctaaaacccatattaagttgttccagactaatgcgtgttttccagagagtacattattaagaataatttggaaaatgtcccttggaattaagcacttgaatgtaagacatcttcctctttttttctgcgagataacttgtagggagcaacgggaaggtatgctttatatttgtgaggataggaatagagattttcttgaaatatttatccaattatatgactttaaaatcatgcaagtttcttatttttattcatcgtatatatgtattaaatgccaggatgatccaaacacatagaaggtgaagttcctgccattataggaatttttggaccttagagaatatccaattccagaacaatgcatggaatactttgtggaaagcatttgcagagagaaagctgtgagttgcagcccttgtcctcaacaactgacagcaaatttgtcaacaaatttaattatgtttatatcaggcagaatgtgtttgaagggcctgcacacgtttcacatagggaaaagaaagaggtgaagagagaaatgttacatgtaaaaaattttacatagtaaatcatcacatggaaaaacacatttttcactggcaagtaaagaaatacaacaacaaagtaacaggtagcgacatatatgtattgtgatggctaagcactaagtgaggtgttggagaagctgtagagaaacaggtacaatttcaaggtggtgccgttaggtgacaattcatggaaatgtatacataaaacaatgttaagtgaaagaattagatcacaaaagagtatataaacgctgattatatctataataatgtgtgtatgttgacatctattgaaagaggatttgaaagaatgtaagtttaatgttgatttgaattttctctctgtaacagtgatttaaatgcatactaatttgaaaagaatacaatgaaaaatgactccccatcacacccctaaaacacataataactacacacatcttggtaaatagattgtggtagaatatgatgttcattgtttgtgatgttgcaacattatctataaatcaaggacttaattgaagttgtacttcccttctttatctactgtaagtctgatgaagcattttttgatcactgtttattatagtaatgagaaaagaataaatcttttccttataaatcctgacaatctgcattttaaatccttgcacaacctgaattctttgtctccactaaatgaatacagaaagtttaagcctgtgattgccttatttattctgcctccctacctttcaatagctactcaatagctctttcttgacctttacctgtcagttaatagttggtacattgagatgtgtttattaagtccaggcagctaagattcagatttatatgcagctaatatgctgaatgaactgaagatctactatgtaccacagatctttgcctggtactctacaaaggggacttcacttgatcttggtagtaaccatctgaagtctgaactattatccctattctgatgtgacaaaactaagcatcagttcagcaggcagtcctcttccgagcccaggacagtggtccttcccttgttccattgtgccttttaagtggctagtctcagtgtgttatagagaatagtatagttttaaacatataaaataaatttgtaggaagcagcatatttttaaggaagatctttttaaaaagacaagtgtgttgcttttttcctcatttaaaaaactgtatattgttgctataaaatttatttataagagtggttggagggaggccgaggtgggcagatcacctgaggttgggagttcgagacaagcgtgaccaacatggtgaaaccccatctctactaaaaagtacaaaaattagccgggcatggtggtgcgtgcctgtaatcccagctactcaggaggctgaggcaggagaatcgcttgaacctgggaggcggaggttgcaatgagtggagattgcgccattgcatgccagcctgggcgacagaacgagactccatctcaaaaaaaaaaaaaaaaaaaaaaaagagtggttggaaattttgatacaaagcaattcaaaattatacaaacaatttgagtagaatccaaacatgaagcaagattttctactactttaataatttcaattaaataaaagttaggagctgataaaaccgtttgagggtttatttaaaggggagcatgttattggcatgctgaccaataacactgggaatgtaatgtatcatgacatgtcagataacacaaacaaggacagtttttggaaaatcataaataacaaaatagaaggagtgtaaaatggaagaagcatcaaggggtggttggtacaataagatattaactctgagaaagttttctaactcatcacttaacattatgaatactgaattgggatgaccacaatactagcttctgtatgactccttaaatattgatattggaaatgtgcaccacatgataaccaatattttaaggtgggggcaaaatagctgctggtatgaatctctagaaagattaacttgaaaactgtcttgtgtaacaaaaggaaaggagaacatctgggaggagaaaggaaatttcctagaaatgggaaatgtggccataatgtgatttctttctataacccatgtatgcaaaaacatttatctccttttactctagtcacactatgtttgtggcttgcatgagtaagaaagctagatgaggagataattgttcagcaaaagaattatagagttgaaatcagtgaagtgaatggtattttatagcaaagagatccctaaaagtaggtggcataaagaatagatgcaaaaaagtattgctttctcttcgagttctaaagacctctgttgatgacgttttgctcatttaaattccagagaataattggaaacagagactttatgcgacagagctttcatttaacttgttcacctgacagttggctttgaatgatattttattaccaatcaacctaaattaaaatacccagctcactgtaaaaccctgcagacagtgtctggaatgctaaaacacataccatatataaataaaattaaggtaaggacaaagattgacaaaagcaatgacagtgaacattaacatgatatcagcagctttgagcttctatcaacaatgtggaccatgatgaagttaccagagagggcagtatagatggattttctaacttgcatttatcagaagagattttcacttttcaatcttaactatgtcttataccttttaataaagatgtggtatcaaacatcgaacatatatgtctgtacctacatgtaaatatatatgcatgtgtgtatatgcatagccatagctatccatccatccatcccaaagttcatctctccaaggtgctagtccacataattgcgttcagttcttctctggtctttgtataaatgtgtacttaaggactttgtggatagtgcgtgatataaatatggttcaggcccatcaaaatgcagattataggatccggtgaacttttccttaccaaataactgaattcctgaatgttgtattattataaaattacaaaagtttcaaacttactgctattctctaattacttctatagagtgattattatatgggatcaccagatgatcatggtctgtcatgctattgctatctttcttcataaatatataatttatcaaagcttaattatattattatccaataaatgaatgatagaataattatggttatgtggttcattacgttatgtcccattctctgactgaagcctctcagtttcatatctttgttgtgtagactatttatgacaagttaaatctgttctctggaacttagtgtcatcgtctattaaaatgaagggttggatttcaattaaataattcataaatttcctgtcagctctaaaattctatgttccattgattatcctcaaactattatacaagttcataaggccttctaatatatatatatatatatatatatatatatatatatatatatatatattagaagatagatagatagatagatagatagatagatagatatactagaaggccttatgattagaaggccatatgtgtatatgtatatatacacacacacacatatatatatgtatgtatagtgttcagttcttctctggtctttgtataaatatgttttatatatatattttaaaacactatattaatgtgcatgaattgagaactgctgtggtatctaaactcctttctgcttgactctatgatgagagatgaatgaatttggaaatatttagtccaagaaaagaaaaagtgtggggataatcagtcttcaggtttatgatgaattgtgactagctttcactctcttgtaaatgatagacaaagagagaacaaactgtaccaaatctcagaatgcataatgtgatagtgcattaaaaaatgctgtagaagctggagatacttagggaaggtagtcatttgatgcaaaatatcagttaatctcctctctagtgtgctttaaagccagggaatctaaaatgggggaagccaaggaggagtagagttgtttctcactgttcaacaggaaggcactttatgtattttcttatatattaattatttctgagctatttctcctaagagaaaacccttagatttggcctacagaagatgtacttatcattggcctttaatgatacagacattgccattgctaccaaagttagtttatatgtacaaggttatatttaattagcttatgtagatcaaaatgcaaggacagaacctaatccctcctcttcctctgtactaatcaatttataatctgaatgtgtcagaattcagattatgaattatgttgtatctattaatccttgtaaccacagcacattttataaaaatatacatactttgattctaaatgataatatagtgcacgttcaaaaccgagtaagtcacagttggtgggcacagagacattggtaataatgggatcctccagctagcaccaagtctctgttttttctttaatgttatatgatgaaggtaataataggtggccagtaaggataaaaagccacccaagaaagaaccagtcttaaacttggctcttttgcttttttcaagttttctcataatatattcaattccatgtaaatattgcaaacagctgaattgcacacattaacctaaacatgaataaaaaatgttgatattttatttaacctaaaaatagtagttatggataggctgcttttatgattatcgtctttaaaatatatcattttacattgggaatatagggaggattgtcaccgttattgtataataagaaaatttgttttgagtacattaaaaatacagtagatgattattgcaatataaggggaaaagttgtttgcttttgacagtctgtcagatgtagcctaggaagacaagtatggtagctgctttatataaaacagtaggagaaggacacaagctcaaagaaattttacctagctgctgttattaaagaaattcttttatagaatagaggctggttttttttttcatctttccgtttttgcttccatctctgaatcctttgctttcatatggcatgcaaagcgtctgtgcatggcagcctgtaacttctgttatttaaactgccaactgttaaaatggattgagttgaaccagaggaggaaaatagccccactgaggcaaatgcatttttacacccttctttaataaaatattgtaaggtatagctagaaagtttccccttggactttcatctaaaactgttagattgtagctttgtgaaagaatcattgttgactcctgtcagacagttttggagaggaggtgaagaggcttgtcttctgactttctgtgcactttgtcaaatcaggtactttgagcagaagtacgaagtgaaggctgatgtcagagaatgccttgaagcaggaacttgtgctagtctcctgtgacttcctttttttttttttttaaggaatcagattggattgtaaaatgatgggaatatgactggacataaacacgttcattgcaggctcagcagccgttacatatcattagtgaagggaggcaaggggcaagggggaccattttgatgtcagtttcattctttttaaagacaaatgcattcactgatgagaagtaaaccagcatctgtaaaattttacagacaagtaatattttaatgccttcttttcctgtagataaacgtataacttttcaataatcattaatataaactgaaataatgagtaattgtgttaaatacccataatgttggagctgcttttaaggaaaccagttatgaagcaactgtaacatcaagatcagtatatttctgttccaaaatagtctgtttcatagactcagtacatagcttgctgttatgccacttcggccacagttaatgccaaaatctaaaattttaaaggtgataatgctttttaataagaaatataatttggccttaactttccccttataaaaggccatattccatacacatcaactcaaaagtttgtcccattttctgacttttctttttctttatttgccaaagaatctctgtaattggcttgctctgcaaagcattttatttgcccttctgaacattaactattttaaagatccgagtgtattatggcagggaacacaagattttacttcaaccccttctatgccctcctctctactaaattaattatttctgttttgagtgttccagggaaagagtaaaattgttaaggtataacaggtaccaacgagtcatccaaacagaagtgccattccaggaaagtacagtatctgtgtgcccagcatggatcttggccctgccctacttttaagcttctaacatatcttcgtagtcatttcttctgtattgtgatttttttttaagtgagcacttttagatgtcccatatggtttaaaccaaatcagaaattcatgtccttaatgtttcgttagtcagaataattaagttgatagttcggggagcagttgaagcaaaataatggggtcattgaagcagtcaagctctaatgggaacctgagctcattcagataccaaatctaataattgttctacacctgtatgcccagtcccattgagcaaattcacattaaaggtttagtggaacagtttcaatgctgtggtccaaagggacttgctactgttttcacaagaaagcactgaatattttttggcaatatatatatatattttttgtgatgtgttaactaagctctgtgcatgtatgttggtgccctatccctacctagagaggaagaaaagggagagatgtattttcaggaatgtttttcttaccatttagggttaataaagatactctcaagcatttgccacctggaagcaataatatgagatgattaaactcactggatagtttggggagagggggagtttggttaatctatgcaaccaactagaaatgaagttcacttaaccctttttcttcataaaataaaatggtatcaaggtatcaagcatgtttttttggggtttttttgtttttttttttgtttttttttgaggtggagtttcactcttattgcccaggctggagtgcaatggtgcgatcttggctcactgcaacctctgcctcctgggttcaagcgattctccagcctcagcctcccaagtagatgggattataggtgaccgccaccacaccctgctactttctgtattttcagtacagacagggtttcaccatgttggccaggctggtctcgaactcctgacctcaggtgatccacccacctcggcctcccaaagtgctggaattacaggcatgagccaccgtgcccggccatcaagcatgattttggttattgaagtagaaagtagcaattaagcattgtgtagtaatgcactgtttcatttctcctgtgtcactatatgactgtaacaacaaactgactgcctttgattctcctgtaagatatctaaagagagttgacaaacctaaaaaaattaaaggtctaaagagtggaactatgaatttaattctgccgtaaactgaccattgaactgacctatctccaatagaactccctcattggaggattcaaagcacacaggaaaattaaacgatttgcaatttacctttaacaactatgaaatacagatctgaccagctttctttatcaaaaaaggcaatcaaagctgaattcacttacctaaagaatagttctaatacacatgaaggtattcattcaaatgactcttgtgctctaatatttttatttcctttggggaattcaaaaatcatttaccaaatgtctcttatattacaggtaccaaaaaaaaaaagatttaaattgcagttgctgcctttccagagctcacgataaaatgggggaagatagatcgcacagggacaatcacagtataaagctcaagctgaatcttaacagatgagtaggagtttcttgggtaggaaaagaaaaaggaagagaagcatgatccaagaaagggaacagcatttatggaggcaataggagaacacagtatattcaaggaagagccaactgttaacattgctggaacataggtatgagaggctggaaagatgaatagtcatgataggccatgtataattagttcgattattttactacatgggtgataaggagccatttcaggcttagacttatggtagcatggctagatatacattgtagaatgattatcttctaacgatatagaaggctgatagggtaagggtgaggctagagacaggagaaattcaatagggatctattataagagcctaagcaacagaagcataaggcctgcactagagcagtgacagtggagataatgcagaataaatagatgcaaaaatgattcaggggttagaattgactgaacttattgagcaactggatatgaggataaaaaagggaaggattctcggatgatttattgatttattttatgattgctatatgatagctgtagtaattttattagggctgctgtgacaaagcaccacaaactgagtggcttaagccacagaaatgtattgtctcatagttctagaggctacaaatccaagatcaatgaatgggttggctgtgccacgctccctgtgaaggtgttagggaaggatatggcccaggcctctctcctagctcctggtggttttctggcaatctttggcattctttggctggtagaagcatcacgttgatctctgctttcattttcacatggcatcctctcttggtgtgtgtttgtctccaaatgtttcctttttctagggacactagtcataagggattagagcccaccccaatgacttcattttaacttggttacctccataaagaccctatctccaaataaggttacctcattctgctgtactggagcttcagagatccaatatatgaattaagggggacacaatttaacttataagatggctctaatcatcaaagttaggatatataaaaaggagggaataggatgaaaggaaatgaaatcagtttaatttggatctgcagtgtgaggtagctttggaacaatcaggagaaatattgagaaggtgattgaagctgtagcttagagcctgagaaatgcagagttgagatccattagcatgcaggagatagaatagttagagcagttaagtttggcaattggatgagcatacccctgggaagtagctcatggaaagtatagagttaaaatatgggaaagggcaaagaataaagtgctgaaaattactaacacgttgtgaccaaaccaaactgtgtctgtctgcacacaagcaatggaaagccaaacaccaaagcactgtgtttttgcagtgagaaagtttattgccaggcagccaagcaaggcgataggagtcaggttcaaagctgtctcccatactagccttgcagccatggatggatttaagggagagattttgaggctgggatctgggggctggacagtgattgactgtaaggaaaagggggttggaaattcccttgggcatgagctattgaccatgcacgcttcttcatgggtcttatgttcagaaaatgatctgagggtggagattttggccctctgacatcaaaaggtcactcaccaggcaagcaagtctattctgtgcagactgcagtcagacacattaatgggttccaacttgtcccagactgtaagccagttttgttgcaaactaagggaattgtaacaaagtgttttgttctctgttctcctgcaagacaagctcaagaaattttgctacttaccaaattctcaaggaaaaggatagtagcatagaaacagagaaagattaaagaaataatttgagaatgaagaaagaataataatatacaagctaaaagaaaagagagtttcatggaaagaataattgtcaacagtgtcatgtgctacagagaggtcaaggaaaatgaagactgaaagaaaaaaatgttaatactgactgcagaatgtgatattgattcaggataggccaattcataaacaaagtaatcatggaacataccctgtattttcaatagaatttcactctacttgttactagagaaaagaatgaatttatttatatagtataaaatttttatacttataaaaattatattttttctagatcatgtagtttttctaatccataagaaagtcatatctcctattttactgtctttcaaaaggtagttaaataatcctgacaaagggaatcgtttagaaacaatacatacaaattctgccttggtcttgaaattttgatatttatggttatggtattttgcgactaatgttcagaataggataaaatagggcatctcagaataagattataatgtggttggtcagaagaaagtcttctaaggaagtatctttcacttcaagtcattgtctgttttttatgtagttaatgctggagctctcagggctgctaaatgtcattttatgtactacttcacaatctaaccatacatattaaccttttccttcaacacccctaagaacagaaagctgtctctagaaccagctttaaagattcacagttagacccagagtaaaagaacagattgaaaagatagtttgtaaactatttattgtcctgcacgaatatgtatatatgggaacaaatgacatatttctatgtctataaatccttgtaaaagttttattcagagaaagaatcagcatgtatttactacatggctatttaatatcgagaaagctaataaagaggtagaagaggctcattctctgccatcccagaactctcctcttagaaaggcaatatctgaaatgatagtgagcagtacgaaattggctataattgaaagctgaattgtgtgaaacaagctaagtttgtgctattggagtcgagaggagagaaagatcagcgaaggctagagggatcgggaaggtgggatttgagttgggctttgaaggataagtagtcttgaatggaggggaaggagaaggcaaagtgggtacataagcacaaatctggaagatatatagatgtgtttgtggaacagttgtgaagccaacctaactagattcaagggggaatagtagagaatgggagaaaatctgattggatagagtgggatctgtgtaaaaacaaacaatttttaaaaacccagaaaatatgtactccatgaatctctcctgtacttttttagctgccacaaattttggggccaaatttattacacatgtattctaatctgccgaagctacatcctttagtgtgaatctgttcacttttatcttcatatgtcttctcttgcagtgaattttaatctgagtccctgaaagttaacttgttaccatttttattgttgtttttgtcttttcttcaccacttcaaattaggattgaaccagattagtcttgttttaaatccactgcagccttttgagctggggagtacggtctctttgagaaaactgttttctttctttttttttttttttttagaactaagcatttgttgcagtttattggcactgcatatttttatttttatttatttttatttatttttattattatactttaagttttagggtacatgtgcacattgtgcaggttagttacatacgtatacatgtgccgtgctggtgtgctgcacccactaactcgtcatctagcattaggtatatctcccaatgctatccctccccgctccccccaccccacaacagtccccagagtgtgatgttccccttcctgtgtccatgtcatctcattgttcaattcccacctatgagtgagaatatgcggtgtttggttttttgctcttgcgatagtttactgagaatgatggtttccaatttcatccatgtccctacaaaggacatgaactcatcattttttatggctgcatagtattccatggtgtatatgtgccacattttcttaatccagtctatcattgttagacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgagtgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcacatgagtaggttgcgaaatttttctcccattttgtaggttgcctgttcactctgatggtagtttcttttgctgtgcagaatctctttagtttaattagatgccatttgtcaattttgtcttttgttgccattgcttttggtgttttagacatgaagtccttgcccatgcctatgtcctgaatggtaatgcctaggttttcttgtagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttttctcaggtttgtcaaagatcagatagttgtagataggcggcgttatttctgagggctctgttctgttccattgatctatatctctgttttggtaccagtaccatgctgttttggttactgtagccttgtagtatagtttgaagtcaggtagtgtgttgcctccagctttgttcttttggcttaggattgtcttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctaaccatgagcatggaatgttcttccatttgtttgtatcctcttttatttccttgagcagcggtttgtagttctccttgaagaggtccttcacatcccttgtaagttggattcctagctattttcttctctttgaggcaattgtgaatgggagttcactcatgatttggctctctgtttgtctgttgttggtgtataggaatgcttgtgatttttgcacattgattttgtatcctgagactttgctgaagttgcctgtcagcttaaggagattttgagctgagacagtggggttttctagatatacaatcatgtcatctgcaaacagggacaatttgacttcctcttttcctacttgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttgactctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatactggcctcataaaatgagttagggaggattccctctttttctattgattggaatagtttcagaaggaatggtaccagttcctccttgtacctctggtagaattcggctgtgaatccatctgatcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagaggtctgtcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttggtgctataaatttccctctacacactgctttgaatgcgtcccagagattctggtatgatgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagggctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgccttttgttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctctcattatgatgttagctggttattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttctttaagaatgttgaatactggcccccactctcttctggcttgtagggtttctgccgagagatccgctgttagtctgatgggcttccctttgagggtaacccgacctttctctctggctgcccttaacattttttccttcatttcagctttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcatttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacatagttctcgagctttggtcttcagctccatcagctcctttaagcacttctctgtattggttattctagttatacattcttctaaatttttttcaaagttttcaacttctttgcctttggtttgaatatcctcccgtagctcagagtaatttgatcgtctgaagtcttcttctctcagctcgtcgaagtcattctctgtccagctttgttctgctgctggtgaggagctgcgttcctttggaggaggagaggcgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagtgtgcccctgctggagggtgcctcccagttaggctgctcgggggtcaggggtcagggacccacttgaggaggcagtctgcccgttctcagatctccagctgcatgttgggagaaccactgctttcttcaaagctgtcagactgggatatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaatcagcgagactcggtggggtagggccctccgagccaggtgcgggatataatctcgtggtgcgccattttttaagcccttcggaaaagcgcagtattcgggtgggagtgacccgattttccaggtgccgtccgtcacccctttctttgattaggaaagggagctccctgaccccttgggcttcccgagtgaggcaatgcctcgccctgctttggctcgcgcacggtgcgtgcacccactgacctgcgcccactgtctggcactccctagtgagatgaacccggtacctcagatggaaatgcagaaatcacctgtgttctgcgtcgctcaggctgggagctgtagaccggagctgttcatattcggccatcttcgagaagactgttttcaaagctggattagagattgactagaaaggaagaaagcctgagtatagtgattagtctacccaatgcattgtttctcaaattttaggtgtagtaaaagggatctgtggatacattttaatgagaacctaataattttgggtccccagtaatcgacttagacttacttttaatatattgttgcttaaatataaaaataggcataaactctatatgctttaagaattttaataaaacagataaaactaaaattaatgttcacttaatgtgcctactgattctagatttaatagtagagcttcagatccacttatacctttttttgaccttatcattacaaatgcagaacatccctgttgtataagtaggctgaacaaagtggtactagtaccatcagtcaacattttgtgatagaattcagggtcatcagactccataccaaatgaaaattttggtagagagcaactctcaaattccagttttaataggatgtctgctccagaaccttgtaaagttgtgttgctcacatgaagagaaggctaggattggaatataacatgggtatttaatccatttactgctggaatcaggaagcaaaaaagtattcagtacatatttaccactcaatttttagatagtgaacaattgcaagttggtccacaaggattacatccgtataatacaactgatcatgtcctgaagacggtactgactgttatgtcacagttctcatatgtccagcttgcctagactgttgtgtgaaagagcattgcaccctgtgatgactcaagtctctgaaaaattttctctcttcaaattatcatgaaaccttcattagtacagtgcacaataatgttgcttggcttttacgtaatataaaagcaaatatatataagcctttttgtatatcagtgatcagtacactagtcactcataaggtgatgatgcagggtatccttatgtaaacactttttactgtaccataaagtgaaaacacaaaactgtaaatataccctgttttaagaaataatgccctagtgagctccactgactttttttttttttttttaatgaaattggctgcaacattgggaattacatcatgtaattaatatctttgttacattgggctcttttagaacagaaacttactctggaccccttaagaaacaaaatgaattttacttccttctgtgtgtctgttcttttctatttatctttcaactggcttactgccctattgagtagtgcctttcatcacaaatcatgccatgtgttacctatgaattggctgcccctgaaggaaactgatgtccataatggtcccttcattggccactgttgagggggaaaaagcctatttagtactgctttcctaagtaaaaaaaaaaaaaaactattgagggtgatggtttcagctagaagtggtgttgggtacatcgggcacaatgacctgaggcaactgtttgcactctaagaaaatatcacccctttcagggtcatgggaaatccaagtgtaagttatattcattgcctccacttactcctcaaccttctgcaatctggcttctgctccccttatttcgaactgaaattgctctcattaaggtctctaatgacctccatatttctaaatctgatagtttgtctttattttactgcatctttctacaacatatgatattattgcttattccatttttcaaaatatctactcccctgaattccataacgtgtactgtaatggttctttctatgcctctctgaatatttgctgttttgtttcatggactcttcttcctatacttatctcttaaatgtcactgtttcccaggatttgatcattagcccactgcttttctcactttacgtacattcctgaatgatggctttgataaccatctaccatctattacccaaatctctctcactcttttcaggcctctcccctgaaccttggtcttgtaatatttgtaacggcctgctgggcaggtccactcagatgttttaaaggcatacaaattgacaaatccctaactgaactcatcatcacctggaatgcacctttttctcctatatattcttagatgatggaaccaccattctcccaaacatataggctggaaattttagagtgatcttggactccttttctttaattttagagtgatcttggactccttttctttcctacatgtccaatgaatccctaattattgtcttgtgcttattaagttcacctactgcatgatcaccaaactgaactgtcttaccacttcactccctattgcatatctgaagttcaagagccttaaaatgacacataagcccaatctgtgttctaaccatcatcccctgcttttaatcaatactgattttgtttgtcatcttcacacacactttttttacctcatattttctcttcctttcctcacagcatctccttttcctggaatatacttttcttccaggataattcatccatatcctttaagaatctacaacaatattgccttctctagaaagtcttcccaaagatgcttcccctaaggcttggctgagtatttaatttctgtactcctgaacagtatacccctcatcatagcacacactataactctcttctcattatctttgtatgctaaccgcatttgagagagaacaccatgaggcaaagggctgagacatttcattttggtatcaggggatccaatataatctaagttctcaaactgactcactgagaactatataacagagtaaagagaaagccttaatacatttccattagactaatttttaaaccaaaatgccacaatcactacatagtacctgccttgaaagactggctcatttatctctgtatccctctagcactgtgccaggcacatagtcaatgttcaagaaaagatggttgaaataaattgcaggccagtttttggacagagggaaatatgcctgacattggaacagactctgcttatgacagcaaggctcctcctctttcgagtgcataagtctactcaggaaaccgaattgaatttcagcaggttgcctggtaaatctgctgtcctagaaaaaaaaaaaaaaatgagtgaccggttttgctagatgcatcattcaagccaggctggaatctctagaaataatctctttctaccctaaaggacaaatctgtccagacaactggaatcctaaagcagcgaagtaatagaaagcagtctggcaacatttctatacccactggatgacaataagaaaaataagtaaatagttatgaaagattttcattgcttctcaagggcataaaaaaaataccctcgcctatgatgacttgtgaaatagagttagaaccttgataaattctgacttctggctgatctttttaagtctttgttttaataggctaatctgaaaaatacttctataaacatctgtttgcatctaatctcattgtcccaaaagtgactaaaaaatgtcatagtaccataatgaggctgtctagactttgaaaagtgtaatatgatcgtgatgctaaaatctttggaatttggctctcacaatatctaatatttaaaatgttcagctttttctctgtatcgggtgccattctggtcattttactttattgtttcattactaaagtctttgtaactgccctgttaggtgggtctttaatattatttttatgttcacaaggggaaattaaaatgagaaaaacatagctcttaagtggcagaacaaagatgtgaacccatatgtatggccatacactgagaactttgacctgtcacgctaaattgtgactatccattgtaagtagaaacagttttttgcttgaggcttgtttattgatttgtgtgcatgctcttcacatccatcagaagattagtatgggccaggtactagattacctcatttagttctgttaatactcttcagtgtaagtaccattattatccccatcttacgaataaggaaactgctgtttagaaaggttcattttgcgaatgcataaacgcaaagtgggcctaattggttaggaaacaaatgagtctagtagtctacattaataagttcaaagactacacatagcagttagctttactttgctccattgttataagtggtaagaaagaatataatgcttagtgctaagacttccctttccaccccacactgcctgcactaggaagggaaaattaacccggaatgcatgctttactaaacatcggtcagtaccttttaccatcaaaggacagactttttttttttttgaagtctcatgtgatttttatcattgaagtaaaactctctccaggtgatgtaatgacatacctcctattttttctggatttttacccatctgtttggagagagtcaatcttttagagagaatgactttttaagactttaacttttagaatttataatctaagatacgtgaaatacctttataaatgataactgtgtggacacaaatttattcatgttctaaaatttgtaagccatgactttcccatcagggaacattccacggcccttactgaaacagggcagaaaactggcacctgttttatatcctttttttctttccattatagtatacttagtgatggtataatcaacaaggaattagtttagagattattggatcctatgctactctttcttaaaattgaaaacaatatgtactttgtagctaaagactgagaatttaacatcctatctagattttgttctctagtttgacaaattaatcatgctcaatgccaaaaattcagatattatagaaatatatatatatatatatatatatatatataaaagaatcagatggttgcggtggctcatgcctgtaatcctagcactttgggaggctgaggtgggtggctcacctgaggtcaagagttcaagaccaacctggccaacatggtgaaaccccatctctactaaaatacaaaaattagctgggcatgatgacgggtgcctgtaatcccagctactcgggaggctgaaacagaagaatcgcttgaacccaggagacggtggttgcagtgagccaagctcgcaccactgcactccagcctgcacggccgagagagactccatctcaaaaaaaaaaaaaaaaaaaaaagagtcatcccaccattcatagatagccactattttttattggtgtatatccctctaaactttaaaaattataatattataaattatatttttttcaaaaagcagattatgacatactcttataacttgcctttttcaccttatcatatggacctctttttatcaagtacatgtagatctatgtaatagtttagattgactgcatagtatcccaatgtttgtaggttccctgttttgtctaatcccatgatggacatattggttatttatgatattcattagtataaacaatgctgcaaagaacatcagtgtatgatgatctagctttatacatttatccgataatgtgaggactggctttgtcccaatagatgtaaatgtcaggaatgattctttgagacatcttatatgagaagcaagttgctaggttagtagccatttttattcatgtataggctcagcctggcactcaggttgtgcatggattgtgttagacactagaaatataaaggaacttgtgccaattatgaatatggaatcaagaagctgtgttttaactgtgtcctaattgttcatatttaaaacaacttttgactggcttctaccttaagggacaatttgtattttaaaacaatggcaccgacagctgttaaagtgtgtgtgatattaaccatacaggttgcctttgttcatacaactggttaagtaattaagcacaggctagcatggggaacattgctaatgggaagcacctgtttatagactcttgcattgtaagctgtaggttaagtatcttttatcaaaatcataggcagtggtatatttctgtgatctggttctttgggaaatggagacatcatgcagggtgaatgaacgactgccatttctgcctcactgctgaaactagcgagcctgcatatcaagggtacctgggcttacttaagctggggagttggactgactaccctaaaacttccatcatcagcaagaaatacgtagcccagacccaagagatgggttgcacatgttaaaaacaaaaagagtagatacatggtcttagagtgattcagaaacaaaggcagatgacaggtaagtgtattctaagtcagcatatcagcaacaaagttcaggcagatcacaaacaactgcctcagaaaatgacagaggattgtccatcatgtgctcaaagttagagaaatggctgatgcctactattcttagtcataggcatatatgccacacatggagtagaaaggcacagagatgacaggtgatagtaatgaattgaccttgtagccaccatgccgtttaacagctagtttattctccaccaacccaaatggctgcttgagctctcaccctgccaaacactcctggcccaggttattgcaatctatgccttcatcggcttttctactgtcactcttgatactatctaggatatctaggcttcaacaatagaacctcttcggaagatttcagagagcccatttctgctcactttttaaagcagaactcctgttttctatgtaaatgcttcaagactgtttttttaaaaaaatagaattaaaattaaaattacatgtttattgaaacagctgtcactgtcttagttctaataactacaagtccagtcagtatattttatttcattattttcttccttagaaaataaaggttaaatatgtatagacattctggttcttcctttatacattcattgcttttcataccctctttgcaaataggaaacatttagtcattaaatagcaatattcgagaactagaattccctttttctgctaatcaaaaattaacagctatctttctgtttcttcttgttgaaatccccctatcttttaaggcttaactgggaagaagttgtccctgactcccagctcctgtactcaagggatatgatttttctccactttgaacctccattgtacttaaaatgtaatagatgctacaagagacaatatagttagtttcatgttctagttgttggtacatttatcctttctaccctcataatgtgcaagggtgcctgttaaggtaccctgcagatagcttatgcagtaacaacgtgtggatagacagacagaagaaagcctttcctttccttgtattaatgtcaaaatacattccctctgtgaaagcagcagagctgaaggtgaattcaaggatcagtttctgatttgatgctaatgattggatgattatttaatcaacagacaagtttctagaaactactatgtataagccactatcatagacaccttgagcatctctgttgtagtttgtgtggtttctgttagcttgctcttcaatatgtttcacatatataacttccttggaagctttaccagctattgcctaactttcttcatatatttatttgtcacctttttctgtattttctagatatgcaggcatcctcatcagactttgaacatcatagagagaaaatctgtcttacgacccaattgcattctctagtaaagaagcaaacataatgcatggctcatatacaaaaccaaggacatttaaaaaaatctattcactagctttgacattgagtccaaagataatcaatggcaaggtctgtggcagttgaaatactgaacaatatactgatgtaattttttcttaaccatacttttctaagatttcttgaaatgcccatgttatcaattatgtaaatgccagtcattcagaatcccaagagattggctgtacatgttataaaaatatcatgtttatggtagataaaagtaagtattgcatattttctacatttgtagtttaatgtggatacatttttaatgccttgaattaatattattgtactatgtgattttacttttatcaggtatttcaatcttcctaaagttactataattgagtttgtttgataatgtacctttacattagtacgagacttgatagtttgcaaaatatgaggttcataatagagatggagagtagagttactacctggcagggaggataagaagaaagtgaaatatagaaaagtgatttaatctcactactgcagttttgtaaaatctaatttgtttttcccctagcacagcagagtttcatgttgataacaagctactgaattaataaatccattgcaactattgagatttttcctttaataacataacgaatgctgagcattaagaaaaggaaaggcgttctttgcacagaagttacctctagcagatctacatccctatgcataggaacaataccaacatcataccgtgaacaatatcaatgtgaaagtaatttgtgcatctcaattagaatactgtattttctacacaaaagcactctgtttcatggaacacatttgcttattttccaattggaaagacatttgggggtctattttgttatcattacatgtgcttaactccaattacagttaatgggagtcgtgtgtctatagtcacagtagcctctgaactattttaacattattgctttccattaccatcctcgttaaaataactttcatctcttctaccaacctgaactaccacagtaatctaggtttctgttttctttgcacggatttatttgcatgtaatgaaggatacagattacacaacatgacctgtttctagtttgcacattataatgtcattgagattagaataggtctagaactatttaattgctaagtggaggtaatcgattggcttctagacgagtacccattgggtttgtttatctagctgtgttatttttaagttgttttgggattatagcatgtagagttctaaaatgtgtcctaaaaaatacatagtttaaatgaaaatatgagtaatggaggtttaactccaccagatattaaaacatctcatgaggctgaaataatgaaatcaggagctattggcacaaaaatatggaataatctcaatgtcaatggaacagaaacccgagtatagcaatttatatttgataaaggaggtaacatgaatcattatagaaattcatgattattcaacaaatagtgcaggaacagcccatctcctctttgtaagaaaaaaaagaaacaaactggtgtggaaacttacctgacattgtacaacaaaatgaattatagataatttaaatagttacatgtaaaaaaaaaaaacaagttaaaccttaaagagcaagaactcatatagttgaatgtttgtcacatgtctctggctagagaaggactttctaagcttaaaaacaaagaaacaaatcacagtgtaaaagattgatagatttagtttcataaaaacagcaaaaaatgaaaccatatattcctaaaaacctacaacacaaaataaataacaatcaacaagcaatcaacaaacaaaggaaaatatttctaataaatatttcaattgtttagtatccctaacatgtaccatttaaaataaaaacaaaagcagaaacctaagatcccaatagataaatgggcaaaagacatgatcagtatagaaaggaagacatatgaaacgttccacctaattagtatttgaataaatgcaaaaagaatgaatcagatgcaattttttcactttttatattagcacatttttaaaaagattaatacctaacaaagagataagatacacaaattcatatactgccaattggatttaaattaatacaactattctggaatacatttggacttacttttgcataccctaacaatgccacttctacatatggcatatgtaaagatgtaactgtcatgttccagaagtttaatgacatggaaaatttctacaatacaatattaaatgaaaaggtagaacaccaaactgcatatgtagtttgagctcagtatatatatatatatacgtacacatacacaaaagacactattctggtcacagtgaggagaaagaatctggtcaactagtagagcaattggctgtcccccacaaagagattaggctcaagcctaatttggctgccaccttgcagtcatttctggtgagtaaaaaactatttccaagtcaggatttctaaaatcacagagaaaagcataaataaaaccattttggacacaagggggaaaaaatgtaagtccatatgagatgatttcagtataacagtccaaaataaatcatctttctctcatcagtgcttgggatgcaaatagctactctatggacatttttggaagcaacataaaaagttttcttggtttccttagcctaagctgcaatagacccagacctctacttgctctctttgccagaaacaatgcctgaccactgatggtaaatctgccacattgtcactttcaaagggctttggagaaagcaaagctcattgtaaattacagagggtttcttttactttgttttctagcctactaattggcattaaaatgggatattttgtaacactatgtatataagggtcatagacttcgtttatgttatcctgctgtgagggactagtatataatgttaggtcaacactggtatctctacatgcctatgaagcaccatagggaaagaaacagccttcccctaggcaacaacagatggacgcctaaccttgtggggaatgaataatggacgtggcccttttataacagtttttttcaatcccaagtttaccgcctcatgccatattcaagatacagccttgtacttttggcactcgctcactgtgttagaggattgtttgcacactcccaggttacataatgcagctcgagtcctccagtctatctcatgtcacattgtgtttaagctttatctgtattgtgcttattccccagttatttcacttgacaaagtcttcggtaagaaggaaattaatgatgtagatttaggtgtggatctgaaactttgtgacatccaggtattttgtggatgatgtgctttgtacatagttgctgaataaatgattgcatgaatgaattctgaagcaatactataatgggtttagtccatttactgcaggactcagttaagaaggttttgagatgaatgccaaatcaatttatgcttagaaaaggcataaagcttcttactcatatgacagcagggaaagccttgacatctgtttgagctggttaacctgatattcagaagctgcagaaccatgtttaagctgggccatggttttatattcctttttagtgaaagatttgaatattacttttgttttggccacgctttctccataggatgcacattttcttttctttctttctttttcctctctttctttctttctttctctttctttcttttctctttcttcctttttcttttctttttcttttttcttttttgagacagagtttcactcttgttgcccaggctggcaatggcacgatctctgctcaccacaacctctgcctcccagatttaagtgattctcctgcctcagcctcccgagtagctgggattacaggcatgcgccaccatgcccggctaattttgtatttttagtagagatggggtttctccatgttggtcaggctggtctcaaactcccgacctcaggtgatctgcccacctcggccacccaaagtgctgggattacaggcgtgagccaccgcgcctgacccaggatgcacattttcatataactatgttcctgtcttcaaccttatgctttaaccaggtcactcttcatagtatcagaatctattcaccttcacatggggcacatttcaaagcctttgatgaacaaaaagaatctgttagcgcatgcatagccggctctggtagatttggaaggtccattttgggattgatttctcaggcttattgctgcattaaggctcatgtttacaaacattagaatcccttaatgaattcttagaccataatgtgttagtctatgaattaagaaaaatgaagcagatgaagaatatgacaaatcatgttaccccatcctccaatcaagcgtgtttttctgtatttcattgcacaatgtccccaacaagcatatatacacagacagaccctcctcttccatttttctctctttgatttccaaaaagataacaggcagattggaagggataccactacttgttaacaaagccctccatataatctcaggtaaatacatgtgttgtcaactattgactttttgaaggagaagcctgtatttttttcacttaaactatactagtattaggagaatgagactagttagaaaagtgaattggattcaggctgggtctcatggagctctcagatcatatcacatgagcacccagtttctccacctgtttccaaagaggacatacaatcatggccactatcacccaaattaatgtatatcacctctggcagcaatcatatctaacatttgtcctttcctcataaatgtgatgccaactatgagtcctgaccttataagggccaggccactgctttttccccattcgtttttaatactataaatataaaagttgtatttcaaacaattgagtgattttcaatctctgcttaaaaaacatgactccaaacgtggaagtcgtcatcattagattgctagccactagaatgtgaagataaatgaaatcaaatttacacacacacacaaacatgcagagtataagagtatatatatgtatatatatttgttggtttttaaactaaattagttttaacataaatacagagagttggaaataaaagatccagatcagccattgctgctattgtttctaatgatatttttttcataaacgttgtaggttgacattgtgaaaatgtaagtggcaacttttacagaattgcttcttataattatctcattaatattgggacaaattaggcatccagagaggtgtgggaggtggaggcaaagaaggaaaggagaaaggaataaagggagggagaaaatctagaataattctgttttgtgcatgtcaaaagctggatttaggccctgaactcaatgtttatcctgccttgcaaaagcttccatgtcttttcgtcagtttgttttgacccgaaactttgttttctcacaccagatgacaccagtaagttgcaggttgatgtgaagccttacatcccatcatttattgctgcaaagctgggtttttggatgtggtacttgtcttggacccagtgggtagtgagtgatggtgtggggtgccagtagcattactgaagtgaagtgtggatgcctgttgaccttagtgtgtaggaccaccaaggcacaagccttttttcaagtcagcatgatcctctgggaatgctaccgtcattctcacgtctggtagctttaacactgaatactttcatgctagcaatgcggtgggaaccattgtattgtaatctcatttttaaatgttttctaagaagtagaaaaccaatctgtatgcaaaccagtgacatctaagtaataagtcctttattcgggaatgttatcttcacatttttagctgaattgtgatccatatctcaaactaaataatggattttttaatggtatcttcaaaaggacacccaaataatccatcactcagatatatctctgagtagagaaaatgcctctttctttctcacctctcagtgatattattgcatcatgaagcactcagtatgctttaagtttatggctggttggctcaggacacataccgtggtgttaatgaggctggggtcatggaggcccgttagctttgctctgtttgctgaccacagactaccgggaaatcagtcaagagatgctagcacagacaagaacggcaccatggcaaaacctcagtagttctcagtttttcctccccatacaacaggcaggatgtgttagttgggcgtcatcatctcaaggaggaaatgagtagcagcttgggaggccccaacctttaactctgaacaaagcaggcctgacatttaggcattaactttgcattataatcccccatcataccattgatttgctgtgtaaccttcatcactaaagcagagataataggatagaatgaaatgggcttacctcccggagatgttgtgtgaattagcaaattaacgagtgtaaagtgttagcatttatgtaagtgctggtggttgtcattatttctagggacctagtctcattctaaatagagaatctaagtatattatgcttttgtcagaaagggattttcaccccacatcaattgcatttaagctgagcataaaacagaggtgataataacatagtagtgatcattgcaatgcagagctgtaaaccttttccctattaaagctagaactattttcagcaactttcaatgcttttaaactttgttttccaagttttgttatctctataataattattcttcctgtgatgggtggtgggaatgggacctggaataggtcctattcattattcattcccatgatgactatataatatattgaatttttttacatcatacaatcaagcaaatttggtagctagtgtgattgccacatattgcaatcattgtaaaaaataaaaactcttttctgctctgcctatgctggtgtcctctagaggtagccaacatacagattgaaaactcatggggaattgaagtgctttccaacaaaaggtgctgtatatagatcttttcaatttaacatctttaccaaagaattttgttgttgcctgctatttccaaggggactgtgcttgagagactgcttccatttcttttatcactctgacttcgcttaccaagaaaagtcatttattgctgattgcagaactcttgaactcagccgggcagctgccgcatgaactcctcagatctgagttccttgttacttatttacattttcatttgaagtgatttttcaggactatttgaaaacctttctcaacctaacatcatgtaatagcaaagatctaaaacttaccatgcttttggtcctttttctgtttgtcttacagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctgaaaattctattacgtttatttagatttcaaaggcaaatattgattcctatgctctgtggtttatttcttttttctattgcttctttctcccttgagtcccttgaaggcagggaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgtagaaaatactgtttctactcattcaaagcacattgtagatattcagagagaagaacaaatggctggcttggcaaatccccatctgagataaagtaaacaagtgaccagcagcccacagatgattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttaagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagctggtcaaggtagaaatactgatatgtatcatcaccttttccagatacaaacttgccttattttctagtttgtgaacaagaacgaatgaagtactattattgataacttatatatttttatttagagcaatcccacatgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccatcatctcctttggctgctgtaacaaattaccaccaataatatgatggcttaacacaacagaaacttatttgcttacatttttgaagggcagcaaagccatgctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaattcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttatatttcaaggcctggcagtaatcctctttctcagggctccaccctttgggcctgtagctcttctttcttggactatggattgggcctctgcctctgtgcctatgggttgcacttcttcctctgttcccacacttgggcctctgcctctgtacctgcagctctgctctcgggatggtgcttcctttatcttgaagggtggcacatgtttgcagctgagaagttttatcaacgggtttcctacctgtagaattctggcagtctcacaatcttctttcatttttttctgtctctgtcccttttaggcccagttggaagtgtttctgatggtagaacattctcaaaaatcttgtgggtcttctacgtatgtcacattgattcacacattcagaaaagagggtcctcacagatttttcctgaacaaccccatctctattcttggcttctgttgaaacagtcaaataaatccacaagttaatgcctaacctcttcagcactagccaaaggttgtcaagacacacccttgggcttatctacagagcacacttttctaacagtgaatctcctaattttagcatctttttttttttttacaatcattcagattgtgaattcaggctcagaatttacccagtcatcagatactgattccttttgtccacttatatagttattttctctttaaaaaaaaattttttttaatgtattagagatgaggtctcactctgtcacccaggctgcagtgtagtggtgcaaacatagctccctgtaacctcaaactcccaggctcaagggatcctcctgcatcagccttccaagtagctgggtctacaggtgcatgccaccatgcctggctaattttttgcatttttttgtagagacttgatcttgctatgttgtccaggctgctctcgaactcctagcctcaagcaatccacccatcttggcctcctaaagtgccggattacaggtgtaagccaccatgcccagcctgttttgtcaatgtatctgttttctgtcttattttactataagcactaagaagaaactaagctatatctctaacactagacttgaaaatttcctcagctaaacatccaagttcatcatttattcaacttttcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacagccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaatgttgtgctgcctatgataattaagattaaagacaagtgaaaaggcatgaactatcgggggggagaagcttcaaccaaacagaagtgcaggagtgcttttgtatgtgcctggtccagtggagatcatgggatcatattaaaaacatacttgtaggaatcataaggttttctttagcactgcttgccagagtagtggagatatggtacaactgaaaagtttagaaacatcagaagggtgatttacacgctccagagaaactgtttcaacagagaagtttttcgttttgttttgttttttgttctgttttggtattgagtatagaattaagcaagtgggcttcaaatgcttagaagggtaaaaatctggaatgagtaataaaaggactgtagattattattttctggagagccttcaatagaatagctcatcatgggtggggtgacttgaagatgaaggtctggacaacgtaataaccaggtctataaataatacaatcagaaacatttgtttccaaggcaaaccaaagaccattgtttcccttggaatggtttacatcaggaatcaaatacattggctttttctcccccatgagacccaaataggcaaattccttaataggaagtctgaaaacgttagtatccacaactaggagaatttgagcttaaggccaagagctcaaaggaaaaatggaaatccagaaattaatatacatgcaatgcatgtaacatgctatatagttttgatgatttataataaaaagaaagctatagccaaatatctcatttacagactgaatttatttagatgtccagagtcccagtggccacaaataaaatattattacagttagtgtccatttcagaaaaaacaacttgcaaatatatgaattatgcaaatcataactttgttcctagttcttggagatgagccagagttcaatctttagccatgatgaccttatatcttcgataatagcagttcagctaatattttcacctatatcttggctaattgaggttcagccatcaccttttgatgtttatgagcaaagtgtaaacactattatcctattatttgacataataataaataatataaaacccctcgacttctctactttgttaaagtctgcccccacccccactccccagtggggctgttctaatcattgagtgtccatttgatgcaagctgctttttcaggacacaattatgaattaaacatagctcctggcttcaagatctcacagcctagtgggagatgggatatgtacaaacagaattgtaatccaaggtggaaagaaactgattgatgttgaaaccgatataaggcctgtggaggttcagaaaaagcaagaatttagttttagagaggtggggtggttattgggtgggaagctggtatctgtgtagattttgtggagtggctggcatttaaactgaaatttaagaggtaagtagatttggatctgtgacactgtcattcagtcagtatttactgagcacctattgtgtgccacacacaatgctaggctctgagactatgacagtgaaccagctagacgtggttcaagattcatggaactgacatctttttgaagagggagggagggaaggcatgagccgaggtataaacttggaaccttggtgcatatgcagagaatattgaacaattctgtttcactagagtgcaaggtccatgaaacacagcagtggatgtgtggtttgggcttcttgattcagtacaggatagggaaatattgaggagttttgagcaaagaaattatttggagcactgaaggaagatgactctagaagctctatgtaggaaaggtagagtggggagaggccacagaaggccaactttgttggaggttactgcagtaatacttatgagaaatgaggccccaaactggggtagcagttgtcagtggcaccacagatacgcacagctgcagctctgaggcttgctatgatccttttttttttttttttttgagatggagtctcgctctgtcgccaggctggagtgcagttgcacgatctcggcccactgcaacctccacctcccgggttcaagcaattctcctgtctcagcctcctgaatagctgggactacaggcgcatgccgccacacctggctaattattattattttgtttttgtattttagtagagatggagtttcaccatgttgcccaggctggtctcgaactcctgagctcaggcaatctgcccacctcggcctcccaaagtgctaggattacaggcgtgagccacggtgcccggccgctatgatcctattatctgtactgttgaatggctcatgcaagccttataagcaagtagcatcaaatcatagagacatgaagcagacaggagaacatgatttctgcacaacttattcagtaatattatagtgattatggtaataagagcaagggtaagatctctaggttgctttcttttcctttcctttccttccccaccccctttcagttcccttcccttttcttcccttttcttttcttttcctttctcttcctttttttaaaacaacactgaaagccaaaacattgtatggctgttcaaagaaagaaaaaactgacaaaagactgagtgcacattaaaatatactgattcagctttggtttcataccgtcaggaaagaaagatatttagataaagtataatttatggggaaagcttcaattagttcatagctaggccttcttaagtgtctggttaatattttaagctgtacatttaagaggttcttgaacaattattattttctaaaagaacagcagattctctgttttactatggtcccagtaatctcttagactttcaaactgtgcccaagtctattccctttatgctaaatgtctttctactcaaataactctaagacttccctcctaggacattcagatgccgggtcatgtgacactgaatggctttattttggctaatattgtgttattccagaatgaggcctgttttatgaatctgctctatctccttccaccccaaataccttgtgttgccatccctccattttcctacaaaaactcaaatatcacaatgggaattaaattgaaaatacctaagtactatgaattttctttttgaacaagtctcggaaacctatggcatataatagcacagtggcctcgacttttggacaaaaatcgagtaatggagtgctttatctggctgaacaactggtagcacttaatggtggtgcttgagggaaagagggaggggaaatgaaaggggtcatgtactaaggcccctagcagaattcagtataacgataaaaataaaaacgtcttccagatgtcaatgacttttttacttcagagcatctgtgataacaaagctgacttgctatgaccttacatcttgtagtactttgtattattgtaaggacttcacttttaacatccattatccatcatcacatttcctctcagtctacaaacaaacatctttaaggttccaccatactattaaacaacaaccttcaagctgtgactcttcttcaaggctaccaatgacccacctaactgccaaatcctacgaatgcttctgaatcctcatcccacttattttctctcatgtcttccaccaagtgtacctagccctgtcttcccctacctctcagaaaactcattcccctttatcagtggttgtcttcaaatgacccctaaatataggcattcttttattttatttcactaggttttgggagagcaggtgatgtttggttacatgggtaagttctttagtggtgatttctgagattttggtgcacgcatcacccgagcattgtacactgtacccaatttgtagtcctttattcctcaccctccccccacccttcgccccaaatcttcaaagtctattatatcattcttatgaataggcattattgttagttgccttcatttgtgttctcttcaccttccagggtcatcttagccatatccacagcttcaagaatttctttcatggagatgactctgagatctctcctggaccccaaaaccaccttcccaccgaaaaggatagctcacacactaaactccgtatattcccaaccaaatatgttcttctccagcaaacttatttttccatccaggtcagtcacctgtctcagtattggcattagccttttcccaatttctatagctagaaactctggaagcattttgtattattccctctcccctaatatccagccaggcacagaagttgccctccctgtttcagtctcttacctcttcaacccattcttcacactctagagagagcatcctaaaatgcctttcttggcccacttcaaaaatctttgattgttctccctaattaatgaaaccagtgcagccttcaaaggtctcaggagcagacccaagcataactttgacgcctcttctacctcattccttaagccatgccacacaggagttatcattggaaaatgccaatactaaacatatgattaagtcactgactgtgtatataccttcatgccattatacacacatgcactttgctctgactgttatggcctcactgcccagcctcaccctttttctcctatcaatccttcaaggaccaatgctgcctttctgaagcctttcttaatttttcttcccccactaaaataaattgtgttatctatgctcccacagcaatttgttcatacctctattctggcctttgtttcattctgccttctactacagttgtctgtgtccttgactaaagtgtaagttccttgatggcagtgacggtctcattcatctctgggcctttacacaaagcaattgctcaatgaattaatgtgtagtgtcaactctcagggaattaaacaaatgaaaaggaatgtttgctacaggtaatggaaaatcatagctaatttcctcatccaggtgagaacatagccttcatcactgtcctgggaactgaggacctgcctaaggtcagcattaaggacaaactccccgaactgtgtttagctggaagttgactttagaggagtactttcaggaggtgaggaaggattgaagacaagtaggaagtttttttcctccaaggtcaagcttttaacaagtgcctgcaatgtacactgagggatttggctgtactccaattatgctaatatgttttatatatgggcctccagcatccaggaaccacctccctcaacaatttaataagtgtaaatatcaaggcagagttgtaaatgtggaacttatttgtaatgtaccaaccttgttattatcaaatgtcacagggtataagtcatggcaattatgctgcctgctttttattacatttattttactttttaaaagtgcagtatatcctcataagcttctcctattctgccctacccaaggaacctagtgtgcctgtgtgttctggagtcacagaaggcagaaaatttagagtcacaggattaatgggcatccctagtaagaaagcgacctcgtgaatcattgactccacgcactgacaccatacctctacattaggcttcactgtgtatttcaacaattcaagttgtgagaccttgtgagtttctccatacaagagatttcatgatttaaagcacagaattgttccttcctccagcttcctaccatctgagtgtgcagatgtgtgtgtgtggtcctgtcatgggaaagttggtcattttgcacaaagccttcaaactcgatcggccagcttggtgtgatacagttcagagtcacctcttcagtgttctgttggcaggtgaaagtgaggggaagtgggcctgatttttctggttaggaccagaaaggtatccactatatccagcacataattcccatttcccagtagtctctttctcctcccacttcttactaaattgcatcaatcactcagaagcggaagggtgggtgaatctcttcctccatataactaagcattctgtggcaacagtccttttttcttatagaggagtcctaacctatctgcaggctttagcaggcttccctggtatcaggcagaaaacctgccaagccatagaaatctgttggcaagtagatctgtttttaaggggtttgaaaagtgccactgctttcgaagtttcctcgaaagagaaggaccaaaaagaaaaaagtaatacttcatccttgcacctaggaggtactttagtagtcatatttcccctaaatcaaagcaccctcctttgtttttggtttatgatccaacaacctcataaacaagctattcatctcttcatcattcatcccacaaatattcattgaacatctactgcatgacaggcactatgctaggcactacataccagcaaaagtagacgtgttttaggtcttcatgagcttagtcaagtggagcatgccaatggcaaacaaatcaatatgtgattacagttgtgtttagtgccttagaaggaaagactgcagatattgtaggagaaaataatggtgtgagagagagtgtgtgtgtgagtgtgtgtgtgagtgtgtgtgtgtgtgtgtgagtgtgtgtgtgtgtgtgtgtgtggtggaaagggaaggggcctaagttagattgggtggtcatgaaagtcctctctgaagaagtgatatttaattagagacctaaaggatgagtaggagtcagccagattaaaagtgcgtaattgtgtagtcaatgcaaaaaggaagtaaagtccatatcatgggatagtgtatttgtcagcttttgctacgttgtatgatggttaaaaacaacccccaaacctcaattagcaaaggtatgctgtggcagccacaggtcatctgtggcactgcttcattgtgtcttcttcattctaggatcctggctgaaggagaagcccttttttttggacacgccaatcttacggcagagggaaaagagcaaacaatgctgaaccttgccacagctttcaatcttctgatcatatgtagtggaagtcactttggctcacattccattggcaaaagcaagttttatgaccaagttcatgtcaattcatcagggcacgtggcaggaggcaggaggaaaaaagaatctatagaaacaataacgcaatctgccacagcccttgtctgagttccacctatacctcttactaatagacgttacaaacatttcactaacttctcagggcctcagtttcctcacctctacaaataatgtttaaaacaactgaagagaacctaagatggtttttcaagggttagagctagcccttaatttaggaagcaacttgggggaactgaaaatatataatctggaatctaagatttctctacatttacccgcagcattttctttcaattacaatgatacaaggaaggcgagttttagcacgctaccttggccactaactagctatgtgatcttgggcaacttactaaaaccctgtgagccttggactattgtaaggattgtgtaaagtaatatataggatgagtacattttgtgtattataatggcataaacatactaatcattattataattatctgactgccatgatcacctctactaagatccaaaaatctgcctctcggccagccacggtggctcacacctgtaatcccagcactttgggaggctgaggtgggtggatcacctgaggtcaggagtttgagaccagcctggccaacatggcaaatctctgtctctactaaaaatacaaacgttagcccggcgtggtggtgggcgcctgtaatcccagctacttggaaggctgaggcaggagaatcacttgaacccaggaggcggaggttgcagtgaggcaagatcttgccactgcactccagcctgggcaacagagcaagactcagtctcaaaaataaaataaaataaaataaaataaaatgaaataaaataaaataagatattaataaataaataaatctgtctctcatactctcaatcccacgtttcacccagccacctcaagctcaccatgtcaaaaatcaaacttcttttccctctcaggcagtccccattcagttccctctccagacttcctgatgttgatcactggcactgatgtgcttctaatcaccaaggtcagaaaacttcaagttatctcttgacagccacacccctactcagttctatcacttctccttccacagtatagtttacatttctctctttctgatttcaaagctaccacctaagcccagaacctagcacctcactccttgattactacactaactactcttactccctttacttcaccccaggccaaagcagccttttgattatctgattcccgtgctcaaaatcctgcagtggctcaccagtaaataaaaaaataaagtccaaactcttcagctgagtggccgacatccttcagaatttggcctggcccactttttccaacctttcttctcactcttacccatatacaccttctgctgcagcagtactgacctaactcaccattctctgaaaatctccaggatctagaatagcaccgtccgggagaaatctaatgcaagccatgacatgattttaaattatgtagcagctgcattttttaaaatgagaaacaagtgaaattcattttaatgtttctattttccaaatatcattttaacatgtaataaatctaaaaattaataatgaaaaattttacatttgttcatactatgtcttcaaaaatccataagcattttacacttgcagcgcgtctcaatttgcacacactagccacatgtccagtgctccatagctgcacgtggctggggctacagtactggacggcagagatctatcccccaccttgtggctcaaggcaagctcccactcgaattagcacctgtggaaatgctgcctttcaaagacccagcttcatagcctccaagaagtcttcccagattctctcaactgaaagtcatctttcccatttccatgctataccatacacattattttagtatattaatacattttcaaatgttttgagtagataacacattcatttgtctcaaactcagagagggtaccgaaggatatgcatacaacattcccagcccgtcccccttcctagccaaactaattcctttccttagaggccaccaatgtcatttgatttttgtatgattttgcagataaatcttacatacatatacacatgtatgtaaacacacatttcttccatctctttttcaacaaatggcggcaaagtaaacgtgctgttctgtaccttacattttttgcatttactagtttaccgtagtgaccattccacatggaacgtacagtacatgaaatgtttcattgaactttccactgcgcattaaagatcattgtatttgtgtctgtctccctgacaagccttttaatttttgaagggtatacattttgtcttcttttccgtatcctcgcaaagctctgcatcctggactctggtgctatacacaatactcaataaatatttattaaattgctcaatcagaatgatcttcttaaaatgctcttttgcatttgacactctcacccccaggaaaataacattaacttctaattgcccacagcatactttctttctttcttactttcttttttttttttttttttttttgagacagagtctcactctgtcacccaggctggagtgcagtggcgccagcccagctcactgcaacctccgcctcctcggttcaagcaattctccttgcctcagcctcccgagtagctagaattacaggtatgcgccaccacgcccggctaatttttttgtatttttagtagagacagggttttgctatgttgaccaggctggtctcaaactcctgacaccttcacagtcaggcccaactttcctttctagactaatctttactccccagaaacacactctttgttttaaacaagtctcctcactggaactttcccacagttggtatgtatggacctatctacttctctctctgtgtgtatattttattctaatgtcttcccaactagactataatcccctgaaagagaggcaatgtctaatgcctttattcatcccaggacagtacctacaactccgtgattctcattgcatgcttgatgggctcgtaaatatctttctctaggatttcttccctcctttcctttcccttgggcctggcctgccccaggctggatgataattaccccgattgtacatttccttttggcagagacagaatacagtttgtttctctagttcatttttatttttaaatcattctttcctcattcaaatgattctccagccagagaagttataggcagaggcagtgacaaaggtcaaagcacataataagtgtactttctgagagggagttttttttccccattttaacatttttgtcttgaatttcaattacttaaatccaaaatcactgccttttcctatgtctcaaataatggaagctgctttgagattcacatcaaaagccaacatggcactataatggctctccagcgcttgaataaagcccagtagtacttataacagtatcagctcaaaaatgggaagcgttacaatagctaccacttaatgagcactatgtggatgatactattcgaaagctttacacccttcattttatttaatccccacaatcatcctgagataaactctattattcatattttacagatgactcaactaaggctcagggaggtaaggtagcatgatcaaagtgtctatcagaaagtgatagagatggaacttgaacccaggcaatatggctccagaacacatactccaacccctaggcatattttctcccttagcttgtgagagccaatgcctttccggtgtatattgcttgaaatctattatatttgaacccctcaggagcacaggtgtcatcagcctcgtctctgcgtccctattgtttcctcttcccttcacttggttcaaaaagaactgttctgcttttccactaagcctcttcaccatttgactgctactatctggggaagcctctctatctgcactctgtatctagagtgttccttgctgctcgaaatatactccacggtccagcagcatcagcatcaccagggaacttgttagaaatgaagcatctcaggtatcaccccagactactgaatcagaatctgcattttaacagactctcaggtgattcgtgtgcacattgaagctcgagagcagcgctctccatcttttgcagtacttactcccttagtaattccttgctggagtgttccgtacacagaagtctaaaatctatggcttgaaagggagggaatcatttaagctgttccctgttctctggcctttaggagctccaaaatcagtcagagaccatgctaagagtagatcttgctgtcattagactaacaaatatgtggacgaaatgaaaagacagccacgttagccatgatttcctttccatatttcattcatgctctccctgtatctcacactgccacaacacagatgctttcttttatatcatgggaacatttttaattaaagcattggaacctttgagaatagacaatcctttaaaagttaagtttatctgtatttacaagcctccatttatttggcagtgacaataggaaaaaaaaactgctgctaaaggcatatagaggaatgattaagctaatttacaataattgctttaatcttgacatattgaattgtagtgtctaactctttgagttctctcggtctgaggtaaaggaaaaatataacactgtgttcgatattgtacctctgaagcacaatggaaattttgccctacagtgccagcctgtcacccatggtgtccatgtgatagaaggggagagatcacccgcaatgtctaattgccactgtactcactcctgtgctttaagatagaaagcccatgttcagaagcaaagccattagcagctattaattgcttagctctaataaattgtccagaccaggacttaattagggaagacatttaggaacaggacacaggacaagaggacataaaggagagccaggaatgagatgaaacctgagcagccaggaaggccaggaaggggcccaggatggagagagggtagttgagatatccggatgtcaactttacttactttctgatcgcgtttcaagacagtccggctggttgcttcttctaaagactcctatagttttgcatctatacctctccaggaagcacctggagtaggaagagccgtggtatctaaggtgatatgaatggtttctttttgctcttggcagctctgctcacccctgcctcccctgaagctgtctacttctctgcttgatgggactggctgggtcaggcctggttttgctttctgactgactcaggtctgagtcactgatcaagaggaggaagtcctaatcatgggtgcagccctttcaagtaagaaacatggaatttcatcaaaagggactgtgagctctccgagacatttggctgacagttattgtcccattatttcacttttagagaaactacattcttcatctttggcccttcgtgaactctgctccaccagtgatttcaatctcaaagtttcctgaagggctttggccagatgtgaccaacagctcatcatgagctgatatctggtatacggcctcaaacaataggaagaagatgatcattgtattcatgcaacatttatataggtgtctctctccagattctggcaagaaattgcaaaaaaatgaactattgcttttgaattggaaacaaagtacttggctgctaaaaatgtggcactgcagcccacttacaacagttgagggcattacaacagttggactctcttggtgtcattcctttaaagaaaagcattatcagcaagaagcaaatatgggtcattcttattaatatttccatactctaacttccttctgaggggcttggtgcattctaactcaattatctcacttatctttgagggcttttgattatcttgggtggggttgtgggacagggagggtcgacacacaagcacatatcctttaagagctcacagatgcttttacatctagcaacttgtttgagcctcgtaagtctatgaggtctacagagatgatcataccttatttgtgaaagaaccatgtttgaaagccagggcttccagcactacatcccaaataccccgagagctgtggctctcagcaccactgttgctgtagacagcattcactgttctttaacttccaaggatgtcagggtagccgtgcgcttgcaaagagggggcaccagggcttttttcttcccctgcttcatttgctctttatttcttacactctgactccttattgaaggtttgtggccctaaatgcagtttctttagctgtctctttccctccaaccccaggtagtattttagcctggatagttcccataggtatttctttatacctaaattcaaaagtgtttcttgacttccttaaacctatgcccttttatgatcaacatcttgcatgtcctaccatttctccccctcccctgacccttgcaaagacactggaatggacattcatccccagtggagagttcaggctcctggtttccatagccttcatcttatccctaccagcagccacatttttacgaatctttatttcctgttttaagaaagcaatatgcctattttttctctgcgatataaggtagcataatattgataggatctttcaaactatttctctctggccctggttctgaaacatatagccccttgagaaacatggctctattattacctatcaagttttattatatttaaaactgtttccacatctgttcccctaaaccgtgacctccttgaggatggggatataatctggttaatctttgtatctgcaaatgccaagcagagtgccaggtacataaattgttgaacgaacgaacgaatgaatgaatgaatgaataaatagtgccagaagaagacaatgctactccatcatttcccccatgtcttgctctgtttttagccaaagtacaaactggaagtgtctaagatattttaacacccaactatgaatagtgtcaatgaaaatgacaatagttcccttctctgttcccccattctgtctattttcccatagaatctttactgctcaggttctatatgcttctgcttgactaattatacacttctttctttcttcttgaatgtttaaactgacagtaattgcccagaactgaatgcatgacctctaagaatctaatactactaaaaagggactggtttcacattctaatctggctgtcataatcatcctcaagaggattgattcagtaacttggaagaggttgccatgtcaaaataaaggttcagctcagctccactggtcagcctaccagctgcacctgaacttgaaaatacctttgtattgttagttgttcacatttctttttataatcaatagatccatgcatctggagtgaagaatcaagtattttgttttgttttacttcatttcaatttttaatctatctaagtttctgtaaaatataataaaaataaattactagataaatataatggaaaaaagtcatgcaaaataaaagctcccatcttttttagagtcaacagacaccagagtactctgttaaattgctgtaaggttcctgaatgcttactctcaacagctacgcttacctcatctcacccccctcaacccatgattctgggattacatcaatctgtaaagcaagaagtgaggagtgctgcatgagactgtgtgcttatctaggccttaaccaaaccttattaaggcctgaattgtccttgaatccccagagcctagcctccattatacctagtggttattgtgtccaagtgaatgccggtgcccttctttaaaggtctatccaccttgtgagtgtgagttagaattgatgtaaatgattcagcactgtaattaaaggtgcaatctctagagacagactcagttttaaacttctggtttagccacttaccagctataagaccttgagcaagttatttaacctctccgtgcttcagttttttttatttataaactggggataattatagtatctatcccatagtgatgttgtgaggaatacaagatgtgacgcatttaagatacttagcaaactgtctggcacatagtacaaactcagtaaggttggctattatctccacgtgactgccttaattcattcaggctgctataacacaataccataaactgggtgatttgtaaacaacagaaatttacttctcatagttctggaggatgggaggttcaagatcaaggtgctggcagatttggagtccaatgagggtccactttctaattcatagatggtgtttttctgttctcacatagtgaaaggggtatctcttttgtgaaggcactaatcccaatcataagggattccacttcatgaccccatcaccacccacaggctctgccccttaatactatcaccttgggggttaggatttcaacatgaatttcgggggcacataaaccttcagaccatagcaatgactaataaatggtgttaatgtccccttcatttcataagagagtgaaattccaagtttacagtcctacaggcccctcaacccatgactctgggattacagaaattgctctaaggcatgctgtcccttctcccttttttctactcagagtaatgtctcattctcattgctcccaacaaggctcctgcaccctggcaaatcagtttacttactattgttcccttatactcagctagctaattctcacttgttgacattttcccaggaccaccatcaacctggatcaccctcttctttcatctctgttatagtcattttccttgttcaaaatcaatctccaaaatagcctccataaacagtagttctcaaactttaatgttcatcgcgatcacctggggagactgttaagcatgccctttcctgagctccacctcaaattctgatttacgaggtctggggtgaagcccaggaatttaatttttaaaataaggcctccctctgtctacccctccaactgccaggggactctgaggcattaacttttttgggtcatagactgacaaaaaatgttttataagaaaacatgaattaacaccacttgaatcaattctttctctgaactttcttaaatgctaatacttttaataaagtaacaccatattaattcagcttcattaaattggaagtcttgatacttggacagaagctaggctgccaaaaagagaggtgggaggctgaggatgaatctcccttcaagatgataagtagagctagccatgcatatttagataggtgccaattaattctttgctgatttattcattgacaaaattctttgtttagtccactcaaggtctcatctactatttctctcacttggattattgccctagtctcttacccagttccccacttcctctgatgctgcccgatagtctattttccacattcaacagaaaacaattgaaaggttttattcaggtgagtgatacactagaattttattttttaaagatcacaccggtgtttatcgtaggataagggccaaaagcttgattaggatctacaaggccctgcatagtctactcccaactacctttccagcctcatcttgttttatatgccccctttctttcagttccacgattaggaacagttccttctgctgcagaacctgtgcataagctctttcatcaatttggaatgttcttctcagcatcccctcctaaccccgtgtacccactcagacacacacttagttaacccctacttatcttttgaatcttagctcaaatgtctcttccacagagatatctccctggcttcccactctaagtcagctttcattgctatatgttttcagagaatcatgttacttttcctcagaatacttgtatcggtttgtgattacacagtcattattattactgtaattattcaatcaatgcccatcttctcttgtagatggcaagctccctgaggacccaaagcatatctatttttgcttgtcactatatcctctgcatctagcataatgatcagcatacagcaagcccttaataaacgtatgttaagaaatgaacaggatgaatcccttctgttccttcccagagcagaccacaatgatctaaacttctctagtttcttcccaaagctaacactgtcttgactgtgtaggagtgtgtgtgtgtgacatgagttcaaactcccctagagggaaaaccccggtcaaggtaataggactcaaaacctacccacttaacctttaagcttttggccagctccatccgccaggggatgagacaagcctgatcctgatggctcctgcccattggcctttgcactgaatagttagcttgtttctagaagtcacccgggcatcatggtaaagatgggatccttgttcaagtcattaagttgcagttcagcattatcaaatcttgttagctatcaccttaactagcaaatgccttctatattaaacactgagtaattttactttgattaagttatccatcccactccttctgatatgcatgtaattatagttcttgaagtgaaatcgaggaggaatggtaacaagatattgctggtgacagtgatggggggatgaatgggttgctagtgtagtgtgatgtgtcatttcttagcccagatgccattcagaatttcacaagagtggtgccaccattttacataaaagccacatcaacaacctggaaagcttcagctaaaatcacatctgaggttcaagagttgaagtatattgactccttgtccctattgctcccagcataagtaaactccacataaatcctatgactccagatggatagaggcataacatactaatgtttctgtcaaaaaaaaaaaaaagccttaactacagagcaactggacaattcaaatgattttctaattggtcataattttccaaacattgtaatatcacatactgaccatataatccacctgagaaaaggcatgccgcaggaagaccataggcataactggcctcacaattactctgtctaaatattctgctaattggattttttttcaattgtgactattttaactgtcctttccaatgatgtaataagtgatattcttcaacacgtgagatgctgttggcaagctctgtggatctgagtaatttgagtagctttcagcaggttttgcaaagccattttattttatttatttatttatttatttatttatttatttatttattttgagacggagtcttgctctgtcgcccaggctggactgcagaggcgcgatctcggctcactgcaagctccgcctcccgggttcacgccattctcctgcctcagcctccccagcagctgggactacaggtgcccgccgccacgcccagctaattttttgtatttttagtagagacggggtttcaccgtgttagccaggatggtctcgatctcctgaccttatgatccgcccgcctcggcctcccaaagtgctgggattacaggtgtgagccaccacacccggcctaaagtccttttaatacaatgattttttcaaatgagtatgccttgtatgtatgtgttatgacttttcctttttagttttaacttgtaaatggaataaaattcaaacaaaagtagtgttaatatgaaagtataaaaagaaaatatccaaagtgccatacttttcagataatctcaacccatcctctgttaacttgtacatatgtccattagtctctgtgattaggaagcatattggaaaatttatttccttggtgatacccaggttttgttcaatatataattttaagtttctcaataagaccatctgttatgtaaaataatctcttcatttcctgaaaattcatttacaaaatgtttggaaagtgtccatttgatataattattccttgcctactctcttttcccaatctccattaaaatatgcatgaggatttttttttaaatgaggtaatcagtgagatcagatgacaagttactacagtacccagctcctttgccatggataactggactgtggatagacactagacccaaaggcagtatttataggctgaccagtggcctatggggtggagcggcataagaattctaaccaatcagatcctcactcaaagggattttcaatttgagactcaaaatatcagcccattggtcagtagtcatagaagtaaaagcagaaacagaatagctgagctaacctaatagcagagctccttgtgagaggacagcttactgttgtatgatgaacagtggtgaagttatttagatggcttgtgtagtttatttaaaataaactttgattgactgagatgtgctgagcatgtcactattctgtgtaacttgactgtgcctaacacatggatcaactttttaaaatgttctgaagtccagttgtcaatgtagagcaaatagaggctgaacaaagataagaaaccaggtctcttcattcctagtctaatgatatttacaagatcaactttactttctttcagaaaagctttagacctcaatgagatactgttatttcttcagacttgctgctatcaactgcatcaacactatgatgctatcttatgtataggaaagcctgatgacaatctgtgaaaggacaggcaaatttccaggtgatatatgtaaaatatttgattgacaaaaacgtcactgctaggaattaaagaaaagctacacgtagtcactcaaagctctggtgagggaaactcgcacccagaaccacacttaactcttcagttggaaaacaatttttgtcaaatgtttcagtagaagcctttaagtatgctttgtatgctcagatgtgattaaatgtacctcttctgagtaaatctgcctctacaccagatctgttcaaagtttggggacagtaccaccatttcccttacttcttgggatagtatcccccaagattcaactttctagcagttattatttcaaggccaggaaactttacctaaattaagctaagaaatataatgtctcatgctgatttttcaaaatttaaattctccatctctgaaagatttctttgtattatgaggtatctggactggtgaaacctaatttgtaagactttccaaatattggtaggttcagctgatctacagaatcaaagtggcttaaaagaaactttgactctatttctttgaacctccatggccacatctgtaaaatgagaatgataaaacttgccatgccaatataaccctcctgaattttagaacatgagagttggaaatgcctctcccaagtgatctcatccatcctccctgctttaccctgtggttaaggtatgagcatcaaatgagataacagagatgcgtttagaagaatgctacaaggtattaacatcatcactctttgtttttatttgagtgatgccattactaactgttccaaaggagcttcttggctctttatttattggttatcttgattgaaaagacctccagactagctaaagtcctggacattagctctatgcagaataacagccagtattttttttttctgtctgttctctctgtttctgtctccacctttgatagttacatctaaatttatccccagaaaaaccaacatatattcttaaccaagacagcacttcctaatttgtcctgttcaggtctcatcctccttgtagaaaaccagtatgtcttagctgaaaaagctttgagacataatcttgtctagagactccttaatgccagtctgcaaaccagctgcatctgaattacccaggggacttttgacaaatgtagacttttgtttgtagttttgttaaactcttattacaaaaaattcaaacaaacaaaaaatgacagcctgtcatgaagaactcttagatacttaccacccaacttacacaattaaccacccatgtttaatcttatttcatttatatttcatccaaatctcatgtataaatatttcaaaatgcaaacatatatatttcatttttgttttttcaaataaaagttcctggaattctgatttggtagttttggtatagggcccgggaatctgtatttgtaatagatgaatctgatatgcaattttcagaacagttgtgtttgattctccttctcatacatagagaaatagaagctaaacaaggacgtcattagctgaagtttactccattgctttatcccaaagacgggttactgttttgaaaggagaaatattctaaagaccattcagaagaaacaaaaacaaaaacaaaaacaaaacaaagcaaaaaaacattatttgagtggtaagtgctttgaaaataacaggctaataccaggaggcaaggaagcaactttctgagatgtcaactaagcaatgaagccttcgcagtccacactgaagtctcatgcctttgagctcagccttcattgactggactactcatttggaagttaatcacaggcagccttgtgacagctcatgtattatggaatcgatttcactctttttttttttttgagacggagtctcgctcagtcgcccaggctggactgcagtggcacgatgtcggctcactgtaagctccgcctcccgggttcacgccactctcttgcctcagcctcccgagtagctgggactacaggcgcccaccaccacgcccggctaattttttgtatttttagtagaaacggggtttcatcatgttagccaggatggtctcgatcttctgacctcgtgatccccccgcctcggcctccgaaagtggtgggattacaggcgtgagccaccgcgcccagccagatttcactcttaaattgccttaactctccaaccaaattgtaagcctatgaagggtagggaccttgcctgattcagctttgtaccactcttctccccacctcctaacaaaaccccgtttggtgtcctgtcacatgtgatattttattgcagtgcattacttcttactttatatcactaggagattacttcaccacatttctatgctgatgtgctaaatgtagagaaaaagtgagtgtgtgtcataatgtacctaaatacaaggactatgtattgtgatctatgtgtcgtgattcaaaaggttctgttggaatgtcctgaaccaaattcatttcttcagtggctcaccatattgcctggaattgctaccctttatcatctctttaagtgactggattgaaaccctaaagttcacacaggagttaatccagaagctccttagcataaattagctgacagagctgattgcatttatgatgcaggtctctttgatgtcataaagggatcataggcttcaggtcgatagctcaattaggattctccagtggaagttaaggggctcttgggtaccccatgggtggaactacgtttgctgaaaaggggcacagtggttgagaatgcaggttttggagtgagatggatttaaatctcagtcctgagtctaccactgactagttagttatgtgacattggagtagtcacttaacttctctgaccctcatttcgttcatcggtaaaacagagggttaacaatagaactcaatttcatttattcaacaaatttgagggccatctatttgctaggcactgtgctagggactggggataccagataacaaggccaggtaaggtctctgcagtcctgaactttaattctacatttaaaattttgctgaggctaacatgagataatgcccgtgaagaacttagcgtggtggttggatttgggaaacacgacaaacatcacttatcttcatggttattattatccaggaaagaaggtgaatggcaccacgggaaaatatttcacaatttgcccaagactcatgctggtaaagaaaaaatttggctcagatcccccaagcctatgaggaggctagaagcaacccacaaaaggacatttgaggaatggagaaaaatctctctcaaccaagaagatattcttatttctgcttaaaaccacagcataccaaaagaagcgctcttaccacagcagccaatgccatgttggggtctacttaagccagaatgtttttatcacgtgggtttgcgtgatagccagagcaacagaggtattgataagatttggctgtgttgcctacaaaatctcaccttgaattgtagctcccataatccccacatgtcatgggagggacctggtgggaggtaattgaatcatggggggcaggttttttccatgctgttctcatgatagtgaataagtctcatgagatctgatggttttataaagggcagtttccctgcacacgctctcttgcctgctgccatgtcagatgtgcctttgctcctccttcgcctttggccataattgtgaggcctccccagccgtgtggaactgtgggtccattaaaactctgtttctttataaaatacccagtttcagatatttcttcataccagtatgagaatggactaatacaggtatggtgagtgagctttttgtagttgaggcaaacaccctgtgtactttaatgtttgcacaatcacagtcagagagggtgcaaattctctgtgatgagcatcaacaggcctgatattaggaaatgatcattgatctggtgagaactagtatgaagttcaatacacagaaaatgaagaatagctacaagacaatgaagagataaatgataatgcaagaggagggtacagggcttacctctgaagacatgacttgaaactccaatgtaaaatatccagggaggcaggctgaccttgagcttggttcagaagggaattgagaggggagagatgtaatctggaaggtagggtagggaagcagcacccagatctccaagggtcatgcccagcacgcaagataatgggtctagtctaggaaacaacaataactttagtccccatctactaatatggttgaaacttccaatatattttctgccctggtcaggactagcttaatcacttggcagggctgagcctgtagacaccttacattagtgactccagctgaacaggcctgacatcaggtgtctttgttttatttgtaccataatagaaaaggagagataaaactcacaagctacagggttaagcttagcaggtgtgtacagaaacatctgaacacacacagcaggattctcacttaaagatccagacccagatatacagactcatattcagatccacatttgagagtcaatattcaatcatttttcaagtgactgcttattcctaccttaccttaatttatgcagaaagctaatacttatgcattgtatatattcacggcttaaaataaagggccgttgaataaatctaaagatgagttttgaacaggtcttttgcctgtgttctctttttcttcccgcaactgactaatgctagattccaaaggtcacttgtctttagcaattactctgaagcactacatcctacctgcagccttttaaacattctagcctaaagaggattcattctattttcttggaaataaatgtgaactgtcaatcgaatgccactaataaacgtttctaattgatgtttgaagagggggatttttttcccttaggcaggctgccttttatcttagtcagtggccttgttgtttataaaaaaattatttgtgcattcataaagcataggatgagagttaaaggacaatacttcccttttctgtttgtcaaattggataaaggcaccattagtactgaagggtttttcttttctcatgatttaaggccagtatgttttaacagccaaatcaaacacagattcagatatcagtttcactttcatgaaatgaaaatatctacccccatcaaatgcctgaggccaaatcatgtgttgccaagtttgaattttgctccctccattccctacttcagtgccccatcattttttttttaattgtaatatggggattacagtagctacctcatagaggtcctgtgaaaattagggtaaataagataaccattgtggttgttggagggagaaataatatctgatttcaaagctaactgagaaataagatacaggcttaaggcaaatgaagatgaaaatagccttattactgataacactgaactcaatggtataactttgatatgcagccaaatggttttagttattttctcctcttctcctctagtctttaagatgattcctctgaaggaatttgggtctacagagcagacgaacttacccataatgtcctcttagctctatctaattgcaaaccatggaccaatgggccggttcagataattcacttctcctcccatgggtaggattgccagatttaagatataaaaatacagaatacacagttaaatttgaatttcagataaacaataaataatttttagtgtaagtatgccccaggtagtgtgtagggtatacttttactatcaacattatctattatttatctgaaattcaagtttaatggagcatccagtattttatctgacaaccctacgcatgggatgaaagtgagtaaggttgggaagagaatttcagagtgttaccatggcagaaggaatgttactcatgagaccatgggaatggaaggtcctcctaacaaccacacagtgtgggagcacagtgtccagcacaaacggcgtgctaaacacttatttattgctttccttcatgcctataagaacccttgtagtaaacgaactcatttattccgaggcattcgattcttactatgatgctcttctaaaagtatttttactttaaatgaggtccaggaggagatcaatgcttaactcacagaaattcttctctaatgattgattttcagccttgaccgagcatcataatgccctggggagcttgttagaaatacaaacacccagaattcccctccccaagtttgattccggggtaggatctaggcatttgtatttctaacaagcttccccagggattctgacactcagcgaagtttaaagcacatcattctgacacataagtgcagtgtctgcaatgtcaaggagcaggggattggtgtattcagggaaaggtgtatgcttctacccaacaagttagctgagaaactattatgccagtgcagagaccattggtttagacccaacgttcaagatcatggacaaagagaagcatgccttccttccaatcctagtagcaataggccaaagctccaacaataaatttatgagcattgaagcacctgagtaaagctcattttaattagaggttccttcctgtgctcttcagctgccttagacattatgtgtgactggctctgagagcagacatggtcaactataccatctcttctcactgcagattacagtcccatgtgaaagggctacaagagaggcaagtacagggagtagagggtcaggaaggagtagggagggagtgtcaaggaaagctttaagggacagtgagtattgtccttcagtcctttaaaggtgggtagaaattcagcaaggggaaagagcaaaaagaaagatacatagaggatagcagacaagagactactagagccagagaaaaactgagacaaacagttatatattctaaagctaagagaaaccttcataatgaggcaaaaataggcagacataaggcggagaaagaagagaaagaaaaaagaggagaagataaacacacacacattacacatacaaacactgttgcattcacaaagaaagatcctcgggagatggagaaaacagaaaagggacagagagagatacaaatccagattataaaaataattgcgatcacccttgctgtaggattttcactgttgtttaaacatgatgaaacaaaacatccgatatacatatactttctcagaagactatctcatgctgaatgtataggaaatgaacaccacatttgctcattcttgatgacatttgctgcttacaaatggctgttttcaggggaaatattgattatagttctaaaagtaggtggatacatcattaatatatttaataattaagagtagaatcataatacagtattgagaagtaaggcagcctttttcctgaacttgatctaaaagtagactttctaatagctgccattgcaattctccagtactgcagtgtgtctccccccgcccccccaatttttattattcggattcattttgttgttgctatgaaacttttggaaaggccctttgcagctgatgagcccaaccgttaagtgtaggtgatttggcttctctgggcgatgttgttgagcacaccagcttcctggaagaaacacagtagagggagatcaattttgcttcacggtgcttaatatcacctcaaggtcttttcccttctgtttctttttcctttttttttctttctttttggagtcatacgttcaaataaccacatgtttgaacattcaaaggaacatggctcagcatgtctttgtaaaggtacagaaggcaatatggcattacacacgctcaatatgctgttttgaattctctagaactttgttgctccaaaatcaaatatcttcagataaagggagagtatgttgctcagtcagaaacatgtaggtgccaggtttgatttctcttctgtatctttagcattttcagcatctactttgtaacctgaagggttttttttctctccctctctctcttttccatttgtagtttagaaaataagcaccagatgaggaatcactgtatctggggaagggtaccaggtgatttctctttgaaaagcttgtattagccatggacatgaacctaggatgcgactggactgggtgatctctggtatgtacatgagagctcaatggacaaaagaggataggcaagcaaggagggactgcccatcttcttcactcctttgacttgggggaagtggtcactgtatctgtggatgcgaaaatggaattaagaatgccctaacaagaatcataactacaagaatctcccactgtttccctgtcacaaaaacacattattcatttcagaggaatgcaagcagttccaaaaattaacagcccttttccaaatgctcccagtggcttacagtttctgctgcaattgcattagcatttgcaattcttgtttttgatgacgactgagctcatgattggtttctctgccactgctacagctggtgtctttgccctggcacaggggcactcactggtgcccttattcccttgcttatgatctacttctcctacttatattcttgttctgctgctcttgattctggatgagagtttttctaccatgtggtcagagcatttttcaatgtccttaggtagcccaaaatatcaattatgacaattctttttatccccaatccaaagtacacttattccttcaggttgatgattctctaaatattagatcagcttcctctagagagggccgtgaagtacttgagtaacttttggcatttctcattgactgttaaccattctgccacgataaggaatataccagtacttctctaccttccttcccataacacatcctttattaacaaatcaatcactcaccaaatgtttactgagcactgtgctaagtactggagataaagtagtgaatgagacatagaaggctcctaccctcacagagattacagtttagcagaacaagaagcaagtaattacataaaagtgtaataagtcttatgcaaatgaaagcagatttgcagttgaatccaacagtctttctgaggaagtaacactaaatacgaaatatgaacgcatttgccaggaggaaaagaagtggggtaggagtggagattgttcccggaagcatatatagaagtctaagggaaagagagaacctagcaattttgcaaagctaaaacaacaaaacaaaacaaaacaaaaacttaaacatagctggaatacagagtacaaaggggagtgtggtgcaagagagataggataggttaaaaaaaagtctagacgatggagaactttgtaatcgagtctagaaactttagactttatcatgggtagcaggaagccacgtgcaggatataaacaagggagtgacttgatcaggattgcacttgggaaagcccagtctgactgtagtgtagcagaaccaactggaaaaggataaggaggggagaaagaaaaccaattaagagtttgttcttgtagtaggccaggctacaagtcgtggtggcccaagctagggtagtagcatggagatagagcaaactgggcagatttaagaggtagaatttactcaatttagaggtgggaggatagggaaaagaaataatcaagagggtacctggtttctggcttgtgtaacttactggcaggggcggtggtgatgtcacctattaggataggaaatacaaaacaagtagcaggtttgaggatgaagatgatttcagtattggagtttggagtctgagatatcattaagacatccaagtggagatgccaattagtcagatacagaggatcgaagcacaagagagatcagagatgaagctagactttttgtgggcatgtgagtctatgagctagttcaaaaggagcatgcagagttaaaaagcataagacctaggatatggcttttagtatcacctgcctttaaggactggacagaagcagagaggcttgcaagaagtctgggaaggagtggtcaggtaagtagaagtaaagctattaatagtagagggcagcgtaacagaaaccaacagaacagagaatttcaaggaggaacatcaaatgtcaagtgctaatgggtggtcaaacaagacagaacaagactcaaaagagtgctttggcttttattatacacaggctactggctaccatgtttaggacagcctcagctgagctgtcttagtggggtagcgggtgggagacgtagaggttggaagcaaaaacaaaatgcagtagttgaggagcagcagggagataggcaaatggagacagtgaatctagaccagaccctcttttggggaatttggctgagagatgaggagaaaaatagaacggtatcaagggcaatagactgcagggaaaggttttgttgttgctactactgagtggctggctctgtagtagaagtgaatattttgatatctactcattgacgatgacatggaatttatcttgactgcaaattccttctcttgggggaatgaatcctagggtaatacaggaagaaaagagacttgagcatgttttaaaacacaagagtctttgtcctgaatttcccagaagcaagtcagtcctgaaacgctttcctcatctctcccatgggaccacaggaacctcatgcatacagcagttttggtgatattccttgccacctcagagtccctgtggtgagtaaataaatgagactccccccaccccaaccaccaccaccaccaccacacacacacacacacacacacacacacacacgcacacacgcacacacaccaaacaggatgctgcattatttattaaaaaatattctagcaatcttctttctccttctgggaggataaatcatttaaaagcattatttctgttgctagttgttcaagttttccatgaagatgaaaacacacgtttactcctatttctgtatgacctgaggtttcacgcttccaggagagggaattcatggtcaacatacattccaggtcatagttgaggattagaaataaagtatctatttcctttccagagccctgtggaggttcactttccctgttaaaaccccaattagaaaactatttttgagttaggaaaatgcaaacgtgtttctcatcagcatattatctctcctctgatctctatgtcaattttaagacattttttcttcatctatctgctaacttggcatagcaattagccctcaataaagatttgaaatgtgttaaatttcaggctttctgagatttagtttaatataatcaattgaaaataactaccttcttagtgtcaaccttttctatatactcaaattgctaacccactttgacatagaaacttgaatattaaaaaagaagatacacgctgggtgcggtggttcacacctgtaatcccaacactgtgggaggctgaggtgagcatattacctgaggtcagtcgttagagaccagcctggccaacagggcaaaaaccctcctctactaaaagtacaaaaattagccgggcatggtggtgcatgcctgtaatcccaactactcgggaggctgaggcaggaaaatcacttgaacctggaaggcaggggttccggtgagccaggatcgtgccattgcactccagcctgggtgacagagcaagactccatctcaaaaaaaaaaaaaaaaaaaatcttttcccatttcactcccagcgtgagtgtttatcctcttaagtttaccccctaaggaagttttcactgtcttgctcctccctctttgttaggatgtgagataatatgtttcttctctggctttttcaaaggctccaagcacctcacagaagagagaggaggggaggggagggagagagagattgatggcactcaaggacagcactgtcttttgtttggcagtctcaaaatgaattttccatcatcctctcagtgttttctattcaccacatttaccatgcacactccaactccactctccccaaactccagggctgaattagagcatacaacagacagaagcagtggctacccaggtcactgcataagcaggctattgaattgactcatgattagctggaagtgcctcgtgcctgcctcctaccctgatctggacattgcgtttctgtgcccagacacactgggcaggccctgtaggcttgtgcctgggccctgaccctcttccttggaacagccttgcctcttcaaaagaaattcctttttgagctactttatccatcataagattaacatgacacctccatacgatctatcacagatgctgacgcacttgcttccaagtataaattaggtgttgggcagtgcagaatgcagagctgtggctaagagaccccatctgcagctcacaaggcatggttgatattggctccggtagtaaaaaccacttttctggatggctagtaaattgccaccataggagatgataatatttgggaaccttactaacaagcttgaattctaacataaggcagttcattgttatgctgcagaatgtgaaatcttaatgcttttgctattcaaactcattttacaacatgatttactgcagctcgaaggatgcagcagaagggaaaaaaacagggaggtaggaggaaagagatagttgggagtggaaacatggatgagtccagctttgtgagcaaatttcattgccactgataatgtaatattttgctttgattaatgttctttctttttgagtgtatgctgcgtcccaataactgtttcttcagcccagtcactgattttttttttttttcctggattctgcttccaaaccaggcattgtggtgtgtgcaaacctagggagaaaagaaggaggaaacaatcccttgagaggtatgcttctgtccaaagacatgctgaatatatttgccttgccagattcattttctcctgccagaaattttcaaacagatggtggaggaattggtgtttgaccaaacagttgggcaatcaacaatagaaactaattgtcatagaattctgctaatggtacctatgctgatacttgctgacaaaacgtaagttttttggtactagtatcagggattctcttcaggaaaaataagttaaaagagctaagtagtcaagaccagcctggccaacatggtgaaaccccgtctctactaaaaaaatacaaaaattagccgggtgtggtggcgcatgcctgtaatcccagctactcgggagggtgaggcaggagaatcgcttgaacccggaggaaaagaaaaaaaaagagctaattaggcaaatgtttctaggaaatactgactcacttcaggaggacattattttaaatacagtccagtgtgggtacagatagttcaccctgtaccaggggactggcatgactgttgatagcgtctatgtgaaataaaaactggccttaaacagttattttgtggtcattacactgagatcatttttacctctaaagtcctgggtccctgggataactctgaatgaccaaacaaacaaaaaaaaaccccaaggtgtcaaaataggaatttttcaagttaaataatgtgctgagaactactgtcttccttaacattgattgtcagaattttcgatttagcctgcagtcaagtttagtgggtgtgtccctccacttatattccaagtgcctattttcttgtgagtatgcatttgaattgagctcagggagtcaaaaaaaaaaaaaaaaaaaagaaagaaagaaaggcaaaaacaaaagcaaacaaacttctggtagggttggtggcatttccagaagcttccacaatatggtcatgagatgaatctcggttaactctgaagacaaagaaaaacttcatttgagactattgtttttcagataaataaaaggcaaggttgctgggtgctgcccttatagagttttttatttaaaccttcacttggtttataaaataaagtccatctgtacactgaggtagcaggaagagggcaaaaggagacccgtgtttcttgagaggggtaaatacatagaaaatcacgttttccctgctgcctccttgtgaagaaaaacagctttgaatgtatcagcctgtgcatctggactctcctgaaagattaactagaaagccgcccttcccatttcacttttgtgtctctagatgtgacaaagaaaactcacttatgccttatttgtcacctcagacagttgacagacactttgccaatgtcagattatttcagtatctcactacttgtgcaaactggatcaaggaggcatttcagaaggcagcaaaagagaggcctctaatctttgcctgagtccattctacagctgaatggttcatctacctaacaacctacattgtctgtatgtaactttaccccttacattaagatgtgaacgttcatgcagcactgcactataatttgatttccatagatagttagaaataggtaaaccctttgtaccgactggtaagtattcattatgtgctttatcagagttataatactgtgtaacacaatttaaaacaaaacgaagtatatgcacaatgagaaaagaaatatccaaaacaaatgttactgtttttggtgcaaacattatatacaggttatttttaaaatgcaactttgcttgtaaaaaaagaaaagaatattagcaagtattttattttaataatggggaatcttagaacaattaatagcgtattgcattctaacaggatttttataatgagcagcctttgtactatgtcaccttatagcttccttttgaatagtgggatcaaagctagtgtgttatttgtccctggtgaatgtagtagaaatagaatctgtgatacaaatgttaataactcaacaggcatcccatctgttacaaaatccctttgtttcttgtccacttcttagaactctgccacagacccatcaacttcttgtaagtagcagagcactttgctgtgatgacagtagtttaacagcagtgaagcagagggtatctttttgtgtttattccaccccttccaggcctgaacaaaagcacctggctgtgctagtgaacagagagtgctgcttgcagagagggaggagcccgagggagtttcagtggtccgggagacaatggcatcagggacctctgctgctgcctacagattcacatgcagtattggcaatctcaggtcggctgtcggtttcacagtaagtaatggcatgagggtaaaagagaggaagtggctgagacttgagctggaatcgtagggcttaaataacttaaaaacagccaggatgcacaaaacacttatgattttgcctcaggtttgttatcacatccgttctcaagagactcactagtgagattcagatctttctttgtgggcagctggtagaggtcttatgagccctaattcccccagtaatcttagagggggatgtctggccaacccagtggagaaccttcgagtgaactacaaagaatacagcagaggagggagagctttacttggctgtcagctttgccacctgtttattataaattgctgaccatgtagccaagagcgtgaattttgtcattagccagacctgggttcaaatcctaacttggacactttctcttgggcaagctgcttaacctctctaagtgtcacttttctgattaatatatcaacgtaaatcaccctgggattgttaggattaaactaaaaaattgtgaaaaacagtcagtagactaacacatactaagtgcccaataaatgggtattttattattattatgaatgaaaattatgtatcccctgtatcaactggggtaagcagtattactctaattcaatatcttgctctaggaaacaggaaatttttttgagagtagcgtaaagggcaacatgctgacctgtctttactgagagtttgaaacctctaagtggaacacaaagtgaaatagtttgcagggattccataacgctggtcaagtgagtgttttcaaaacacctgggaagctgtctttttttttttttttttttttttttgagacagagtcttgctctgttgcccatgctggagtgccatggtgcgatctctgctcactgcaacctctgcctcccgggttcaagcaattctcctgcctcagcgtcccaagtagctggggttacaggtgccctccaccacgcccatctaactttttttttttttttgtatttttagtaaagatggggtttcaccatgttggccaggctggtctggaactcctgaccgcaggcgatccacccacctcggcttcccaaagtgctgggcttaccaggcgtgagccactgcgcctggccggaagctttctaaaaataaatattcctgggacctgcctccagatgatctaacacaaaattagacaaagaatgtccatttgtaagaagtttcactaagtgcttctaacaaaactagactggaaccactggttgagggtatttgtcccaggatttccaaatatgtagcatgaaggacaataggccacggtaagaaacttgatgcgaacctggaagtgggcagtagtaaagatggcagacagtgggtgggaggctggcaagatactggaaaggagagggatagaaagcagatagttaagtggtgatctgcaagttaagcaagaaggcagtcagctagcctatgaaaggtgtcagggattctggagagttggcagagcatggtcagccagacccatcagagggctacctgtaaactgaggctcagagataaattgtgcacatacttccgccagaaactaaaggcccttataggatgacatttttggatcctcccattcagccagcctagccttaaagggctactcctcctttattaatgctggtcctatataggtcctgacacagagagaaaaaacaccactgcagaagatgaatcatgagggaaatcaatagatttactttttttttttttttcggtttaggagaaagaattattaagccccctttacttacacctaagacaattgactttccccacattcccattccaatagatagaaattgccctatgaaactcagactcctcaggatatccacactgtgaattgcccttgacaattctgcagagccaagtgctaggttcaatagtatctattcaatatttagaaggtattcactgaatggatcttatatattgaggtggtgcttatttctttgtacactagaggctatttgtgggatacttacattttctgcacagtgcatagtcaataactcatgctgattgactgaggctaagactatataggtccatctgattaaccatttacagaattgatcagtgcttattatcttatatacacaacctgagcaagagtctttttgctcaaggcctaacttggctacttagtatctgactttcaccatgtcatagctctctaatcctagcttgaacagctgaactaccaggaaaatccattttatttcacatatgagtgttaacatttgaaggtacctgtgttatgaggctcaaagtttccattacagtgggttgcatcaaaattgtttcatgcactaagggaccccacagcttccagttctctccatcttcatcaccatcaccctagggtaagccatgatctctcacctcaactacaatagccacccaactggtcacttcacatgcatttatgccccctccccaaatctgatattcacattccaggcaaagtcatcttttctaaatgcagatctgattatgtcaacctactttccctccttccagatgctgtgctaaaagctttaaaaggttccaatagtattcaaggacaaaacttcttactatgactttcagtgctcagcagggtctgtcctctgcctacctgcgtcccaaatgccatcatgaactgtgattttcctcactctctgagcatcagccacatgtaaggttttagttcctgctaactgtggccataacttagggtgcagatacagattcatgctcattcccagcacagggcatttgcacatgctattctttgtgtctttcatttttatcagttacattttgttgatatatggttattcttatgataatatagatgacatctgtgctccccactagaatacaagcttcacaaaattagacactgtgtttgtacctctagggcctagcacagtgcctggtacataatagacagtcaacaatacttgttaaataaataaattaagactgtacacaatcaccacacattttcttgttaaccttcttcctccaacttcctgcaacttcaatacataactaagcaccagtattctcaagcaggttagactacacccttgtatggcatatcctctgtgggcatcattccatgttccagagctccctgctcccgaatgagaatatacctactcagtgtcctatttccttaatactttagtcttgaagcgttagaataacttatcaagagtaacacttaacttgcaatcctaaacaaaaagaacaaagctggaggcatcacattacctgatttcaaattatactacaaggctacaataaccaaaacagcatggtactggtataaaagtagacatgtataataatgaaacagaatagagaatgcagaaataaagccacatacctacaaccaactgatctttgacaaagtcaacaaaaacaagcaatagggaacagactccctactgaaaaaatgatgctgggaaaactggcttaaccatatgcagaagaatgaaactggacctctacctttcaccatatacaaaaattaagtcaagatggactaaagacttaaatgtaagatctcagactataaaaatcccagaagaaaacctaggaaatactcttctggacatcacctaggcaaataattaatgactaaaacctcaaaagcacaggtaagaaaatcagaaatagacaattgtcactctgtgctgttgattatctgcttataagggccagggcaatatctcaatcactgctatatccccagcacctaataaagagtagtttcttaattaaggcatgttgaatgagtgattgaaggaagagtccttgcaagtagctctggtctaacaatggaaccttctttcccaaaagacaatctcctttaccttctagctttattgaggtataattgatgactaaaaattgtatatatctaaggtgtacaacatgataatttgatatatgtatgcattgtgaaatgattgccacaatcaacttagtttacatatccatctcttcacatagttaccacctttgtgtgtgtgtgtgtgtgtgtctgatgagaacacttaaggtctactcttagcaaatatcaggtacactgtacagtattactaactatagtcaccatactatcctttgggtctccagaacttatttatctcataatttaaagtttgtaccctttgaccaacttctccctgtatctccaccccgatcccttctgctctctgtttctgagtttgactttttcagattccacatataagtgaagtaatgtcgtatttgtttttctgtgtctagcttatttctttagcataatgtttttcaggttaattcatgctgttacatatggcaggacttccttcctttacgaggctcaataatatttcattttctttatcaattcctctgttgatagacacttagcttgattccatatcttggctatggtgaacaatgctgcgatgaacacaggagttcagacatctctttgagatactgattttatatcctttggatgtatacccagaagtgagattgctggatcatatggtagttctatttttaattgttttaatgaacctccatactattttccataatggtagtgccagtctacattcccatgaacactgtacaagggttccaatttcttcacattctttccagcccatgtaatctttttactttttgataatagccattttaacaggtgtcagatgatatcttattatggttttgatttgcatttctgatgattagtgatgtccagaatgttttaatatacctgttggcaatttatatgtcttctttgaaaaaaaagtctattcatgtcccttgccaatttttattttatttatatatttatttatttatttatttatttatttatttattttttgagatggagtctcactctgtcgcccagtctggagtgcagtggcacgatcacggctcaccacaacctctgcctgcctggttcaagcaattctcctgcctcagcctcccgagtagccaggactacaggtgcgcaccaccatgcccagctaattttttgtatttttagtagagacagggtttcactatgctggccaggctggtctcaaactcctgaccttgtgatccacccaccttggcctcccaaagtgctgggattacaggcatgagccactgtgcccggccgtcccttgccaatttttaaatagggttatttggatttttgctgttgttgtatgagttccttatatattgtggatattgactccttatcagatacatggtttgcaaatattttctcccattctgtgggttgtgttttttgttcatctattgcttcctttgctatgtggaaacatttctgtttggtatagtcccacttgttaatttttgcttttgtttcctaagcttttggtgtcatgtttaaaacattattgccaacaccaatgtcatggaagttttcccctatgttttcttctaggagttttacagcttcaggttttacatttaagtctttaatccactgttttatatatatatatatatatatatatatatatatatattttttttttttttttttctgtgtaattctgtcttcattgaatgaatgttcccttctcttctattttttggaagaggttgagaagtattgatgctaattcttctttaaaagtttgatagaattcaccagtgatgtcaccttgttgtgaaattttctttcatggaatttattattaacattattactggttcaatctcttaagttggtgtaggcttattcagaatttctatttctttctgagtaatttttactcttttatgtgtttctagaaatttgtctatttcatctaggttatctattttgttgacatactattgtttatagtttatgcctaaaacctcaaaagcacagataacagaaacaaaaaatagacaattgttactctctgttgttgattatctgcctcttataactctttgtagttttgtaagatctgtagtaatacccccacgtttctttctaattttagtaatttgagtcttctctttttttctcggttagtctaggtgtaggtttgtcaatcatgtctttgacagaacacacttttgatattcttgattctctctactgtttctcttttcactatttaatttatctccactctaagcttcaatattttcttctttctatttgcttttggtttagtttgctcttctatctccactttcttaaggtgaaagtttaggctactgattgagatatttcttcttttttcagtgtagatgtttatagctataaatttccctctgaaaactgcctttgcttcatcctgtaagtttggggtttttttttggtgttgttgttattgttgttgttgttgtttagatagggaggttctcactctgttgctcaggctggagtacattggtgcaattatagctcactgcaacctcaaattcctgggctcaagcaatcctccccctcagcctcccaagtagcttggactataggcgtaagccaccatgctcaactaattttttaattttttgttaaaaatgaggtcttgctatgttgtccaggctgggtttgaactcctaggctccagtgatcctcctgcctcagcctcccgaagtgctgggagtataggcatggcctaccatgcccagctgtatgttgtgttttgtagtcatttatctcaaagtattttctaatttctcttttaatctctttgactcattaaagtgcgttgtttaatttccacatatttgtgaattttctaaattttatttgctttttatttttaatatcattccattgtgtttggagaacatactttctatctcaatcctaaaaatttattgatatttatattatggccaatcatatagtgtagcctggagaatgttccatgtgcacttgaaaataatgtgtattttgctgctgctaggtaaaaagtgtcctatagccgtctattaggtctagtcagtttatacagtgttaagtcttctatttccttcatgctcatatgtctagttgttctacccattattgaaaatgggacattaaagtctccaactattattgtaaaactgtctatttctcttctcaattctgtcatttttgcttcgtgtgttttagggcactcttattagttgcatatatatttataaattgctatgtcttctatatagattgacccttttagcattatatactgtctttctttgtttctagtaacattttaaacatttttcttttcttttttttttgttgttgttgttttgagatgaagtctcgctcttgtcccccaggctggagtgcaatggtgtgatctctactcactgcaagctccacctcccaggttcaagccattctcctgccttagcctcccgagtagctgggattataggcgcctgccaccacacccggctaatttttgtatttttggtagagacggggtttcaccatgttggccaggctggtcttgaactcctgacctcaggtaatccacccgcctcagcctcctaaaatgctgggattacaggcgtgagccactgcgccaggcctctttgttttatagagatagggtctcactatgttgtctcaaactcctgggctcaagcaatcctcccacctcagcctcccaaagtaccaggattataggcatgagccaccatgcctggcctatgtttctagtaacattttttgtcttaaagtttgtctgatattattgtagccacttaagctctttcttggttattgttgtatggggtatcttttttcatcattttgctttcaacctatttgtatctttgtatctgaactgtctcttgtagacagagacatatagttatattatgttcttttaaaatctgccaaattctgctttttaattggatactttaatccatctacttttaaagtaattactgataatgaagatttacttctataattttgtcatttgttttctatgtcgtattttttctgccttaatttcttcattactgccttcttttatgttgagtcgatattttagtgtacccactttaattcccttgtcattttttttcactgtatggtttgagttgttttcttagtggttttcctgggaattacaattagtatcttaactataaaaatctagtttcaatttttgtcaacaatttcaataatatacaaaaactttgctcctatatagttttatcttcctctttatgttgttattgtcacaaattacatctttatacattgagtccatcaatatagatttataattatcattttacacaactgtcttttaaattagacaggaaaaataccattaacactgacttttatattaatctgtgtagttacctttaccagtgttctttatttctttgtgtggattcaagttactctctagtgtccttttatttcacactgaaggactccctttggtatttcttctagggcacatctactagtgacaaattttgtcatttttttttggttttatctgggaatgtgttaatttctccttcaattttcaaaagtagttttgctggatgagcatagttggttgacaattgttatttctttcagcacttcaaaatagcatcccactgtttctggcctccatagtttcagatgagaatttaactattaagcatattcaggatcccctgtacatgatcagttgctttactcttgctgctttcaagatttttctcttagtctttggcttttgacaatttcataatgtgtcttggtgtggatctctttgagtttattgtacttggactccatttaggtttttggctcagtagattaaactttttaaaaatcaaaaattaattcaagatggattaaagacttaaacgttagacctaaaaccataaaaaccctagaagaaaacctaggcataaccattcaggacataggcatgggcaaggacttcatgtctaaaataccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacacatttacaagaaaaaaaacaaacaaccccatcaaaaagtgggcaatggatatgaacagacacttctcaaaagaagatatttatgaagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaaccagttcaacccttgtggaagtcagtgtggcgattcctcagggatctagaagtagaaataccatttgacccagccatcccattactgggtatatacccaaaggactataaatcatgctgctataaacacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcatagatgggaattgaacaatgagaacacatggacacaggaaggggaacatcacactctggtctggggactgttgtggggtggggggaggggggagggatagcattaggagatatacctaatgctaaatgatgagttaatgggtgcagcacagcagcaaggcacatgtatacatatgtaactaacctgcacattgtgcccatgtaccctaaaacttaaagtataataataataaaaagaaatcattaccattattcatgaaattaaaaaaaaatcaaatttgggaagtttatggccattatttcttcaaatattctttctgttcctttctttctctctttctgggactctcattatgcatatttggtatcatgggcagtgtcccacaaatctcttaggctctttccatttgatttttcctcattttttttttcttttggttcctcagactggaaaatctcaattgatctatcttcaagtttactatatggttttgagttgttttcttagtagatcttagaattcttagtagatttcttagaatcttcaagtagattctttcatgtgccaggttaaatctgctagtgagtgcctctacttgaatttttcattttatttattatactttttaactccagaatctctgttttttctttgtaatctatgtctcttgactgatagtctttatacagttctcatggttttcttaagatttctggacaaagtttcttttagctctattagcatatttaaaatagctgacttaaagtttttgtctagtaagaacaatgtttcaccttcctcagggacagtttccattaattgccttccccctcccccatgtattggccatattttcttgtttctttgtatgcttcataatatttttgttgaaaactggacattttgaaaattatgtggcaactatggaaattagattctgctccttcccaggaaatgttgttactgcttattgtgatagttgtttgttagggactttcctggatcaattttgtaaagtctgtattttttgttgtgtatggccagtgaagtctgtgtagtgatatcccctcttgtatccttgatattggtaatttgtgttttattttctgttgatcaatattgctagggctttattaattgtgttaatctttacagagaaccaaattttgtagtattgtttctgttgtagcccactgatttcccttcttagctttattggttttttccttctacttattttgaatttatttggcccctctttttctagtttttttaaagtggaagtttagattatggattttaaacttctctttctaatataagtctttgaagccttaaagttccctttaagtattttcttagcttcatcctgcaaaggtttacatgatggtatattcattataacacagtttgaagtattttctaacttcctttttttgatatatcacctaaatgccctagacttgagtatgtttttaaacttccaaatatttgagcatttttttctattttttagaattatattttatgcaacctattacatattcttttttttacagctgtattgaagtacaattgacaattaaaaattgaatatatttactatatacaatgtgatgttttgggatatgtgcacactgtgaaatgatgactacaagccatggaattaacctattcatcaccttgcataatttctttcatttatttgtggtgaaaacatttaagatacactttcttaacaaatgtcaagtatacaacacagtattgttaactatagtcaccatgctgtattcatctcaataacttattgatcttataactgaaagtttgtaccctttgaccaagatctacccattttcccctcctatagcccctggtaaccatcattctgattctacttttttttttctcatgagttcaacctttttcgattttgcatacaaatgagatcatgcaatatttgtcttcgtcttatttcatttagcataatgacctcaacttttttttttctggttggtcattttattttacttattttttattatactttaagttctagggtacatgtgcacaatgtgcaggtttgttgcatatgtatacacatgccatgttggtgtgctgcacccattaacttgtcatttacattaggtatatctcctaatgctatccctcccctctgcccccaccccatgacaggccctggtgtgtgatgttccccactctgtgtccaagtgttctcattattcaattcccacctatgagtgagaacatgcagtgtttcgttttctgtccttgtgatagtttgctcaggatgatggtttccagcctcatccatgtccctacaacggacaagaactcatccttttttatggctgcatagtattccatggtgtatatgtgccacattttcttaatccaggctatcattgatggacatttgggttggttccaagtctttgctattgtgaatagtgccacagtaaacatacgtgtgcatgtgaatgacctcaagtttttaaatttgattccattgtggttaaataatacagttaaaatttttgaaatttattgacattctatggtccagtacacagcctatcttgatgaacatattatacatgcatttgagaatgatacgtattccttatgtattgttctaaaattatcaattaagtcaacttggttgataatatttttaaaatattctatgcccttacaaattttttctctagtgtttttatcagttatgccgtagcaatattaaaatatccaactataactgtgcatttgtctatttcttctattaatttcatcagtttttgctgaaatagtcttattagctaaacaaacagatatgattgttatagcttcctgatatattaatcatttaataatatgaagtgttcctcttaatttcaggcaatactccctgtcttgaagtttattttgtctaataatgaaatagacacacaagcttgcttatgcttattgtttgcagcatataactttttctatacttttattttcaacctgtttgttgttgtatcaaaacacattgcttgttgtagcatagagtaagatcatttttaaagcctgtctataaatccctgtcttttaattagagagattagtctaactccatgtaaaataattattgacatgtttggatttaagtctgccactttgcttttcaatttatattctattggttccatttgatattttgttcttctgctcctcttttcttgtcttcttttggtttagttaattattgttattattatgttttagagacatagaatacattcactctgttgcccaggctggaatgcagtggtgcaattatagctcactgcagccttggactcctgggttcaagtgatcctcctgactcaacctcctgaatagctgggagtagttgtgcaccaccatgcctggataatttttctcttttttttgtaaagactgggtcttgctatgttgcccaggctggtcttgaactccaggcttcatgtgatcctcctgcctcggcttcccaaagtgttgggattatgagtggggcaccatacccagcctaattaatttttttttttttttgagatggagttttgctcttgctgcccaggctgaagtgcaatgctgtgatcttggctcactgcaacctctgcctcccaggttcaagtgattctcctgcctcagcctcctgtgtagctgggattacaggcgcctgccaccacgcccagctaattttttgtgtttttagtagagatgaggtttcaccatgttggccaggctggtctcaaactcctgacctcaggtgatccactagcctcggcctcccaaagtgctgggattacaggcgcgagccaccgtgcccagcccagcctaattaattttttaaagtatttcatttaaatttctctaatgacttttaaatttgtcttctttgtattatttgctagtgtttgctctagggattttgatatgcattcttaagattttacagtttacttagagagttaatattgtaaaacaaggatatctacctttattttttaaaaatttgattatgaggtgcctgtttttgtcattgctgttgtttgttttatgtatttacagtggagtttgtgtaattcttagaactgtacattgatgcatttcaccaaatttgagaatttttctgccattatatcttcaaatgcttttgtgcttcattgtctctcgcctctccttctaggaatccaaatgcatgtatgtcagatgcgcagtcttatttgcatgaggtatagattggggtaggcaaattattgcctgcaggccaaatctggcttgtttttgtagggccctcaagctaagaatggtttttacatttttaaaagatcataaaacacaacaaaaaggaaaacaaaaaagaatgtacagtagagaatttatgtggcctccaaaacgtaaaatatttattatctgaccctttacacaaaaactttgctgtctcctctgttagagaatggtgtttggggctgctatagtgactgcaatttggagggggaaatcctagaaaagagggagccatagatggagggagcttgcaaatctgcttgcaaactcccctctacccccgtgatgctcagactaggtattggtgtcagggaaaaaggtgtataaatgtgatcctcaaccagcatgatttccttctttcaaggatcaaggcactttctattttctgatagtatttgttatctctccagttctttcaagtagcagttatgtttatatttttcccagagtttataattgttatctgtgggagttttgagatacaagccactgttctattccagaacttgccagactcatttttaattaaatagactataaattagtttaaagggagtgataaaatggggaaatcaattaatgctttatactcagtttattcacccaggtgttttagtatagagtttggggctacattttgtcacctcatgcaaggaaacatcttttaatttgcacctgtatctatggaagaaaactgccaaaatcattaggataaggctatgccccaaatattcatattttaaaactctgcctcaaaattacagaatcagaaagctggtatagacctcggaggatacactcaatatagaaatcctctttacagcatctctgatgggtgggctttcagactctgattaaattctaggaattaaaagcgtcacagtttttatattttctataatatatcaatgccttttgattcaaaatgtttcttccacatcataaggtggctgatgtaattagactcaagatttaggaactgctgagctatggatcaaagccagttttcttccatctctactgaaatgggtttagtttttgcccttggactatggaggcagctctggctcagaagtgaacatcccctttttaaaagaaatgtgaatggtacccaggaattcatggccatgtttgagggctgttctaagttctgagctaaatccctccaggcaatcactgcactgaggaagcagctcacactggatgcccagagaaggcaacagatgcactatttttctgacgtactgttctccagtttaatattgggctggagtacctgtgacatgtgggaaaccatagatatccacttacaaaaacattctccagtaaacatattcatttatgtgtggcaaatgcagttttcaaagatatttgcaagatggctgtgatcttccttttcagtcaactgaattttaagattcaaattaaaataaatattttcagcatgaattagccccttcaatggaaatcttttaaccacttgacaagatgcggagctatgtactttagttatcctgtatttctgtctacctactggtatccatgtactttaatgggtaaactggccatcaagtaataatttgtggccctcatttcatgtgcaggctcatgctgttgctctagtattataattttacagataaataaagaccatatcttaatatttgttctctaatttcattgcaagttacagggaagtcgttagtcatatgaagatttacaacttgaaaatatagtttccagctaaggcaatttatcacccacaagaattctggggaagaatactattttcatctgtgttaattactgtgctatcttactttcatttccatttatgtgcttaaaagatttgcttgcccacaatctcattctattttctgtatctacaaataagatatctcagggatgttcaggccctatattcctcaagtgagaaattcaaagataaaagagagtttttggttaaaaataaaatacttaatccacattttggggctgagagagacagaaatcaatcatagatcttagatttagaataccctaaatctaccacatctaggttataagccagagaaacttaaacttcataagattctcttctttccaaaaagtgagagggagagatgggggaggggagtgtggagaagagcgagagagggagagacagacagagagagagagaggtttttgtgtcttgctaaatagcatatttaagacataaatgctaaaaccatagaagtctcttgaaaattctttttctaaaatagaatgtgggaagaaatcatgtttctttgaacctttgccaataaaagggtgtgtgtgtgtttgtgtgtgtgtgtatgtgtttctgtgtgtctgtgtgtgttgtgtgtgtgcacacaagcataggtcagggccagaccaactggacatttgtcccatttctctcatcagtgttgtctgtaaaactcatacagtgttctacaaatgaaagaaaaaaaattaatgctcctattattacgacattcaaaccactcctcctagtgctacattaacaagtctttgcacgtcaaggagtagggccggtggtggtggtggtggggaaaaatcaggttcctgatccctatggccactaccaatagaaataagattatttttagcaattatcaaaatacagtaacagcatcttttaaaatttgttctcaatgctcaatttcacagtgacttggcttcactgttcgaactttataagatttattcccaccatttgctttgtatatgaagttcaggaagcagcagtagagacagttttttttgaggttcagtgggactggttcccccggctgtgatattattgcagatgctctgctagtcacacacactgacatctcctccagcacacgtccacactccaggaagcgaaaagggaagctttgtgtcttaaggatggtgtagttttctgtcaagcttctctaactttatagaaatagctgcttcttaagcagcccctgtaagatctgaggcctagagatcaacctaggggctagttattggttgcatacatactgattcaaagttgtgctaattctcaaaggaatctttatagagaattgccaagaactgtcaaaactccattaaatatgttattaatgctaactaaactctctatgcttacaggagatgccccaaagacattagtcacccagtaagtcactggttattgaacattagccaaatggcctagtctataatcattatgttgggcataagctgagtgctttagtctccttaaggaaatatttctcttcttccccaaccacgggcagacccagatcatacttgcattgcaaggagtaagagggactagacatctatttactccttagttgaaaagaccaaggggcttctttgcttgaagtccaaaatatttagctgtgatgaaaccttacttaataaaatgaatgttgatttatgccattttcatgatagcctccagctgacatgtaccattcatagattggcatttaaaatagatgaagatggacaataagtagactttaatattatttcttcaagggcgtggataaaactaaatattttggaggcctttatgcacacacaattgagtggttcttacagcattattaacatatgaagctcttagtgccggttttctctcccaaatgtgtgctgcatttcaccacaggcactgaaaaatctgttacgttttataggccgggcagacattggaactgcagtaatacatttttttctatttaggttgcatttgtgtgtcactcatctataataagaatctacccattagtatctgttttcattgccagtagatttctttctttgtctgctccccaaggtggttaataaaatgatttttacagtgaaacaatgctagatttaaaaaagtgtaacttagtgatcggatatgaaaagaaaattcactctctacccccattttaaagaggatttagttaatacttttaagacatctgagtaatttaatttatataacgttcactcagatagcccatgtctcagaaatcatcccaagaaaataataatggttgtgcacagtatgcatccacaaagtgctcatctcactgctgttttcaatatcacagtactgaaaacaacctaaatgcctcacaataagacattgtgtcaaaaaaaataagggtgcaaacgtaccacagaatactattatgaaaacagtacaaaagaaaccagagaaatacattttctgaccaggaaagaagcttaaaattggtacactcatatgttttcaacatgagtgtgtatgtgtgtttgtgtgtgtgtgcgcacacacacacatttacccgtgtaacacacaacttatataaattcactattggcttcctctgagtggaaggattttgagtgatgagtgatttctgttttccttctcccacccacctcctcaaacaacaactatttacttagctaaaaaatatgtaggtcaacaatttcggctgtgttcagctgggtgttgctgcagatctgtgtcaggcttgggatttttgctatgactcttgcctgtatctatgattagctgctggttgactggtggctggttagctgtttgcagagatgtggtcttgcatcttccagtagactgccttgggctcattcacaccatggtgatgttccaggcccagcacgccagtaagcctcaacgcacaaatgctttccaatctgccttttcttctattaaaaaaaaattttaattttggtttaaaaaataaaacgtaaaataaattttaccaccctattcattttaagtgtccagttcagtagtatcaactgtattgacattgctgtgtaacaaatctctagaactatgtcatcttgcagaactgaaactctatacccattgaacaacatctccctttttccctcccccaaatccctgacaaccatcactctactatctgtttctatgaattcaactaatctagatacctcatataagtggaatcataaagtaattgtctttttgttattggcttgtttcacttagtgtaatgtcttcaaagttattccatgtggcatatgatagaatttccttcattttaaaggctgaataatattccattgcatgtatatatcacatttttttaatctattcatccatttatggacatttgggttgctttcatctcttgactattgtgaataaagatgtaatgaacatgggtgtgcaaatatctttgagatcctgctttcaatgcttttggatatatacccagaggtaggattgctttattacatggtatttttattattaaatttttgaggaacctctatactgttttctatagtggctgcaccattttacactcccaccaacaatgcacaagggttccaatttatccatattcttgtcaacacttgttattttctgttttttggatgagaaattagtggcccattagtggctatcctactgggtgtgaggtgatatctcattgcagttttgattttcatttctaagtattagtgatgctgagcatcttttcatatgcttttggccatttgtatatcttctgtggagaagtgtctattcaagttatttggctctgtgtgtgtgtgtgtgtgtgtgtgtgtgtgtgtgtatgtttgttatatataattttctgtaatgagcacttatttttgtattgaagaaattattagaaacaataataataaaaaaatcaatgtatcaagcaagttgttgcagtaggtaaatgggccaatcttgagtggttagttgggataacttaggggtggggccactgtctttacttagaattaaacaattcaagaacacttaaggcaacacatacaaaggcaatttcattctaaaccaagtcccctctaccttttgcggatcaattagctcaagtgacataaaacagggcaggcaggggattaagtaaatgaagatgagctggcaatgcagccatgaagcagcaacagtccgtgccctaaatccatgtgaaatacctggtgatcttgtatacaaagtcttggtctggatactgcaaatgattgttctcttggggattttgatatttaggagaaaactttattatgtagtcaagggttatagcttttatctgaccaattcagaagaggtaactagctaaatcaccaataattttgtaatctgggtttcaagaaatgctctgcaagcattttagggtgcaactttgtataaaataaagataagcaaagaaaagctcataacaagctttgaactttaaaaattctatcaaaactttaaagctccagacttaaatggtgaatgaagtgaatttcccaaaggtctggactggtgactactagcaaacctgctgaatgaaataattaccttgaaagaaaataatgagggataatggcattcaaacctgttaactgggaatgtaagctctgtgattttcttggtggacaggctaatacgataacagagtgatctgagcaggtgtgaacacattcattctgcagaagcaaatacaaactgaacatgcaaggtaattatggagaagagatactggattcaatgagcaaaccatatgtaaaaatagctctattcctgcctttgaattctttctttattggagtcctagacagcatgcatgtcaaagtcccgtacttggtcttattacaccacaaatctcttccagtaatgtcctgcccctcaccctcagtatcatctcattttctgtacctctttctttctttgtgttaaggttccatttctctcttccttcacattctaatacctaactgaaactgcatattggaccacattacgttctctcactgtccacctcctctgcatttcactatttctttctcttttattcaacctgataagcagcactttatgacagcttattatcttacagctgttaatgttctatatcattttcaatcattccccatagttttgactacatcgtgtctcagctcctgtgttttggttcagcaacagtggtttggtattatagtgtccatctacctacaacattaatattacccaccttctcttcctcctgacttatttcctctaggacaagtccatctaattatccagtcttctctcttgctttctgtgccacaatgctctctacttcctaagatcagtgtcctatttcctttcttgacagattagcttgttttttttctagccacagagccttacactacatttattatatggttcatcctcgtcttcactcagcctcccacctctagtcgctggttatggatcacagtattctattagcttctgatcattttttaaccttcttcttcccctcctctagcatatataaggtgatacacccctgaaagatattttctttctattattccaaagtaagaatgaacaaacatgaaataatttatcattctataaccgtcctccaccccctcccttccaaattcaggtctcctttttctctggtgagttcaaactgtcatatgtttatttagcacattttcacattcaaagcatttaaggagctaattaatccttagagtacccttctgcaatgcacctaggctatagaggcagttgacattaaggtgggagcaaagctcaagaatttctgttttccaaatcactgttcagactacattttctttcactctgtctctctgtgattgaaataagtaccatcatgaataaattatgttgattaatttataaggaagctgctagaaaatgggtgactttcctggtactcccaatttttctatcagatccatgttagtcttctatgagcagctttgaggcagctgggaatcaaaccacagaacaagatgaaaacataccatgtttttctttctttttcatccagaaagacagaattattcacctatatctgtaattacttcaagtcatttccaagaatacagcaagaagatcatgtatgtggatgtgcgtacaagtgttgacaaaacgtggatgatgaggggaagaggactacgttgtagtatagttttatgttggtctggtagatcacattattacagacacaatgagtgagaggaaagagctcccttatccccttaccaggatctctttgcttttttcataaaagaaaaagaaaatacactctttcagccctatggcttatatgctatatgaggccatttgggatttatagtttggctattaaggagggaaacgagttattgagtgccaaatcactgttttatctggctgttattattatgttaccaagcagtaaggaagggcttttgtataatgagaaaaaattactagcaattaaatgatgttctttgttctttttttcagttcaaatgcaataggtaattgtttaactgttacatccaaattgtggaggccattggtgatcattaataaataaactgtatgtgcaattgcatactgaagaagccagctcagtcaacacttttttgatcagataaaaaatacagcaaacaatcttaaacatattgggctcaattactattgccttgccctgctgtagacattgctcttcaaccccttgggtagaatacagtcatagttgaaagaaaagtcagattaactgaaacttttcctgttcatgaacattattcatagaagaatagaccatttccttttgagaggtgaagggcttttgtggtgcttattgaaagatgcagggagtttgccatagctatattggtgcaattttttttcaactaataggtcaaatagtcatcttagtcagttatacttcacatgggttatctcatttgatattcatttatctccatttgcagatgaggtaactaagcttgggggattaagtgacttggaaaaatttatatatctaggaaatggtggagctgggaagtaacttcagaaagatcgctcctgactattatattgtatcacctcatcccaggctcaggcatgggagaaggcccagagttgtgttttaaaactgtaattgctaataaaactttctttgaagaatgcaattgaatggttttccttttatgacatataaaaatgtccccaagtaaaacaaacacacaaaacaaacaaaaaatataaagtaccaccctttaaaattgccataaattctcatctattcatctctttcccaaggctcaaatcttcacatctacctggcaatgatgattagaaaacacatgcactgtaaaaaatgctattccattaaaatattacctggttaacagaatgctatttgtaaagtcaacaagatagtaacaattcatttgtgatttgctatccacctagatggagtgagcatgttcttcagacctgagctatagaaatctcactttctctaataataacaatgcaaaaaccaaaccaaatcaatgtattgcaattataatatgaaggtagccatgacagctttcactgaatttcacgcttcagattcatggcaattcaacatcactaaaaccaagcaagaatttctgttcattaaaagccataaagaaaataaatgacaaactataatttggaaaaagatatttgcaacacatatgacgaacagaggattagtatccaggctttacatgtatacacagacacacacatacacacacacacacacacacacacacatatttttatgtatcctttaaatcaataagaaaaagagataaactcatagtaaaatgagcaaaacacatacagttggagacatggacaagaatgtttatagaattgctgttcctaaacttctttttgttataaattacccagcctcagtattcctttacggcaacacaagatggacgaagacagtacccaaatatcagccctgaactggtacaaaccaaagttgtattaatagtggaatggattgatagattgtgttatatcctcaatactacatagcagtgaaagttagcaaagtacatcttcacaccaccagtcagatgattctcaagacgttgcatgaaaaaagcaagtggaaaaataacatgttcttgttttttaaaaactatgctccaaatcatacaaaactaaacaaaatgttatatggagctataaatttatgtgacaaaactatgaagaaatgcaagagaatgctaaacacatgattcaaaatagtgattacctctcaggaggatagacaggcataggatcaaagaagggtactcaggagacattgaagttgacagtcatttgttatatttaaaattagttggtagtagagacacatgttcattgtatcattattctttataaatgtattaacatttcatgaatattattttgtacctcaatattgagtatatatattttatttatttatttatttattttcgagacagagtcttgcactgttgtctgggctggagtgcaatggcgcgatcttggctcactgcaacctccgcctcccaggttcaagtgattctcctgcctcagcctcctgagtagctaggattataggcacctgccaccacgcccggctaactttttgtattttttagtagagacagggtttcactatgttggccaggctggtctcgaactcctgacctcgtgatccacctgcctcagcctcccaaagtgttgggattacgggcgtgagccaccacgcccggctgagtatatatattttaaagatgtgatgtaacattggttaagatagagagatctaacccaaactctgtgggccaacatattttgaaaaggaatttgtgatgctgatctattccttcatgtcagagtgcttccttatcctacaatgcaaccatctagccataatattcaaagatggggaatacatcacccctcttgactggatcttctatccaagggaaaaaccagagccttagacaagcatatgtagagagctaagtgtgtattgtgaaaagtgggacaaatattaaattgggtttattcagacctatggagtgtccattgtaggcctcttaattgcatttccagactgaattcacagcatgtattccttcacctattccaccccaactttttttctcaacttcaggcccacactgtttcatcaacgtattcttttatttacaatttgttttcaacagattgagggggaatggacacgaaaccaacaagcaggcaccaatctcaacagttaatgaggcagggaggcataacaaatcccaaaaattatttctgaattgcaaatttgccatgaaagctgaaaaaatgactggcttcctctgatagacttgcattgccataaatgataaatgaagcacagatttcattattcattttttaaagtgaaattagcttacactactacataacatttatttaaccccttttaaaatgcattcatttaatagccccagaaatcatcaataaagaggaaggttactactacctagcctatcttggagcaatttaaactcctgtaggcaaacttcctcattatcacacagccataacgtgaccttggggggataggtgaggatgtcactctgtatttctgtacttggacttcaccatttacctaagacaaatttttagattttttgtccaaaatgtttcttacctcaacatgatataagttgtcaggcaaatatgaatttatctacatatctcattgtggggccataagcattccaaaagcatgtggtcccacagaaaagaggaatgaaaaaaaatggtatttttaatactctgattagtaataaatacatcctaagaaaaagtcccagatacggggtctctagatatgaaggagttaggggtagcaatgagagggaggatgagaaagcagaatgaaatgaggagctctcagcaaggcaaagcctggtggcagcaggtgccctgcagtgtactctaaattagtggttagcagctttcctttttccagttgcaacatacaagaaggaggatgttgaagtctaatctcacatctttgaatatgcccagagttatatgaaatactccatttcctgtgtgtaactctgcccctttctctaccacccaagaaagcattaatggaacgtgagtaagtcaaagtgatgcccttaggatagctttgatttcatgctccctttcaaaaaattaaatgataactgctatagttgggatgtttgtcccctctaaatctcatgtggaaatgatctctgatgttggaggtgggacgtaatcggtggtgtttgggtcatgggggacccgcccccatgaatagcttggtgccctcccggaagggtgagtgagttcttgctctattagttcccatgagagctggttgctaaaaagagcctggaacctccctcttctctcttccttgccttctcccttgccatgtgatccctgcatatgccagatctccttcgccttctgccatgagtggaaacagccctgaggccctcaccagatacacatgctggtgccatgcttcttgtacagcctgcagaactgtgagccaaataaacctctttttgttataaattacccagcctcaggcattcctttatggcaacacaaggtggatgaagacaatacccaaatatcagtacttaaagtattattttcatcaaattccttgtgacatccctaacaacttatagatatacataccagttagtgccgcttctagttgcactctgtcatctggcaaattctacaccttaatttttatggctagagtctgaataagaagtgatctcattcttttaatttctcatatacccctgggtctggtgctgtaggtaatgcaatgataaatacttctaaagagagattggcaaatggtttatacagtgttcttagaataagatgctgaggaggaagaaatactgctttttgaaaggtttgcccttccataagagacaacaaagaatgtgctttgttgactgactctagacagatttttacccattttgttattttgttctattccactgttgctgtatgtttttctaacttttttgtttggcaattgtgatctatgagtatgtctttaaaatcattgaaatactatttgagcctgggaatttcttacgtgtatacaatatgttgtggcatatggagagtctaggtggcaggcaatttggatagtggccacactcactaatcagaagacagacttcacatgtgcttactttggaaggtactattgatcccacagtgacctttccagttacactcacacacagttcataacgggttttcaagtagtgtcaatgcataaaaaggttaactgagatttaaatactgtgtaatggttaaaggccaatgactggggaacctcattggctaagcttgttacacctcacaaccaatgggactgtgtgtcattttaaaagttgttgagttttgttctattgctacataaagtcagcaaatattatcactattaatgacagctataatgatgataatattgcccaggcaccttgctaagcccttactcttggaggtaggaagaatattctttattttacaaatgaggagaccgaattacagaatccttaaggtacaagtaaaaaaactggtgtttgaactatgttgtcttgtattcttaaccaaaatgaaatactgcttccccagtgggcctttctttttatttgttcatttcatatggtagtctgagcatcagctcggtctcatctttattaagaatgtgattttttttttccccaacgcatttgcaactttcattaaagcacactacttgagcccctaacatttttaaataaagataacttacctgtgattttggatactccagaagacacctacttacctgcctatcctatctaccattccagatgcccctggttgtccaagatgagtctcatggagacctggagccccaaagtatccctaaaccatgtgcccagggcccaagatacagtactagggtcactgggctcccctgggattgaagacagtcttccttaggaatcttttattaggaactaagaattcccatttgtttgatgaggtttgttgaacacatctttagaaatgaagaaatctctaataaagatgattctcaacctgtgaattagctatgtttaatgactcatcccagaccagctttgcacaactctctattttatgcttcttgactgtttctttgactgcccatctatgtgtgctgagggaatacaaatttaagtttagtaggagcctgagcaaaatgtaattgagaaggtaacttccctccaaataatattaaaggtaaaatagaaatgatttaaaaattatcagtgttacattcattgatgtgaataatcaagaaatgactatacagcctcatattttgggccccagtaattcacaatttgtgattaaattcctgcgcagttcctgttcaaattaccactgcactatctctgaatgaatggttagctaagcaaagtaatagtgtaaacaagtttgcaaaggggcatgtttaacttgggagggatcgatctctttttaaaggctttgatacattaattatttacactgaaattttgtttttgtagaactgatcagtccagttacaaactggagtaattaggtatatttaaaacaactaaaaacaaccaaataacattcataatacatttaatatcaatggctttttggtaaagtagatcatgcaatttcatgaattgctttattattaaagttccaagacttagtcccctggcttaccaaactgaatcttcgactctgggcacatgatttagggacaccttgaggcttcaggtttctgtgagcctccccattgacaaccaggggcatctggaatggtagatgggataggcaggtaagtaggtgccttctggagtatccagaatcacaggtaagttatctttatttaaaaatgttaggggctcaagtagtatactttaatgaaagttgcaaatgcattgaaaaaaatcatattcttagtttaccagagtaagggtgagacagaactgatgcccagactctaccatataaaataagcaaatgaaaaaatgctttgaaaccatttaggggagaaactctgatgttacatatgcccccttacccttcctttggctttttctaggtgtttttttatttcgtttcagttgccagaaacattttaaatgggttgagacaaggggaaacaaggagtgtttgatacatgatggcaggggaaactaaaaaaagcttgacttggttattttctccccacctccaacatatacacagtacctgggacagagacagccagttgacactcaatagctgttctctccatttgtaatagaatcctgaatttagcagaaaacacgcttaatactacatttcccagccttagaattgtcacgtggctaaggtctgtcactagtgtataagttaaaatttcacatgtgacttctgcagtgtccttaaagaaaactgatgcactgtgctttcctctctattcctactgcctggagaggtgacatgatagccagagttaaagcaatcatcttgggtcataagcatgagagacacactctagggatgatggagcctatgtacctggtaactacgtggaactgccaagccatccctatattgtcaacctctagatttctcttgtgggcggattaagctttgtgtgtttaagccactgttaatttgggttttctgtcactcacagctgtacctaatcctaactgatacagcatttaatcaagttctttcctaatagagggaatctattgcatggacaaagggcagagaaggccctttggaaggggattatttcttggtgattttattgacaccaggtcaaagcagtcttgtgtttatgaaacatatcatgggttgtggaaatgactgaggcacttagcctctttgtgtcagtagcttcacactgccaacattttgcctttgtgcgtaccacttgctggtttgcaacaacagatacaactatgaatccttctcgacctatatattaactgtctgaatgcaaacttaatacaaaccgggttattctctaatgattgcagtcaagatgggaagagtggaatcttggcaatgcaatctatcactatgccaaagaccctatgattgcctgtttcagtaccacacactagaaataacctgtaagagaaaggcagacctactttgcttgcaaattgctaaactcccctcctcatgtcaccattctggaactgttgaattacatcaaaagtttacaacccaaaattgatcaccttggccaatttacacaagaaggatcaatataatcagttcccccctctttaaatgttaacaaattctttaacataacacgcctgaccatgggatacagattaaaattagatacagaattaagttccttcttcacagtaaaagagtcgatttgaaaatcctgataatcagcccgagctgcccacaaggcttggctttatagcatttaataagaaaggaagcttgcttcccacaaacgtaatgatttttgtttaattcagtaaagggaaagacagaaacaataagtgggttagggattctccagttaatggtcactattccatccaaggaaggaacagctttgagctctgtatggcagatccctgtccccatcctctgggaaacacctgtcaaggagagtgtaaaggtccccattcatctcctccttctgctgagagaagggctgcatcgttgtcaagggtatgctagactagccttacctagaaaggccacttctacacatacacacagcaaagaccatgatcatcctcagacaggcgtgaccgaagtcaagctcagtgcaacttctgatggaatgatgcatacccaaaagcttcaacatgggcctatctactacttggaggcagaacagacttgtgggaaaattgtaaagtagtgccctcttccccttcttctgcttgtgatatctctaacagaggccagtgccttccagatcccattgttctctttccattccagtcacactttatgtgagctgtgatgttggataggtggttacaagtgaactcacactcattaagtttgcatgttaggcgtggcgtggtggctcacgcctgtaatcccagcactttgggaggccgagtgggtggatcacttgaggtcaggagttcaagaccagcctggccaatatggtgaaaccctgtctctactaataaaatattagccaggtggggtggcgcgtgcctgtaatcccagctactcaggaggctgaggcaggagaatagcttgaacctgggaggtagaggttgcagtgagctgagatcatgccactgcactctagcctgggtgacagagcgagactctgccttaaaaaaaaaaaaaaaaaaaaccaggaccttataaatgagtcacaagggtgggaaggcagatcattgctggggaggctgaagtaatgaatgacagttattttctggattacaaaaggcaacgttataaaagagtctatgtttctggagtccttgcaccaatgcttccctatatttgccctccttcacaagcctccctctggctataacctggttttatttttttctagcttctcttttcaataccaaccaccaccacttattgcatgtatgctttgtgccagggactctaatatactttacacacacatgcacatagctcatttcatcattaaatgaacccaaatgagataggtactatgtcatctccttttcacaagtgggaatgatgtgacaaagaaaggcaaaacaatgtaaacaaatacgcattcaactaaaatacgaactctacaagtgtcgggatttttgtgtttttcacactgtattttgtacatctagaaacaatgtttggcacataataggaacacaataaatattgtacctacctgtaagaagtagtatttttgtctagagtcaattatttaaaaacaaataaacccactcaagctaggttaggcaaagggggatttaggttcaggaatacaggaaactttgcagacccccccaagtgacaggaaatacagccagactacacggatactaggaagtgttgaggcagatcatttgtttctgtctgtccctttggggccatgaggtctcccatacatggtgcgtctctgttcctaatttcttttctgcagatagaagcttcactgcaaagtttacagctcctctttcttcacataagcttgcacattaatttggtttgctgtaatagtaactctgccttcaatttcacagataccaggtaaaacgttgtttcccctgcccatttccataggcaattgggccaggtttccatcccagaccgtattagctgtgatcagtaggcggagtcatgtgagccacccgttccaaccagcggatggatcagatttcctaaagaggttgtgtaggcaaggcaaatatgactgacatctctcaactaggcaggtggccagagacccagagtcgtgttagaagagatatgctatatgccagaggcttctaggacagaagtcagcacactacttctgtaaagggccagatggtaaatactttaggttttgcaggccagacatgattgcagtgcaaaagctgccatggacaataagtaaaagaataggtgtggtgatgttccaatacaagattacaaaaacaatataacaatataaaaacagacagatggctggatttggcctgagggctgtactttgcagactcttgttctaggacaaaggcctcatcagtaaatagaacacttatccatattgctagcaaactggcttcaggttctctgaacaaacgatattattttgtttttactgatttcttcttgtctttaatcattaatgaattgcagtgaccttgctgttatgatgtagaacatcctgctaaacagggaatgtaaatactttgctatatgataaggagggtgcttgaagaaccaggttatacctatcagagccgtttaaatgggagtgagtgattatgctacctattgctaaagtggtgtaattatccaaggacaaagggctgtttttgtggaaacaattcattgccatccctccccacctcttgccaaccctctatcaggatcttaagtgagacatatattttagtgggtgctgtgttctctcactcatttcatagggtacctctttccaaggtctcttaatatagcatgagaaataaaataagggtccaaaaaaggatcggaactgcaaccaatgtgtgtcgccattgactgcatggattgtttgtcaagtagaaaggcagagttttaaatgtagttttattttaaagagtcggtgtttgtagatgcagcccatgtagctgggctaagcttgtaataacttcgcaagtgctgtgaagaagccccaatttctctctgaaagtggttttgtcatactgtaatataaaaggataagggagtaatcttaccgtgtgttgctgggtggatgctgttcctgcagtttattatatttaggtaatgcttaactgcacacttgatagacattacttttatgttgtggctcctggactgttttatgctccccggccattatgctaagaaatgaggttctcttacctttcagagttaaagtcccctgctcctaccccatgtccgaataaaagactctgacagtgtaactatacaggtaagctctcactttctcaactaaaaaagaatgagtctactctgaaagtcttggggcccttaaagtggacggatttgtcagtaaaataacagggagtcagttgagtcaacacattaattaaatgcccttatacagagctgtcctcaaaataaggagccattgcccagccactggtggtggattggggggggaggagaaggcaatgagggtagctgtggtaagcactagttcctaattatacatctcttcaaagctgaggttgagctgcccacttccacgtcactcctcccttaggcagcattatgcttccctgacttctcccttgacccccacccccaccttggtaatgagctatgttatgggtaacttatcccaagaaaagaaagatcatgaggataaatgatagatctggcctttacagccaaaacagtttctgcgatccaattctcttaagtctggtgttgcagaatgacattttaaacacttgaagaatagcaccttcagtaaattggctttaggttttttgttctttgtttttaataatctcaaacttatagaaaagttgcaagtatagtacaaatgaaatgtttccccctgaaccatttaagggtaagttgatgcctcatcaccccataatactagtttagtgcatatttcctacaaacaagaacactgtcctacttaaccacaatgctaccacccaaatcaggacattaattattactatctcaccctcaaatcccattcaggttttgccagttgttccaataatgttttctatagcaaaaggatccagttcagactcaggtgtaacacttgattgtcatacttgagggtaaagggggccatgactgtttaccgtcctttagtctaagatgtttccttaatttaattttgattttcttgaccttgacacttcaaagattatgggccagttgttttgtcacttgtccctcattttgggttgtctgtttcatcctaattaggttccagttatggacctttggtaggaacgtcccagaagtgctgctggatcttctcactgcattctatcacgtggcatgtcatttctacttgtttcattcttgttgatgtccactttgataacttgagtaagataatgtctgccagacatctctgatgtaaatttaatctttccccatttatctcattttgtaattctttagtttaaaataatgttagacttacagcaaatatatagcacagagagtgttatatacccatcactcagttcccctagagtaagcatcttcaattaccatattaatattttgggagaaggtacattgaagccacgtagaaatccgttccttgtcaagctttcaacatattcatttaaaag

SEQ ID NO: 152 - DNA, 257604 bp, Homo sapiens
accatcacagtggtagacacttatatgacaaaagggtctcactgctgatcaattttaaatctatacttaaaggtgatctcttctgaggggagaaaggacgattacccaatatcttattttctttaggttttcctatgagcgtgaataaatattattttagattttcctagcacttatatcatttctcataaagtagttcatatttccatatggcattccttcataattcttggctgaaatgaaaaaatttcttttttaaattcatgcatcacctccagaaaaataaactcagagttgaagagttgctggagaccagttgttttcaaaggttgtttagtactagaactccgttttcaaaagaaatcttatgtcaaagttcaaaatacaaaataacgtgttgcaggctgaagcagaggcagaaaaatagaactcattttccaaattccattccctatgttagtatgtccaactcgtaaaaatgcattgagctgtacacttatgatcctgtacacttatgtaactgcatgtgtattattctttaatttttagaaaagtaccaacatttttagaaaactactaacataagcctacaaaatttgcagtcgttatgttctaaagtttgaataagcttcaggcaacacacagttggaatctgttcaaatttctgacaatacatattaaaattctatactaacacattattcacatagactcatgtttacctgcactgttaatgacaggcagatgtgtgccaacaataaataatcacggaaaaataacacccacactataagaaacatggagaatatttatataatgattaataggtacttttcaaacttgataaacatttgtacatattaacctatttaatcctcacaacaaacatctgggttaagtactaatattgcacccattttataggtaggaaaagggaagctcagacagaataagaaacttgtctaagattatacctataacaagctggggtttcaactccaggtgaaccagttacctaacctcagagtccatggtccagataacagtttctcctatcatataatgtttctataatctaattgcaaacacatttttaattttgcccactaaaatcacttattacagttattgctgttatcatggcctatcaataaaaaaattccttaaattcacaggctgatatggtttggatttgtgtcccctcccaaatctcacgttgaattgtgatccccagtgttaaagaagggcactgataggaggtgattggatcatggtggtgagttttcctcttgctgttctcatgatagtgagtgagttttcacgagatctggttgtttaaaagtgtgcagcacctctccctgcactctcttcctccttctccagccatgtaagatgtgcgtgctgctcctttgccgtctgccatgattgtaagttttctgagtcctccccagccattcttcctgtatagcctgtgtaactgcgagccacttaaaccacttttctttataaattactcggtctcaggtagctctttgtaactatgcaaaaacggactaatacaaaggcatacaataatttcagttttaactggtttagtattttcacacaatgacaaagaaaagggtatttctgaagcatattaacaataactttaaaaaccaaactatttcacaatttaatgatacatgctttccagatatgcttattagtataatttccatgcactgtttcataatactcaaagatgacagtgctatctccatgcagttataggacttatgccaaagatgactgtagtgggtgagtagtgccccccaaaaatgcatatccacccagaacctcagaatgtgacttatttggaaataggaactttgcagatgaaattagttaaggatcttgagatgaaatcatcctgtgactgacatcatccaatgactagtgtccataagcagaggtgaggaccccgagagacatggagaagatggtgagaagatgcaggcagagagtggagtgatgcatctacaagccaaggaacacgaaggactctgagtagccactagaagctggaagagaagcatggatgcttcctcccctggagtcttctgaagatgccaaccctactaatactatgatttcagagactttagtgagagacttaatttctgttgtttacaggcactcagtttgtggtaattggttatggcagccctaacaaaccaatacaactactaattcaagattctgtaagatgcataaatacattctggtttctggagagcagctgacaattctacctgcagcatttgattatctccatacctcttcccccaattggttacatgtcaaccttgtctccaacaagattcataagattgccattaatgtgtttgctctatctactgcttaggtttctttgtagtacacagatttgttatgttaaactgtccttcagaatatactattctgaaattttctttcacctacttcatattgcaaaactaaggtgcagtaaatattgctttacagccacaagtgtaagagagttctaaaaccttggtcatcactggtgatactgtcctgttacttgatgttcgctatagttcataggtgacactgacagaactgctcaagtagctacttcaaatccgtagctggcccaaaatctgcaaacactgtaaactgttagtttctcgaaaagattaatgatgtattgatgacactttcagcctgttaacctccaaaaagatatagaggtcttcctgatgtggttttcttcttcatcatcatctattagcccaagccacagcagattcaggaaatgttcctagctcagtatctcaaaaagcaatctttagctgcaagtagttcctctgtgcccagtgttctttaatgtcaatctacagaatccttaatccttctagtgatttttgggacattctctttctattccactctgctgctttccaacacagtttatatttgcactgcaaaatgattactcttacaatctcatatccaagtctacaacttaaacttttcatgccaactctatacagataatccctggaaataaactggcaggatttaaatatgtggtctcttaccactataccacacttgcaatacactacaaatatttttcacaaatcctgtaattaccttgggaatggcccagttatatctcatcatacctttttgtgaaaaaagtattaatttattgaacataaaattgtacatattctaacattttggtaagtatatgcaaacatatataaattatattttaaaaataaatttaacttttattatatttggcttatattaacattaaaattattttagaattcctaagtatacttactaaatataaatgtaaagtatactaatgtatgctttagaattcctaagtaaattcctaagtatacttactagatgactgcagatagtcaaattagttccctgagacataaaaccattaggagtcataagctggctttacgaacataggttttactccacagtctatctgtagaaccagcactacacaacttggatatactaaatactttcattattcccacaggaaaatgaaaaaaaaaaagtaacatcatccacctatgccttacttttggaaaggtgtcaagagataactcagagtgttactaatgtttatcagttacctgcttatatgaaaattacaactattatagtagcaaaacagggagaaatggaaaagaaacatatatatatttatggatatatatatatatggatatagtgagtaaaagaaaaagacaaaacaaaaacttggtatagtatgattaactgtattctaaaacaaaatctaggaaatgccgtagatctaatcctgaaattaaatgagaattttcatgaatatatttatttaaaatgccttaatatatccttatacatgtactactttatgtttcatgtctactcaaaagaggaattgaagcatacttgcaattatttcaaaacatctgataattcagtttgtagaagaatctttgatatttctaaattgattactagtgcacatccaacacagcagctctacaactgctacttcaactgatttgataaagtgaaaaaccattcagtataggctactgtattctatagccaaagaccactaagcaaatgagaaaaatgtcttaagttagtatattagtttgctagggctgccttcataaaataccccaggctgagtggcttaaacaacagaaattcatttcctcaattctggaggccagaagtccaagatcaaggtgttggcagagttggtttcctctgaggggcataaggaaatgatttgctccaggcccctccccatggcttgcagatggccacctcctcactgtgtcttcacatggtctatcctctgtacatgtacattcctgaatggctgtgactctaaatttcctcttcttataaggacacaggtcagattggattagggatatcctaatgatctcattttaactctcctctctttaaaggccctatctccaaacatagtcaagttctgacatactgaggtttagggctttaacataggaatttatgagggaacagtacagcttgtaacagttagaaaacatttttgttcccttgaccagtcaataaaagcaacatcccacatggttgtcttctataactaaattattttatcataaatatttccaccaccaacaatgtaacctattaactacatcatataggcagatattggtaaaaaaaaaaaaaaagtgtcttttcataacattctaatattctactcctgatttgaaagaccaaataatatatcgtacacaaattatgaggccccaacctacaacctccacgacataatgattccaaccaatataatgttagctgtgttgttgactctgctgcaggggatataaaatgcaattaaactaataactaatactgattattcaaaatatgtatcaaactcactaacaaattgtaactggcatttttagaaggctatagcaacaaagaggttaacgtgtcttttggttatagcagataaatttgaaattttcaaacactataaattttccaggtggttgccacctggaaattaagtgttctaagtgctcacagtaggtgaataaaagataaacatttggtatttagtaagacatttatcataaaatgatggaaacgcatgagaaactggaaaccaggagacgtatttgagcagacaaatattagggtcaaatcaaggaattgctagctaaaaacatataaacagagtcttagaagcagaaagcatagtattaaatggaaaggatttaaaaatcaaatatatcagtgaatgctcttaatggtaaaatatggaaacagagaaatatggcaaaaattaaaaatgagttaacattgaatccactctgataatacactgaatattgatctcttctagaagcttaaatctattcacagctgtcccaggaataatccctggtctagagcagcagttcctaaagtataagaattcctggaaaacgtatgaatttatccttaaataaagagtagaatacacaaatttaggtgaggttcccagcaaaaagcaccaaagggaaggtgacatttacttttaagtttcttgatgaaggagaaaactagacaacattcttgccacagctgccacttcccatggatttaacttaggcaaaagccaccatgcagctctgcattgagatgctgaaggctatatagagatatgacaaatgagagaaaagatatccaaagaaggggagccaagcaggattttttcaagtaaacaaaatttggaaggagaggttaagggtgtaggaatcaaaagtcccattttgtggcataatatgattctgacacctttttgagatgctatggaaatagcaaaagctgttgtctatagaagtgtggatcttagaaggaaagtctgggatataaatttgtaagtctttaacataatggtggtattatgggaattgaaaacatcacctaaagagaagatctagggagaaaagaagagaagggttcaccattaggctagtgaaaagcacttttaaaaaagcaatgcatagacactgcacagaggaagaggagaaagtaaaggaaattgaccataggagggaagagccagctggggaagagctagatgggagtgagacagattgggtttcactaagacacagacactacacctgaaccaagagtaagacaagagcacagtttctgacacagtgtaatcactcaataaaggcttgttaagttagtgattggatgaatgagttacagactgaactagcacggtatttctagaattaagagttgactaggaaaggatggaaatacatggtggaattataactctaaaaaggtcagaccaaggtgatgttgtaaacttaccttagttttattttaatatactcaccaacaaaaaaaagtaagttttgtcatattttttactctttaataaaatttaataatgaaatagattattgggaagtaatcaataaaacctttatagattaattttaactgcttagacaaggaaaaatgtattgaaccttagaagtccaaaaagagagaaatattacaatggtatacagaaatacaataatgactaaaaatatttccactgaaatgcaacagaaaagttgtaagccattatatcttagaaaagaagcagtcctaatgaagtagatttttgaaaattgtcatacaggtaagctcattagttgcaatgaaagttctccctgctgatctaggagtacttaatgaccaggatttgttatgcctcaaaaacaaaggtactttttaattcatgtgatagctcactgaggaggtttcaaatctggaaacttttaaatgatgatatataacacgtgtataagagcattaaaatactccaaagcaaacacacttacctcattcaaaatattacattttctcctcaaatctcattaataaagtaatataataataaaaaagttatgcttaacaatcacctatactataaaaagtacttcagtgatggcttttctatgttaaagatgaagttggctgctccctgtgaaacatactaacggtgtctgctgacccatacacagacactagactccactcttaacagatggaaactaaaaagtcccaaaaccccagaacgccctgctgaaacacaaaaacaacaaaaagaaaaatacccagaagaaccaaaccaagttacagttctgcaagtccttatcaaaggtaaatatttttaaagaacaaattataatatcaataaagaattttaagtatgagtcaacataaatatttcaaaaacttcatttacagcaaaacctgctaaacaataaattctacaataaaaaatacatctactcaaccatgtttttccccaggaaaaaaactcccggtgtatttcaaggcactttgtacctaccatgttttcatccactactccgttatctatcaaactgattaatgtccatcaagaatactcatttccaatttttttttatcccatttggtcaaaaaatccaaaatatcagaattctctctttaggagagttgatttccctgaggtaaaagttattttgaatatcactgagtgattctgaatgtttacaacccattcagttcaatgcccttttgccctatctcaggtgatttaacacaagaaaataatttcaattattttcccttcttgaatcctattaaaacatctataactatatatatgggaagattcttcttatagcaaggacattttcaggttgcagaggggtaaagtgagtaattcaataattcattggaacactaggatttattagtgaaaatttaagtaaaaggcttattttttgtcttacaaatcaagacaggccatatgaaatatttacttcaaggaaacatacatctcagaacaaagtttcaaagaacatctcatccaatcacatgcttctttgtcaataaagttctataatcctcattttatagaagaagaacaatttaaagggagcaggaaaagataaaattaattttttttaaagaagaaatattcactctaatatggaaaacaataaaatatccttcaagttgatgaattccaatattaaaaagaaaataaagaggttataaagacaatttcatattactaatgactagtagtcaacaaaaaaagaatacagatattccagcattccagatgagttgttttccaaaatgtattcataaattggttgtttgacaccaagtaaagttgaaagaatcaatgtgaaatataaatgaaaattgaggccgggcgcggtggctcatgcctgtaatcccagcactttgggaggctgaggcaggcggatcaggaggtcaggagatcgagactatcctggctaacatggtgaaaccccgtctctactaaaaatataataaattatccaggcatggaggcgggtgcctgtagtcccagctactcaggaggctgaggcaggagaatggcatgaacctgggaggcggagcttgcagtgagccaagatcacgccactgcactccagcctgggcaacagagcgagactccatctcaaaaaaaggaaaaaaaagaaaaagaaaaagaaaattgaattattaaggtagtcaaaaaattatatttaaatcatattataaccaagtattaataatagctctatccgttctatgaccctttatgacctgatctaagcccacaattgagactagaatcaggttagaaatttgggcattaggaaagagtgaaatgaaactctggcagtatggtgtcttctataacaaaaaaagagagcaccaacaagttgggcagagatagatttggtactcaggtaagtagggagggacactgattgctggttctggtatcaggtatgtaataggctatcagtgcctatgaatgacattgaatcaagagagcatcaccctggccaaaaagtgcaggagatttagcagtagaaggtagggctagcaggtatctacaaggtttaaactgtaaaacaaagtattttataatataaggcctcatcatctaactaaacaaattaaactcatagctccaatcatgacaactcataatatcctacaactctctttatttttaaaatgagatattgggtatgaaaacactgtgagaaagtggaaagtacatacaaataaaaggtataattttcagtcttttagcactgaagatcagagccatgaaatgtttcttaaaaaggcacaaacctttactagctttgtctaaaggttccaaatcatccacaaaattcagtatatcagggtacttctcttcacatatttctaccaggaaatgaagtagcgttgttttctgatctgctgattttgtgtcctttagctaaatagaacaggagggagaaaaaacacagagtcataagtatgttgatattctgtctacttaaataatattaatactgtattttgtagataaggactaaaagttgtaaaattagttgatttcgtttttgaaaaacaaatatttaaatactcgaaaaactacttttgacttgctgcttggtgaaaatcattatttgtcgcaaaaaaggaataagtttaatcgagcatgcaatgttttatagaaaaaaatatggaaaatgcctaggaaaacagagtaacctatgagtctatttaatagtagtatttaaacatccttggcattcatccatttatcacttggcacatatccatagaatgcctactagctactgtagtagttggagacctaacaacaaataaaacatagactttcctcaagaagctgtttagttaaaaaatatacgtatttgccttggtgtgacaaatagtatagtaaaaataatcacaactttcatttaggaggacatgacaatggaactgagacttcaaagacaggaagttgtatgggcttagggaaaagaaagaaaaaatacaaaagtgcattaacacaggctcatggagcagcatttacaagggctatagatgaggaaggatatgacacctctgaggcagctgagtgactccagaattaaagtgtatctgtattagggaaggcatgtagggacatggcaaagatataaatctgaaaagaccaaaaaataaaaggaaagataatggcatgcaatggaagtaggattttgattttgaagcaatataagttttccaactagatgagagatgatcagatatacattttagaaagctccctccagtgagtgtggctaaaaagattagggcaagagtactaagagaagcatgaagagtgagttaaaaacccatggcaataatcaggcagggaaagagggcagtctgaatggaggttgtgcctgggaaatggggacaatgagaccatgtgggtgtggaaacccaggtgatgctgttaactaccatgtcagaaatgatgagaaacagatttgtgtgaggtggccaaagaagaaaattgttttggacaaggtaaatttgaagcttttcagtagtacccaggtggaaatgtcttgaaagaatatacatttatctatctatgtatagaacagtgctttcattattttttttcatgattgccccctaagaagtttttaggcatttttttcctaactgcacctataaaattttaaaatcacaaaggtgatgcatttatgtttatatactgtatgcatatctgtgttttacacctaaaaactggttaaacaagtaagacatttttgctctccaagaaccaactttttatccctgaaagatacctattgaaaatacatggttaaacctcagaggaataaactggggcaccaacttgtgacccctttcctcccaaagctaattagttgatcaaattaacataaacaggtatgtagaatgaatgaaaagaggttacgggcttgagacgaccagggtggaccaatcctaatctgaaatggccaaggagtgcaatcacagggagaggtagttaagctaaaacttcaacaatgataaaagttagcttgggttttgtgtagtgttgggatagaaagtattggcaaggaggagtggtatgaacacaggactaataggtaatctggtagcattccctaccattaagtaatcatttagagcagagatacaaataaagggttaaaaaaaaaatcagtcttttctaccagaatttaatttacagctggaaattcaaggcatacctaattgggcacagtactacttacttgcttcctttccaagaatttccaactttaaaattggctcctaaataaattcccataagtaatattttaaaaaatccaacctcactaaatattctatcactatcagaaaaataccaaataactgttaaagtccagtagtggaagaatgggagatttccgtaccatcagacatattaacatactgactacttattgattcaaaaactatcatagagccgggaacagtgagctacccacctagacagctttactttcacatcatgacacatgtaataggttcaaatgctatgctgacctacacaacatgcaacttatacagtggttcccagtactttaaaaacagactgaatatgaacacttagtccatgatttggtaccttgtttaaaagaaatacagatttcacaacatagagctgagtgttttacaagaggatgcctcaaaaacatgactccattgactacctagacaaatagtcactaacatacgtggatgatttggcaatgttaaaacatgtccttgactaattaatagtcttgagcacattactggaccttagctttcacacaggtaaaataagaaaatgaaacaacatagaaactctaaattcactttttactctaaaaatgttaagtatacattatagtggaactaagagttagtagacacagtacaatttaatttttaaaaactggaagagtggagaaatgtagtaataatctcatttcagagttatttctgtgtgtttgggtcagttggaatcattctatgggcttctgtttttacatatagactcatgaatgtcaaatacaatctttaagtttcgttacaatcctataatttcattcatactatcatcttaaataggtaaggccagattaaaagcagcaaacttttacaaacagttttctctttgcacagccaccaaaagttaacatgaaagttgtattctgttttgttaaaaagcaccctagtagcaaagatcctttatctcacccaccctcatttacagcaatgactacttggggaacactgttcctactctgaattctcggcaacccatttttactagtctacacccttgtagactgtttggaacgttaagacaatcaccatctaccttcacaatttgtaaagcctagaaagagtattccaatagtatctgtgatatagctaaacagccagcaactgctaggattaacgtatcaagaaatctcaatgacggaagaacaaccaactggattgctcttggtctttatttgtaagcaatgagaattcagaatttagaatcatggaaaacaatgtagtttgtagcaacttagtttaataaatgttaaatactcaagtcaaacacagattcgagttattcagagaccattataaagctaaacactgatttaggaggagggtgctaccatgggttgtcttgttgaaaacatcaactgagtagcaagcagcataatgggaacaatctagtattaaaaagtacactcactgaatagtaaagggaagcacaatattcctatcatttcaaaatgggtatttaacaattgaaagacaccactcaaactttcatgtaaataaatttgaaactaagcctaataaataagaggttcagaaaagaagcatgttgttgatcatgcatggtgtctcatttataaactactatgcagctctaaactccagggcagagattcttcatttatgctctaacattctctagaaaaatttcacaatgctgccaagatactcttcctgcctcaactactctattctctccctcccctctctctaaccatcttttaaaaagtcttccaaaagcatcaaagcataaaatgtattaggtccttatccatttgctcaatatttttttcatttcattaatgaaaattaccaactaaaaaggcacattctactcctactcatatcatactcactcatatcataatcagtttctgagctagaacaagtaaagcttggaatacagtgttaattttgttgaagatgagtaacaacttatgtaaactttgtaacgctaaatcttggaaagaaaataaaatatttgctttaaaaatatcttcaggttaaaagtatgctttatttaaactttaacagtcagtgcttgacaggatttcttttgtattactgtcaagagatttatcttactgatgagtaatcatcaccgttaaacagaatttcctatttatgtattgtttctttaaggtacatttaacgtggcataaatgtcaaataaacaaaagatggatggagtttctccaaccactctgttcattccagacaaaataatgttaaaagtggatcctgtaataaatcatggcctagttgtcagtctgcagtaaaactcccttgcagttacagtgcaaggtttggggatatttttgaggtattcagcacaaatctggatgacatttaaagaatattccatttatttagtcacatggtaataatttaaatttaaaccctaaaataaaaactaagcatcttcgtgatcttcagaagtcaaggaactggaatcccttcctgtttgaaataatgaaacttacatcttaagaatattatcacattaataactctactccgcatcattatgttcctataatctaggtatgtatcaaagcagcattgaatatttagatgtttagatgctgtggacattagtgaacaccagaaacaagacaaaattctgaaaaatcttgtaatggcaccattaccattttagaagaatacaacctgtgaataatattaatgctgaggatgacagtagcatcctcagcattaatgtttggtacttaccatgagacagacattagccaaataatataacacatgttaagtgcttaaaacattacaaccccaaactagtattatatccattatttaaaaaggaaaatggaaatttagagagatcatatagcttacactggatcacatggagccaatgattggaacacatgtctgtgtgaatacaaagctcttatccactataaaatatagttcctttacagcaatctttagtctagcttattattaacaaaataaaccaaattctcaaaaaatggcagtaaaacaacaaaagagcactaatgcaatgtaaaatactagcaccctttaacctgttaattctagcctggaaagcatctaaaaacagacaccacactcccttgaggtcatttctagttctaagagcacaacattctattgttttatctgtaaaataaataaaatgccatctgaatcttatcaatcaaatagcaactctttatatatttctaatggattactgctgacaaaatatcatatgattgaagaaaaaggtatctataaagtttaaccttcaatggatttataccactatattttaatagcatcatatcccatctcaaatcttttgcagaataaagtggattgtgtatgcataaaatagcatccctaaaaataaaggtatctacgtgaaaatgaatgtatgaagacatactaacaaagactataacacaattgctcagacagaaagctcaaaaagtcaatgtggtagtacaaattcactaataaaaccaaccaccattatagaatggattttgttttctggtatgtacgtgtgcttgtgtgtgtgcctggtgtgtgtttgtgtgtgtatttgagatgggctcttgctttatttacatatatatttatttatttatatatataaatatttttaaatatatattttaaataatcattgtgctaacaaaatttttcaaaacaaaactgagtatcactccaatacaaatggcaatgaaaatcttgaagtaaataaaacaagatggttgaggcaggagaactgcatgagcctgggagttcaagactgcagtgagctatataatctctccactgcgctccggcatagatgacagagtgagacctggctcttaaaaaaaacaacaaaacaaaacaagcctaaggtgcttatgccactgccataaccacaaccattaatattaaaatataactttcttaataattctaaagatagaaaccaattgatattatataaattagatactaaggcatataaatactaaattacttatggcacccatatataaaaacaatttatattaattacttaatattcattttaaaatgataatgaaaattaaaacattaagtgaccaagaaagtgcattaaataatgtggacttccgtaattataatatgctaccatatccccacacactttctctgaattatatttttaacacatttctcttgaattacagtgagtgtagaaacttctatatagaaagcatttgtgcattttagtaaaagtttagcatactacattatctactgcgttgcactgttctgttcatactgccccctttttcctgcaaaagatataaaacagctcaatgttccttacaaaaaaggactattttcagttcttttagtactgagagatcagaaaacagacattcataacaggcaaatgggaaaaagtactagaataaacaatctgcaagggaacaaatatgattagaatacaaatatattttttaaatgctaaactcggatgatcaaagacataaaaaagatacaagatactgcttcagcaactatatcagcactctccacctaacaaaaacactctcaccaagaacaagaagtcatggcagggtcgcagtgagactggcactttcatagtgccagtctatgaaagccactgcaggcatgcgcaaatcagtaaaacctccaggaaaatgatttagtaacatacgtcaaaaattttaaaaatattcttgtttggagtagtttcagaaaactcactggagtccaacattgtccagccaaagctatgtaactaaactgctattttagagcacggatttcttaatctaataataagaatttctcatgggaacaattaacaaaaattggagtaagtgcttagaaagtgaacatgtttagattgtttatacaaatggaccaaatacattaattttaaaggttttttaacccttattaataattaactttatattttagactttatattttagagcaattttagctttacaggaaaaactaacagaaaacagagttcctgtatacccttccctacacacacacaaattatcctgttgtaaacattttacattagtgtggtacatttgtgacaagtaatgtaccagtattgacacgttattgttaactagtttccacgttaaggttctttctttgtgttctgcagttctatgtgtcttgataaactcagtgttattcatccatcactacaatgttatacagaatagttttaccaccctaaaaaattctgtgtctcacctattcattccttccttcttccctctcctcagaacccctggcaaccactgatgttttattgtctctagacttttgccacttacagaacatcacatagttggaatcatacagtagatagcccttccagtctggtttctatcacttagcaatacgaatttaatgttcttccatgtcttccattggcttaaagagatcatttatttttaatattgaataatattccaaatgaatataccacagtttatccattcacctattgaaggacatattgcttgcttccaagttcaggtaattattaataaaatggctgtaaacatttgtatgcaggtttttgtgtggacttaagttttcaattcatttgggtaaacacttaggagtgtgattactggatggtttgttctacgtgtagctttgtaattgccagttatccaaagttgatgtgccacattttgctttcccactagcaatgaatgaaggttgtactatatacttaccagcacttggtgctgtcagtgtttagtattttagcaatgccagtacatatgcagtggtgtcttattgtttgagtttgcaattccttaatgacatctgctgctgactattatagggacagaaaaattacaactccatcctcttagggtccttgctggtctgataatttaatttgacatgagagagattaacaggagaaacgtgtaatgcaagttttccgtagcacaaaggccatcaaaggaatgaagactgaaagaaatagagtcagttacccatataccggattgtgaaaagaacagttgttaaggagcaactacattaggtgggaaattacttttaacaaggcctctaaaaaattctctttgtttcgactttttgttgttgacgattaaggatgttgcatctttccagtacggaaaggccatcttttgcatgaaaatgttaacttctgcttttaagaaatagcaaggaggtcaaagcaatctttctacacctgctgtttttcaagtatctttaaatagtcaatataccagaatagcatattttaatcccttcaatatcttttcatacatttacctgacacctatacgttttgatgggtatctcttcacatcttttgatcatttctttaaactgggttgtttatttcttagttttaagagtttttgtacattttagataaaagtcctttatcaggtatgtgttttggaaagattttcttccagcctgttttcttttcattgtcttaactgtttgccacagaagttttaaattttaataaagttcaatttatcaattttctttcatagattatacttttagtgttatatctaaaacgtcataataaaaccaaaggtcacatagattttctcttatcttctataaaatgtatagtcttgcaatttatatttaggtccatgataaatttttagttaatttttgtgaaagatattaggtctggcaactttttttttttttaaatgtagatgttctcgtaccttttctttaaaagaaagactattctttcactattgaattacctttgttcctttgtcaaaatcaactgactatatttatacgaatctatttctggggtctctattccagtccattattttaaaattatttttattttttttccctttggccaataccacaatattttccttattgcagctttatactaagtctggaagtcagggagtgtcagatttccaacttagttcttcttcttcagtattgtgttagctattctgggtcttttgcctccccatacaaactttgaaatcattttgtcaatatccataaaataacttgctggaactctcactggggctctattgaacccatagatcaagttgggaagaaacgacaccttaatagtactgagacatgctttctatgaacatgaaatgtctattactttattagatcttctttgatttttttcaaagttttgtaggtgttttttttttttttttaaatttgagatggagtttcactcttgttgcttaggctagagtgcaatggcacgatctcggctcaccacaacctccgcttcccaggttcaagcgactctcctgtctcagcctccctagtagctgggattacaagcatgtgccaccacgcctggctaattttgtatttttagtagagacggggtttctccatgttggtcaagctggtcttgaactcccgacctcaggtgatctgcccgcctcagcctcccaaagtgcttggattacaggcatgagccaccacgcctggccttgtagttttcctcatacagatcttatatgtattttgttagattaatacctatgtatggtttttgttactaagaaaatgatacactattttaaatttccaattccaattgttcattgctggcatacaggaaaccactggctttttaaattaggtgacctcataatctaaaactttgatataattgcttaacagttccaggaggtttattttttgtccattttttttgggggggggggtggcgggcattctacacagacaatcatttcatctatgaagaaagagttttgtttattctgccccaatctttatagcttttatttttcttgtcttactgtactagccaggacttccaacacaatgttcaagaggagtagtgagagaagacacacctgcattgcttccagttttagggaaaaagcatcttgttccttaccattaagtatgatgctagctgtcgattttatgtagatgttctttatcaacttgaggaagttcccctctacccctatttggtgagaatttttctcattaatgaatgttacattttttcaaatgcattttctgcatctattggtgagttttcttctttagctcattgatgatgatagattacattaatggattttcaaatgtcgcacccagccaggatgcatagaattaaaaattattccctctccttctatttacttgaacagatttagagaattgaaattatttcttccttacatgtttgatagaatttactggtgaaaccatctgagccttgttctttctgtttttgaaggttattcattattgattcaagtattttaatagattcagattatccatttcctctagtgtgacttttggtagatggcatctatcaaggtccatttcatctaggttatcacatttgtaggcttggttgtgttaataatattcttccgttatctttttaacatccataggatcagtaacgatagtccctctttcgtttttgatatgggcaatttgtatcttctctctttttctcttggttagcttggctattgatctttttaaagactcaatcagatattggtgggtttgattttctctattaattttctgtatcaatttcattgatatctgctctagtatatattagttctttgtcttacctactccagagtccatttgctcttctttttcttgtttcctaaggttaaagattattctttttagatctttcttattttctaatataggcacttgatgctataaatttccctgtgagcactgcttttattgcatcgaacaaaactttataagttgtattttcattttgctgtttcatataagtggatcaaacagaataattttaaatgagatggttttgtttttttaaaaaaatacagaaacttctgaactttacattaaaggacttaacaaaacacacgcctggtatatctcaggtgatatttttcagtttgttctggtggtggtggattctgtacctcccaatgctggaaccatagttcaaagccacttatgacacatttcttcatcatcctctcccctgtcccccaagaacaaatgttcataagtaccaatggctaagtattactatgtggataataatgttgcatgttttgtctctgattccaaaaatgtagaaacaatgcagacccttgataaaggagaggtaagacacttcttagagtatcaggaatggagtgtcttgtttctggtttttatttttcatttataaaatatataaaagtgaagtctgaattaaaccagggatggtaatattcaccttcggtgctatctctgatggggtagttgtctataagcctgacgccgaggaggattcagaggctgggtgtttgggggaaagggtagtttgatagagaagctatgcttgctatgagagcaggaagatgaaggcacacaagcagcctatttgctgagcctgagcaaagtcactccatcttttataattctattagaagaatcattctcatttacaacatttaacagcaattgaataacaaaggtgacatgaaaataatttaccaaaaacgctatttagaaaagccaattaaatatttcttagaaaatgtcatagattaaatgtgttaatgaatgagtcaaagggggttaagcattctaaatagtttcacattgctttggaaatcagtatttctgtgatttaactggctgcatgtaaaataagaatggcatttgttatttgcaagtctttggcccataactgctttactttcaaaggttgccaaaatttactggtataattttgccaacctaataaagaataaaaatccctctcaaaataccctgaatgcaaatggaacaatggatttgttcggcagagatctttcttaaaaataaattcatagagtaaaggaaaaagtgatacatagggatcaaaacttcacaaaaacgactcacagtgttaacttgtgtgagtgtgacaggtatgcaaaatacaaactgcctgaaataggcaaaggtatcctgtctcatgcttttgtagtcactgaaactctacctgtacaagctagagacttgtaaaatggctcgagaaacaggccttcaacttatttcagttccactatgtgcctgaaattcacactccttttcaaagttttcattttcagagtaatgtttagcttggcatgagaggaaaagcagcaatttttgaaaatattttcaccactttttcttttttttttttttttttcactctttttacccaggctggagtgcagtggcatgatctcggctcactgcaacctccgcctcccgggttcaagcgattctcctgcctcagcctcacgaatagagtagctgggattacaggcgcctgccactatgcccagataagttttgtagttttagtagagacagggtttctctatgttggccaggctggtctcaaactcctgacctcaggtgataggcccgcctcagcctcgcaaagtgctgggattacaggcatgagccactgcgcctggcctcaccactcattcttaagtgaagaagtaaagttgtttcgtttttgtcgtggctttggtgttggttaattttcattttttcatgtttgcttttggttccagatcaccagtcagggattttccattctgggatatgaaagtagggcagaagaccaagcgattcacatttcaagttgagtatgaaaatcacctaggaagtagctttaaaaatgccaccaatcaggatccacatccattctttctaagttaattgaactggtgtggggactgcggcatcagtatttcttaaagggtactccaggttgctaatcaatgtcatccaaaagccatttgtcacaattttggaaagtgtctcattagggttggtggaaacattaaagaatatgagaatttaatgtttgttgctgtttctattgttttaattatctccatcacagctctgatgaagttattctactttttctactttttgcttataaaaggaatatccagaatcagataaaaaattcatgcattagaaaagagaatttaggaaaaattaattttgcctgccaccccctcaccgtcttagcacctactcctcaacgcccatagccccattaccatgtattcatcaatgacttcaactctgagacgaactcattagatattctactgccatagaaaacagaaggcttcctacaaagtgacagtatggataaatttaaagtgggatcaatagttatttgtttctgcaattttcccaaagaataacagcataaataccaataaaaattagttattacacgtggtaaaactccttcaaaacttatatctattaccccaatataggaagtcagttgattcaatcaatcacctggaacaaagagctgcatcatcctgttgtattgatcagaatgatctgttactcagaaattatacatcttattagacattagtaaacattattaaacacatgttatggttattatatgtggattagtaacatcttcttaaatttacaagtcaaaattatctcatatattttaatatggtgttgaactttgatggttgggtcaattcactctttacctaaaatcctttgaaaaaaatgaacttggccctatcaacgtgtctcttggagaaacatctttgatactaaccagatacaaacttttctaggtcagcattttggtcagataagcatctaccatctgccgatttaatttctaaagatatgttttccacttaatcaacagcagtctccccactctcaaaattaatatgatgtcaaaatgatatccattttttatctgaagttcagtactacatttggaggattttttaatgacaagcagtcctccattatttctgcaaggtttatccttttaaaaagtcaagccatcagaaagcaaggtacttacaccattttaactaaactagaagtagcattactgtgactgaaacgtacattttttttcacatcataagggttcgcatggggtgccaggtccttaagaggcccagaatacatattttgggggagaggggaagagaggaggagaaagagagattgttctaaaaaaaaaatcctgacgaaactgactcatttgttgtttataacactattcaacacgttttccttttgtaaagatacatatgcaaaatttcttatgaaggtttaatcagggaaaacactatttttgctcatgaagtgaagtttgcacatcactttgaccaccaaaaagtcaagcacctatatagcaactttaatttttatttagatcttaatcataaattcagttatgtttaccttatatgtcatattttacttttttgtcatatgtcacatgaaatctttgggatataagaaagcaaatccttttctctcgaatccagagatattatagttactcattgccatcctgactacaaatgtctacaaagctatgatacagctccccaaactaaactataatgggcatgaaactcaagtattcatgctcttatttctaaacaatgcaaagttaatttaatatgaattttcatgaatttttcatacttgagttaaattcgtaaagggcatttaaaagtaaggattttggatataaaatgttaaatgtcatataattacccagcatgttttaacagattaaaatacttccttgtctttctactgtcaaatatatatggaattccttgtgtagaagcttatcatcaaaccaaatgctttatactcagtgtgaaaattcaatcacaattgtcaaagatcaagctgctacttctgataacaaatatgatgagatatcatcttgttcaatatatgctttcaacttgacatgtaggctaataaaaaacatgaagttgtagtatttattttgtttcttccacaacagaaggctcctaagagggatgatcaaaatactcagtatcattgcaagaaaataaagtcaactctttatctgcagacagattaactggtttgccgactaactgtagtaaaagaataacagctacattgcatttgtaaaagatttaaaaattactatgcatcagtgattgtatctcaatgagaggatgtctatttattttcaacaacaaaataaacataagacactactttttgtcttatgacaagtttcattcattcaacagctatttattgagtacttactatataccaaccactgcagtaggctatcctacctcattaatcacacctagtctccctgtcaacagctctccttagaggaaggcataaggacatgaggaagagcatgcagccagtttttttgtgtcaactataattctgagatgtaaaacctaaagaggatcacagacacttttgcacgaggaaacagactgtagtacatgtgtggctgtggattaactttcccctatcttgcccctcaccctgtttttcttactttgccttccttctcagggaaagcctgaatctgccattcttgcttgcctccttctccttcagcttccaagttcataaccagcacaccttgacaactcctcagatgtccctgaatttgtgtacttccctacatccccactacattctacctcaaacccttctgccgttaccttagcttggaactccatcatctcaaaacacagtgatagctacttagtggacactcaaacctttgctaaataattgaataaggtagcttcaatcatatgccctttaagatactgaggtaaacaagagtagaataacaacaaaaaacccctgatctcattctcttttgagcaaccacttcaaacatgccagtagcaatatctcccattagttgcctaaggtagatacttaggaattatttttgacctttctctcttctctgccacccccataccatctttcctattaccttctcagtttggtttcctctgttgctctcttaggtctcacactacatgtcaaccaaacaccaaatacctcctcaatgtaaccctctaacccagcgctgtccaataactttatgcaatgatggtaatgtgccatatatatgctgccaacgggtatggacactgagcacttggcatgtggcgagtgtgactgaggaactatgtttttaattttatttaaatttcaactaatttgaattaagtagccatatatgtttcatggcaacagtactaaacagtgcagcttaaccttcttccatactgctgatagacatatcttgctacgaaacatctgatcatattacttgccttacagagtgtgactccataaaatctccatcattaggcaggatattcaaagctctttacaatctagaccaatttatcacctcagtctcattagccccactcctttcccatctagtttgcaaaggtagtaggccactcactgtactcacacatgccatgctataacccttttggaagctgctgactcctgcttagaacgccttttcctctcacagaacatctgctcatccttcaagatccagcttaaattcccatttctctctgaatatctaactgccctctcatagctgagctaggctctctgtcttaactctgctgccataacttttagtatgtggcttcattaaagcatttcatcataattaatggtttacatgtggaaaatatgagtctcatgtatgccaggtaaatattaatcacatacattaaagatagaatctaaagatagaatctggcaaagcatctggcacaggacttcactctgagtaagcccacgagagatgtgccaagtcttcaggatgtgttttaggaattgcatcgcccatgctagggatcttcaccaaatacagctgcctaagaaaacagagaggaaaataaaagaatggagatggggcaaaggaaacactcacaaggcattgatagcaatgagaggcttaggccagggaaattgtataagaaaattcatgaaagccccaatagaataagcatgcagtaaacctataggtaaagcagaacttgtttttcaccttccctaactagctggcaatagcaataatcaaattccttaatcagggagtgtggttgttacgaggtcaagaacaagaaaaaggttttcttctgatgtgtaactgagaagaatttgttgtaagcagatcaataaagccctattactatggcccactcctcaggaaagagctctgttttataaaacattgaatatatttgctgtaaggaaattcaacctatgaaagacacaggagaaaaaaaaggctctaaacttactccattttcatgtcctctagaattatatttagatagaaacacttcaaaatcaataatatccgagttgcatatatttccaatataataatttcccctttatataaaggggtcccatttttctctcctttcagtctgcttatgaaagcaatgcagagaaatatttaaatagttaaaggtaaaaatgttaatggcaatcctaagcaatattcaatatatatacaggtatctgaactgagtaagtacgagtcagtattaataatattttgacgttccatttcattggtttgagaaagcataggtttatgatataattttgttattaaataaaatccttgaattggatttgcagattgaagaaaattaatatttggatttagttcagaggttgagtaaattagctcagttcactctgggtttgagttcatggttcagttcaagttcttgataatgagcacatcaaaataaaaaaatatttaaataatgcaatcagggctgacatttaagagcaagtgttcaggcaaatatgtgtttttaaaaaaacaaactcactttacagagagagctaaggttaaatccgaaggtttgagcattccgggagccagcattcatgtagtttcccattagcaatacaagttccagcaacttgctaaagcttttgctcttctttatctcttcgcaggcagtactgacagccatgatgtcaggtttgatgttgttcacctgctcttcaaactgaagcttaaagagaatagcactgagccgtggccgtagtctcttcacattgctcatctgattgaaaagaaaacagcagatttcctttaaaatgcatggtatagtttagtactgtacgactgcaagtaatctgggatgatttattggtatgacagtaccaaagaagaaatatgtctcctaaaactgatagcaggaagagagaaaagccctgcttgtttttgtaaggaatccagagtcatccctcaaaacccaaattaacaatttagatgctcaatgaaaagaaagctttaattaaatgataatgtttaattaagcaataaagtaagcattttttaaactaaattctaaaaaggtaacaagatacataggccacaaattacaaggcattcatgtcattattttgaataatttttgttcaatactgcaatatactgggtcatgtttaaaacacattcagaaaagtctaaagagggtttgttttcttcaaatagcaattgctgtcctcagaaaccctgctgactaacagtatgtgttagatagagggagagtaaataggtcccaatttgtactaaattgactttcttcagaaacacaggaaagtagaatgactcctgacacatactaaattagcagaatcagagttaggaaacatgggagtagtagcaggcagaagcggtgcaaacccacaaatctatcacatgccaagttaaccctgtctgggactctaggtttctctactgggaatgtgggggactggaggtgtctaaaagaacaaaggggcaagttcctgcctttatccttactcctgtgttatatcaacacacatgcaggaaataatcacttagctgtaggctgaagacataccacatatgaagctagatatgaattccttgaccaaacacactagggatttgggacttaaaacgcactgaaggggcggtaatagtaaaattgttgaacttcaacaactattgtaaatatcaaaagcaggttaaggcaaggtcagaaaaaaagcagtgacagattaaaatagggactgtttctcccttagtcacagactgtaaaggaaaggctaaaaaacaatgctatatgaagcctgtaggatgccaaatataatgaaaatcatgattgtttgggatacagaaagctatcagctcataatataataatgaccgttacttaaaatatactagacaaaggcttataagactccaatatattatagacactgccttaatgactaaacataactcagcttactcatctgacaaaaattgagcaataaagaattagttctttgtacacaactctgagagaatattttcatatagaccaaagccctatagtgaatgaaaagttccattttcaaataatataaatatctaatttatacttagctttctccccagacccttgccaaattaaatggttattcatatacaatcaagattctaagggctcaattaatgtagttattaataagaagtctactttacaaggcactttaaggaacgtcttcatattccactgtctaggaaaaacaaagaatgtaagttcaacaaggaccaaaaaaaaaaaaaaaaaaagaagaagaagaaatatcattaagtttatagagtaagtttaagcgatatgaaattataaagagacaaagatgtactattataatgttgattcttattgggcatgaattgttctttttaagcagtgatcacttatcacaaagacatttgtcttaaaatatattatattttaagacagatgggttcacttacctggattttttttatccttaaccattgcaaaaggaagatgttcatatgacactggtaacatgaataatgctctattacacttaatatgtcctttagagcagtcagacatacaaaagagcactcacatgtagtacctgtagttatggccattctgaaggtgtataatgggctcatagcatcgctgttttcagtaagtgccattattcatgattatgaagccaggtacttgcaatacatatgagaagaaattctccagtattctatgcaaaacatttgtattacgaaatatattaattctaacatatattaatgtactactacattcatgcacagaagaaaaaagagactgcttaaatgcctacattataccaccccaaaatatgttaaagctttcctgctgacaagctaaccatatgtagccagcatagagtaattaattctcctagaaaaatataacctagatttgtatgaataatgagtgtatctggcactagggacaggtaccttgaaaagatagagtaagtctatgatgtaatgcagaacaaagtgctacaagttcatgaaaatccctgacaaggcaaagtcaggaaatgtaacctaaaaacaaagctttgaacaacacttaaaaaaaaaattagatgtccttttcctattgttctttcttccaagtttagataaatcagtatttgactattattgagtaaatgtgttttaataaataaaattattgagtgggaaaagaacttgaaaggtcacctggagaaggtgcctgtctttagttcactatttagtcatatgatgacccctaggccaaatggttgccctttttatttaacaacaaaatatcatttaaggttaatgttccaagatctaaatcatggaatctatgataataacagaagggttacttttctttttttgaggcagagtctcactctgtcacccaggctggagtgcagtggcacaatctcagctcactgcaacctctacctcctgggttcaagcaattctcctgcctcggcctcttgagtggctgggattacagccatgagccaccacgcccggctaattttttgtatttttagtagagacagtgtttcaccatgttgttcaggctggtctctaacttctgacctcaagtgatccacccacttgggcttcccaaagtgctgggattacaagcatgagccactgcgcccagcccttttcctcattatttgaatcaaactttatttcttcaggtggaatcaaataaaaagggttaagaagggggaaaatatatgtatatgtaaaaagcccgaccaatgtttccgcatcctcaccacttctcatattctatcaacactggggatttgcattctgttttcctgctaagaaaactaaacttctgacttgtctaagactaagtggaaggcagaaatgaactatggtgctcaaataatactctgaatggcaacagaaagtcatttttaaaaatgagaaaaaggaaagggtaaatgaacaataaacataaaatgtaagctagttaataattagaatgctagaagaaattagaatttcatttttacagttatcctttaaatctattgttacaaagtcttggcaatataaattcacgaaacccaaatctgacaataatgagatgtaatctgaagatcaatccaaaaaaggaaaaatacattgatttcactcctgtttttcctgaaggcagggagcagtactcctgtaacccccccacacacagatgtcatatgtcagaatgaagagatgttaaaagcagtgactggtaaaaatcaagaagcaatatccagaaccctaagggtaattttatttcaaaattttgtttgttggcaatatatgttgttagagagggaacaacgtaaaaagacctttagaaaaatcaatgaactaacaagtattgactgggccccattcagtgctgtgaggggcacaggagccatagcagctgcccctgtagcccttatcgttgaattctttctgcctgtcttaaggagtataaagtcagaaaggtccccaggaagatgtaatctctcaaaatctcattatggttctatttttcacatataattttatccattattctataaggaaaaaaatcattttttacatcaactttgtttaacaccatatctacttctctttatacattttcttttataaatacaggttgtcagatgtttttttcccccgtcctactatgcagacttaacatggcacacctcagaaggatttattttttattcttttttattcttccctgaagttattatgaaacttcactgttcacttaactctctaacagtatagtaacctgctgactgggaagttactggcctcggtcttaatttataatactctaaaagcattagttcatctactttgtagatatcacattataagaaataacagaaaagcatttcaggaaggtgaaatgactctttcaagtcacctggctagtaggacccaggcctagagctaacttgctgctaatcaactgtccttaccactcagagcatcgcaatgtggaaattaagaaccacaatttacaaaccatctggaactcaagcttcctctgctatgttttctagtaggtaagaatgaactttaatttcttcacagtagttatcaagtaacaccctgcaatgagctctgcctgccacctgtactatctcaatatttcttaccttcctccttaatatacccaactacctcctattgtgctgaatctttaatactttttcagatctacttttgttgtctctccacatcagggatcccacaccagtaactgttagaaaacaggctgcatagtaggaggtgagcagcgggcctgagcgagcaggtgaagcttcatctgtatttatagctgctccctattgcttgcattaccacctgagcttgacctcctgtgagatcagtagtgacattagattctcataggagcgagaaccctgttgtgaactatgcacgcaaaagatctaggttgcatgctccttatgagaatctaatgcctggatgatctgtcgctgtctcctatcaccctcagatgggtccatttagttgcaggaaaacaagctcagggctcccactgattctacattatggtgagttgtataattatttcattatatagtacaatgtaataatagaaataaatgcacaataaatgtaatatggttgaatcatcccaaaaccatccccctgccatctatgaaaaaagtgtcttccatgaaaccattcactggtgctaaaaaggttgaggactgctgctccacactacactctccactcatactctcctattagctaattcttcagttctctatgggagaggtatgataagcaagaagaatgtgaaaaaacaaatgcagttttatgaaagacaagagaaaatactttgagaaagtaatgtgatctaatacatcacagaattaagacactagagaaaaaatttttgagcttgatttttctaatgatataaaaaatatctttcattgttaacagaccaatatgttcatgatctccagaattctcagaaaaaaacacaagttcatttcacttggagaaaggcttcaaaaaaaaaaaaaaagctattcaagtgacttatgcctgaggtaatactcagaatatcaaaactgtttttaaaataaatgtactcttacgatattaaagctgctatgctaaagttatttaagaaaactatacaaaaacaaagtacatatggtataatttttacatatttcataggagaaaggtaaagccaaggcttgtacaaaaatattaaaaggctaaaatgtatattcctccacttagtcaagaaataaacaattggctatagacattagagactgctgcacctttgtttataaatccttatcaattctggatcactaaggatttcacaggaggtccaaatgagttctgaagatactcaggatcatcaagtggtaaagctatgattggtaaagctaaagaacaaagagacttcctatttaatttggcagtctcagcacacagtcttaacacataagtttcatatctcttgaattaaaaagctggcataaaccccagaatcatattagtgtcttaaattcattcatgcccgcttccagacaatccccatcccatcgtagaaaaccagtgttttgatttcaatcactatagcttagttttgcctgttcttgaaatttatattaatgaaactatacggtaaacagtttatatagctggcttctttcactaaaaaaaaaaaaaaaaaaaaaagactgagatttatacacacgttgtataattcagtactttgttcctttttattaatagatttccatgcaagaatataccaaaatttgtgtatctactttcctgctgatggactttccccccaacccaccccagtttggagctatgtagtgagttgaattgaacagagacccacaaaaggtatgtctaaatcctaacctctgctaccttgaatgtgatcatatttggaaacagttttagcatacgtaattaaattaagaatctcaagatgaaatcatcctggatttagggtgagccctagactggagtgatacatctacccagaaacgccaaggatcgtgagtagattaatgaagctagcagagtggtatggatcagattctcactcagagactctggaagaaaggaaccctaccaatgccttcatttatgacttctggaccccagaaatgtgatagcataaatctctgttgttttaagccaccaagatcgtagacatttgtggcggcaaccctaagaaactaatacaggctattttaatactttcgtatgagtgttttcatttctattaaattagtaaaaaatatagtacaaatgtatacctaacctaaaacattgccaaagtgtttttgcaaagtaggttatatgattttatattccttttaccaacttatgttttattctagttatcttttatcttttcatgtttaggtccgtactccattcctctaattattcagtaaggtgtgatgcaggagttgagattcattttagtccctaagatgtatagactttacaaaactatttgatacaaagaacatcattgaatatcaaatgatggtatttttgtgggtctatttctaaccttctagaaagcttagttgtatatccttaagccaaaacttttgccttgatgttaaatcagtagtttaggtccaccaagtttgttgttctttaaaattggttttctatattctatgtcctttgcataccatatgaattttagaaatcatttgtcaatttctataataaaacctgctgagattttgattgggaatgtgtgaaattcctaggtcatgtgagggagaaatgaaatcttaacaataccaactcttccagtctataagcataataaataccatttctttacaacttctttcatttctctcagcaatatcttacagttttcagtagaaaatctgcacatatttagtgaaatgtatcccaaagtatttttagttttttttatgacattgtaaataatactattttaattacatttaaatttttgctgtttgtagaaaaaaataactatttttggtacactgactgtattctatgacctttttcaattcacatagacaattaggtcagctgaaaaaaagaaaaagatggtatactttctttcctctaatgtattcatcttttatgttttcttgttacacagactagtacattataatgctgaaaggaagtaatgcaaatagacacctttaccaggttctcaaccataaaagacaagtcatctaatcattcacccttaagttgagtataactccaggtttctcatggatgtcctttatcaaaatgaggaagtttccttctatttctagtttgttgagttttttcataaaaaatgactgaattctgtcaaatgcgtcttatttcgcatgtatttaggtaattatgatttttctcataattaccttgtatttttttatctgataatatggctaactaattaattttgaaatgtaaaaccaaccctgcattcctgggatcaattccatgtggtcataacatactctccttattaagttcagcaatatttgatgcaaaaatattttgttgacaacttttgcatctatgttcatatatgatattagtttctagttttgctgtagtagattcccttctttgattcctgataccagtagtttgagaatttggttgtctttttcagcgcttcattttcatttggctcaaaataattccttctttggcccaccggtaattttaaattaggttatgcaatttttagactgtggtagatgttctattattgttgttgtctaacttaattctgttatagacagaaaacataccctgcaagatatctatattttgaaaattactgaggcttattttatattcccatatggtctaccttggtaaacatttgatatgcgtttaaaaataatgtgtattttgcagttgttgtagatagtgttctataaatatcagaacaagttggatgatagaagtatcttgattttctaagaatttactgattttttttgtacactttttctagaatttattcaaagaggagtgttaaagtctcattatgattgagaatttgtatatttttccatttttttctgccaggttttgcttcataaattttgatgctcaatttttaggcatacatatttaaaatgattatctcttcctggcaagttattatttttgttattgtatactgatacttcatttcttataatatagtttgccttgaaagataccttcttggaaatacacatacccatgatatttttcatgtgctattttattactatttgttttccatatgtcctttctgcctttttccccactgctatgtttgagtgtttgtgtcccaccaaacataaatgttgagaacttactcaccagtgtgataggattatgacatggggcctttgggggtgattggatcatgagggcagagtcctcatgaatgggattagcaccctcataaaagagggtccagagagctgccttgtccctccaccatctcagaacacagatagaaggcaacatatatgaatcagaaataagtgggccctcaccagaaatggagtcggccagcaccctgatcatggaagtcccggcttccagaactgtgaaaaataaatttcagttgtttataatccattcagtttacagtattttgttacagcagccaaaatagaccaagacaacctcttttatcccttttctgctttgtgttagtcaagcaatttttagtattctatttcgtctactggcttaactatgcctctttttatattttctctggtttgtctaggattaatacatcttaatgtatcaatctaattggaattataaaccctgttacgcaatgttttttattacaaattttctttcaaaaaatcataagaaaaaaggttttatttactatttcaggtactcttcattactttttgtagatctgagtttccatctggcatatttcccttttgcctgaaggacaacttttagcatttcttgtagggtaggaattactgtcacaaactctttcagcttttataatactaaaaatgtcttcatgtcaccttatttttttttaagacatccattagatagagaattctgagtttacagggtatttttttaacacctttctgttgagcttcttgcattttaaactcttctgttgacttctgctgtctattacttctatgaagccagcaaaatcttttatctttgttttcctacatgtactgtgccttttatctttttcctcccctcaagatacttttatcattttctctttttctttggttttccacagttttactaggctgtgccatgatatctttttctctttatatttttcctagttgggatctgctgagcctcttaaaccctaagtttatgtttttcactgaatgagacttttttgtccattatttcttcaaatattttgtcagccacaatcttactctcttatcctttggggactccagttacaggtattttagactgaatgatatctacccaataatacctgctgtttattactttattcagtctttcttcctacataactaagagaaaataatcactataaaactgccttcgaatttcactgactcctctgccatctccaatatactattaaacccacatactaaaatttttaatttagttattgaacttttcaataatttctatatagcaattttttttatagttttcatttccctgcaaatattccttaattatgaccatgtttttctttaattctttgaagatcatttgctttagttctttgaacatatttgtagtatccttattttgtctttgcaagtgaaatccaaaacctgggccattttggacttctttttttcttgataatacatcccattttattattctttaatttttaattcaatattgcattcaatattgaatacttacttacatataaccactctcagttctgtaatatcccattgaaaactatttgttcttatttgagcagtcaaatcaatcactgggtgatcatcttaagttgtatagttcactataaactttgttagtgtagctctctggaaagtaagatttgttttcttagaccctctaacttagtgaaactcaatctccaacctgttttccctggggagttcatcaagacgtgctataggttttattagggtgggtctagactaggtctttagggtgtggccctacttcctaaagcaccagcttttccttatttgattgaatgtcaaatatgctaatgaagtgttaagatgatctctgtaatttggcagagccagaagtacaaagctgaacctctagtatctctgttccactctcaccctgtagcagctgctatctggctagtcttgctcagtgtatgaacactccagctcccaggcacagacacaagggagatacccacgtggactactggagttcctttctgcacaattccttccccattagtgctctgccctgtagataccagctgtttcactgccataaattctgatctttgcctcctcagctcagagaactatattctctgctagaactcaaatctctgtaatttaagtggaaaactgtcaccaagccaaaggctgagtattcatgaaacttttaagtttctgttctctcaagaactgcagcttttctctactggctgctcactgtctgaaaacagttgacctggatattttgtccagttttatcaccgttagcagtttatatatgttttgttatatgtattcctaagcattttttaagttttctgatgttgatgtcaacgtaatttttacaactttttactataatttccgtttttaaaatacaaaaaaaaaaatcctgtacccaaattaaacatgctgtccacatactgcttcacttaattcatcatattctttctctcttcttctccacatatatacatatatgtatgtatatatgtatgtatgtataaggtgctctccacaagtttttccaatgttaaattactgtttctttcctttataattaatagtttatggggagctgtttcgaggctatgtaaatagtatgtatataacctattttcaccaaattttcacatttgtatcaacagagatagcacactaactagaaaaatacagaatctactcaactttattaaaactgaactttacggaccctttcagaaacagcagtaccttcaagagcatgacataaaagtgcaaatgaaccagaatatatctacaataatttcactttaagccacaactgcaacaaaattgtctaacttcagtgatttagttccataagtccagcctcctcttttccattatgtttccaaaatagtcttacaagagtataggtaaagcaaatctcaaacctcataatgagatttgaagagtacagaaaaatgattcctaggcactagatgaaagtcagatctaaaagcaaccttaaaacaatgttgtttgcaaagtgatgaatcacaagagacctttttgcttataactacaaaatgctttaggctgtatttcaaatgaatgatgcatggctggtaattagtatgtgactataatgatgttttgttttgtttttccaaatgaaagaaattaagcagattgtgccataaaatttcaacactacatagatggtctaactagaaagcatcatgtttccataccaaaaaaaccccaaaaattatcatcaaaaaaaaaaaacaatctacaattctatgataaaataaaatgcccccactttttagcaggaatttagtggggaagtggggattttagattttaaatcccatataagaaaaagcagaaactaagaaaattttgaaaaacgtactttgaattagccatcaattcaagttcctgcttaaatattctaggtaattttttacctcgaagttaatcttcagctattaaaaataaattgcagaagcatttaaacagggaaaccactgctaaaagcaactttaagtacagtaggtacctatagcaaacagaaacacaagagtgattgccaccataagaaatgaagtatggccttagtgtcaaaaaagcatggttcatagctgagctgtaatagttaccggttgagtaaacaggtcaaaaagttgcctaatctatgtgatggtaatgcctatttctgcagttatatgaaaatgagacttaactttactcattcattgtgtatcaaatatttattgaacccttatttatgtgtcaaacactgatttaggacctgaagattcatattaaacaaacaaacaaacaagcaacaacaacaacaacaaaacaagaacctggtgcacatggaatataccataagtaagcagagggagaaggggagaaaaagagatagaaaaacaacaaacaaatcagatcattttaaacaaaaataaacgctataaataaatgaaaaagagggtaacatagatagagaatgatggggggcagcatcattataatgaaaacttctataaggaagtggcatttgggcccaagaggaaacagcaagaggaaaacctaaaatgagaacaagaaaatgtatatagctcaaacagtggaaaaggacaagggtagtaaaagttgggattaaagaaacagagactacattatcttataaattatcatgaaactggaaaccattagaagggtcaaagaaaaaactgaaagaattcattggcactaaaagaaatgttaaaagcatttcttcaggaagaaaggaagtgatttcagatagaagtctagatttataaaatgatgtgaataacactggaaatggtatataggtaagtagatataaaagactctttttaaaaaataaaaagacttaaaatttctttcaaaaagaaatactccaagtcctaaagcaccaataatatagcaaaacaaagaataagagtgaataagtcaaaaaagataacacagactcattaaaaatactcaatccaaaagaaggtagaaaaagagtagcaaagaatagatgagataaatagaaaataaatagtaagatgctagatttaaaccctgccatatgaataaccagattaaattaaaatggtctaaacacttcaattaaaaggcagaaatggtcagactggattaaaaagcaaaactcaatagactgcctataaaaactgtaggttaaaagataaaggatagaaaaaggcatagcatgcaatcactaatcaaaataaagctgaagtggctatattaagataacacaaagtaagtttcagaaaccattagagtatttgaagtttgtgaacgacataaaatctcatttaataacaagagtcagtagctgctatgtgaaaatagtatattcaaaacatgaagcacaggtcctgaaacagtaaataacaaatggcaaatacaaaaatacatatggtatgatgaaccgccatagcatcagcatctctaacattacatcttttctcaacaatattgttctaagattaataaccatattttattctactttaaatgtggctttccattgccatttcattaacatttatgaaacaaacacactataagcatggcaacccctgccgtactttcagaattttatttaacaaaagagggattatgagaattcattaaaatactataaatgtgatacttacattctagagtcacttggctaaatcctctgaacttgcaagtggttaattaactacatgttcaagattgatcagtggaccaggtaaaggtcagttagtcacagagtaaaagggaaagctggagctggggaggtaggatccaaacaaaacacaatgcagtcagatccctgaatgcaattccagccagctaatggttttatatctatctttaaaagcagacataaccagtagacattaaagttcttggtggtcttctagggaggcagggtcaggggtagagatacagacagtgtgacacaggaaaaagccctctatgttgcagattagtttattcaaaaataatgaacaagagaacctttttctatgatatttgctaaccagctcatatttcgaacaataactctgcccacatactcttaaatgactaattccttgccttaagtttaatctatgcgattttacaattcttgttttttgctgatgccaggatattaatgacaaaagtgtttctctatattccaaacataaacccattaagaacgacagcttgctgtgtttcttagtattgattgtatgcaatttttattctttgtttctacgttaggacaagtaaaattcattcagggacttctaaaaataaattggtagcctttcaataattcatctggtatttgggttatgctttatttcaagccattgatttggtgggtgcattttgggagcattcagatcaaatcactgtgatacattttttttcaggcaactcctctgcccttcagtaataaagtatacccgttgctattgtctgaggatatcagaagggccaggtctgtgatctgcaatttaagcagaatgggagatactaaaatgtgggaagacaaaggaaaacctactgaagatgggacatcaggtggcattcaggtaacggacataataaaggatgaggctataattaaggctcgtgggcataaaaaaaataggcagaaacctgcgttttaggaagtacaggttgaggaaacagtggtctctaactgctaagagagatcattaatgaggccagcagtcaaaatcatggataattccaaaggaagtggtaataagaattcagtaagaagtagctaagaccacagcagacatagtccttcccaggagaaaaaaaaaagaaagagagaagaaaaggaaagaagtctcccctgcccccccacccctcaaaagcacataaatagaatgagaatagaacagacaattgagcagtaaagaaaaagattgtcatgaagctaattgaactagttttctcttaattacattaaaaatatgaaatgtttttggaaattctgggtcagaacttaggaaaaacaaatacagtgtcaaggaaacttataacaatattaagctgctggaaccttaaatcttttcagaaaatactagcattcaagtgatcagaatgatttaggcactttactgtggctagtgattccaaggagagctacttaaaaaggaaacattgataaaatagggtagaaagactccatttgtccaaaacataaaacttcagtaatgccacatagcttaccataagaagatgacacataatgctacaacaaggaacaaaatattgacagaataaaaactgacctaatgacagtttcagcataaagccacaaactgagaacccttaaacaaattaaaatttatattactaagttttgactatttaatgcataaatgtaagtcaatatactgtaagtgggacagtataaacacaaaaaaaggaatttcctaacatataacaatttgaacaaattcctagattttccttggacaaatatagtaaatcaaattatttggtagtggtgatgctggtggcatataagttagtgctagtgtttcactaaacgggaaaaaatcactttggctattcggtatccgctcttctaaataactgtaatatctagacttggatataaaattggcatccttggaaaagaaagaaaaatagcagtaatggaaaatagcagacttgcaggataggaaacttgatccaatgttaaaggaaaaaaaaaaaaacaaaaaaaaaacacatttatcttgtgaaaagagccaagtctggtatggaagacaaggatgtttaatgacgcatataatttaatacaaaataaaaatataagaaaagcgaaaaagggaagaaaaatcaactcagacaaagactataattaaccaaatacatatggggccaaaacactaccaccctttgtctcaggagccacaacgtgaatgaagttaaataaaactgtttaaaagttgattctgagtatctcagagaaattttcaagtgcttggcctcagattgccagtttccctgttaagctgaggacagaaaatggagaaaggcctactcaagagaagtcagtggtcaggccacaagaataatgagccagacgaggtagtcgacattctagaagtgtacacattcactgggctctttaaggatggacaggggaatcctctcccatttgggtcttttatttctgaagacagaaaatagggacaagattgatcctaaacaaaaacgtaaggtaaactctatttttaaaaacctttccctttgcattcatttacctttttcccacctcctgtgtgcatctaattctttgccaatatatcaagaactctgtgcctaaaaacaacacagtgtggtggaaacaaaatgaaatatggaaatgtaagtttagaaatccgcagtttcaatctttctcttttgcttatggcatgtggaggaggtcttggttaagtagtctattctatatgagtttctgttcttataaccctgaggagctattataaacaatatgtcatatacatgtatataaacatactttgtgaactgtaagtcactaaataaacttcatataactgctatgtaattacttgtctgctctatagtggctcatttgatgcgatattatgccattaacctgaaactccaaaattcacctctctccccgctccctttatccaaaccatcatcttttgagtatcacaagtcacagataccatattttaaaagttaatcagactaaaggaatgcagagtaagattttaatctcctctaggtatcctaaagcattatatgatttacaaacagaaggctgacctgatgttttataatatctcaggtagttacatgaactgcagtatttttggtgggggaggcgggggtggaggcaggggggtcggtccttgaacatacttccgtaacaactattaggctgttattatacacaactcgttgattttaatttcaggggattccgagaaatccgggatacctagtcagagagttagaggtagaaagcttttaaaggctcatatttctagccccaacatgtgcaactaatatcagaagagaagcttattctaattacttttttagtaatttagattatactcttgaaacccactgtgttgaaaagaaaataaataacccagcactgtgtctcaatatgagatctggaagtcacaataattgatcacactgaaatgctcatcagttagtatctacctttatgtcaacccctatatggcatcccctttgctacttttcactgcaatcaattgtgtctacttgaaagccaaagtatagaaagtctggaaggtaaaaattgctcaaaaagagttattaaaaaaattatatgtgttttataaaatcattgagaaagaagagggtatcaaaagaagagagtagaggagagcatctgagtaagattcttattcaagtgttagaagatatgggaaaagagtcagggaggagtcagacattagaagcacaagggagccaggaaagagaacaaaaagtagatataattaatagggtgaaatgctgaccagaggtcaagaccacacaaaatgagaaatgaaaggacctaagctgaatctggaattatgaggttgtctatatcacaaagagaataactctacgacagtgatgggaacaaaagcatatacataaaacatgctaaagaatcgtagaatagtgagagagaaaattcttaatgtaaagtggaatatagttcttaaggaaagtgggtgctggccgggcacggtggctcacgcctgtaatcccagcactttgggaggccgaggggggcggatcacaaggtcaggagttcgagaccagcctggctaacatggtaaaaccccgtctctactaaaaatccaaaaattagctaggcatggtggcgtgcacctgtaattgcagctactcgtgaggctgaggcaagagaatcgtttgaacccagggggcggaggttacagtgagccaagatcacgccattgcactccagcctgggcaacagggtaagactccatctcaaaaaaaacaaaaaaagaataagaaaaaaaaagaaagtgggtgctgaactggatcacaatagatgagaagaaaaaagtgtaaaataaaaataagagaatgaaggctgggcgtggtggctcacgcctgtaattccagcactttgggaaaccgaggcaggtagatcacttgaagtcaggagttcgagaccagcctggccaacatgttgaaactccatctctactaaaaatagaaaaaaattagccaggcatggtggcacatgcctgtaatcctagttactcgggaggctgaggcaggagaatcatttgaacctggggaggcagaggctgcagtgagctgagattgcaccactgaactccagcctgggtgacagagtgagactctgcctcaaaaaaaaaaaaaaaaaaaaaagaaaaagaaaaaagaaaaaaaaagagaatgataacagcagctaacataattgggcatttgctatccactatacactacacacatgcatgctctcctaatctcaccacagctctgtgagacaggttctatattcacgtatattttaacaaacaaaggaaatgaaattgaaagatagtaagaaactcatacaacgtttcataactagatgtggtaaattcagaattcaaacccaggtcttcacaatcagattagaaacacaaggaaggacagttgaaggtttctggaatactaagacaaagttttttttaacccagattcaagtctcagtactaagaacatattgccaggcaagcctcaataagccaagagctaaatgattttagtttttcatatttaaaataaataaagcatctgagagaaatttacttattcattcatcaatatttattgtataataccatatattgtttgaggcattaggaattcacaagtgagtacctgacagaatgattcctgccaccatagatacttatggcaggctaactaggttagtggacagagcgtaatacagtaaatgagaagccgatgagtactagggagaaaaataatgcagtgaagaggtgtaatggttaatattgagtgtcaacttgtttggattgaaggatgcaaagtattgttcctgggtatgtcttgagggtgttgccaaaggagaagattaacatttgagtaggtggactaggagaggcagacccaccttcaatctgggtgggcacaatctgatcagctgctagcatggctaggataaaagtaggcagaggaacatggaaggactagactgacttaagtctcctggcctccatctttctcccatgctggatgcttcctgccctcgaacatcagactccaagttcttcagcttttggactcttggactgcaccagaggtttgccaggggctctcaggcttcggtcacagactaaaggctgcagtgccagcttccctactttcgaggctttgggactcctactggcttccttgctcttcagcttgcagatagcctattgtgggacctcaccttgtgatcctgtgagtcaaaactgcttaataaactccctttcatatatacatctatcctatcactcctgtgcctctagagaaccctgactaatacaagaggaaaagaagtattttgagcaactgattatgcaatttcaaagaaggtgcattgagaagacttccacaaaggacctgtgaaaaaagaccagaaagaaatgagagaacaagccatttgaataactggacaaggcaaggtacaagtgagaaattctcaagaatgtgactggcatgtttaggaaacagtatagaagccatatgattaaagttgccttagccagggggaatggtagaagatgaggtaagaaataccaaggcagggacaaattatgtagagccttgtagactactacaagaattctggactttcctctgaggtgggaagtcattgtagggttataggtaaaacagaacattatgtgactgaagtcgttggctgttgtgttaagaatagactgtgttaaatataacttgagatgctatatcaaattctttcacaaattttacatgcacgtgatataaaacacaagcaaaattttgtaccttttgccatcaattaaaaagaagagagatcaatataagtcacagttgaaatttcaaactttttgagaaactcacaagttattagcagctcaaggaaatagcatattattctgatcatgctgggtttttattagttctaataaattaaagaattgcagagttatttaatatagctgacattctactaatttcaagggaaaaagagtaacaaaagctcataagagaattcattcagagctcaattccacttatcctcccactctacagagaacacaattggcagcatgtgagtgattttttccctgtaatggcaggatttgatattactattttgatggagatttgaactaaataagctcaatcccttgattaaatgagagttattttataaaggaatatgcctgcacacttctggcattttaactttatcttagttcataatacaggaactatatatttattatcatgatgtattagagattattccattttcttccatatgagagcaaggtctggaggcaaaaagttttttttctttcactgcacagacacacgttgtcatggccactagcttctttctaaatgtccctgatgaattatataccctacaaatgccaaatatccctctcaccccaactcatggttagtttttgaaacaaactgcaatagtgttatatataaaatcaccttgtacaattccctaggtaagggattgcaattgtcctttgagaggtgataaccagcagcaaaaacaaacaaaaccttgctgatgatgtgcccctctccagggagaagactgagaaaaacagtaaggtttgcatatttcaccttgcccttcactgcctcttgtgttacatttctaattcactccctcagtgatttcatccactcctatagctttgtatgtgacctgtatgctattggcttccaaatttataactccatccctgaactcccagcttatacccccaaatgcatgcttcatatgtccactaagaggtcaacagacccttagttatcttcccttccataatctgcttctcttgcagactttccctcatctctataaatgggaactcttatctaattttacagcctaagaacctggagttattcatgattcctcctatgccccaaatccaatctgtcagaaactctaattcactattttcaaaatcatccagaatctacttctcaccaatgacactgctgctaagcctgtcaaactaccactaattcacacattaataatgagatcattgaaatagcttgttaaccagtcactggctttaattatattcctcacctcaccctactatctgtttctccatatagctgccagcataacacttctatggcatcagtctgatcatttcacccctttgttaataactcactaacggctttcttaaaataaaatccataattctcacactatggctgcaaggccatgcatgatcaaggccctggtggcctctttacaccgtctcccaccttcactctgccacagccactggcctcacatagccaaactcacttatccctcaaggccttgctgtttgtggtctcttctgtctataacatgcttccttgagatatccacacctctaactaaagtcactccggcttctgctcaactcttacctcttcagaaagtccttcctaaccacacaaattgcacacacaaacacactcatcctaccacttcctgcagagcattcactactatctgatattacattattatttatgcatatattgctaccatccccaataaaaatatatgacaaatagggactaagagaaggatcatcacatttaactcagagtctgcagcaatacctagcacacagtaggtgttcaataaatatttgtcaaaaaatgaataaattattgctgaatcaaggagacaaagtatttgaagaaaatttatcagacaatggtacagtctaccaatacaaactcaaagtctaagtttctccaacaaaatccaagtccctgaaacatccaaagactgaaacatacactactggaatagttgctaccaggaggcattccccaggctgaagtgcagtggcacgatcttggctcactgcaccctctgcctccccagttcatgcgattctcatgcctcagccacccgaatcatctaatgagagtgcaaataaaaatgtacaaagttcttaagtatacccaacctatcagcagtaaaagcaatgttaagtttcaccattaaaaagcctctaattttccatgaatgtcactatatttggttaaatcaatgaatcagttacacattattttgactgttaaacatgtaaagaaaaactgtgtatggttgatatggtttggatttgagcccccatccaaatctcaagtcaaattgcaatccccagtgttagaggtgaggcctggtgggagatgactggatcatgggggtggatttccccctttggtgctgttcttgtgataagagttctcaggagatctggctgtttaaaagtgtgttgcacccccctcccaccttactccttctctggccatgtaagacgtgcctgtttcccctacaccttccaccatgatcataagtctcctgaggctttcccagaggctgatgttgccatgcttcctgtaaggctcgcagaactgtcagccaattaaacttgttttcttcataaattacccagtgtcaggtgtttctttatagtcctagcactttgggaggccaaggcaggcagatcccttgaggtcaggagttcaagacaagcctggccaacatggtgaaaccccatctctactaaaaattcaataaatttagccaagcatggtggcgcacacctgtaatcctagctactcgggtggctgaggcatgagaatcgcatgaactggggaggcacatggtgcagtgagccaagattgtgccactgtacttcagcctgggcaatgaagtgaaactgtctccaaaaaataaaagtaaaaataaagtgacaagaaaaacaatgactgaatgcttatcttaaaagatgcatacctctaagatttaaaatagctagaaatatagttatgaaataatagtttattatttcaaaccaatgttctcactgtgtaatgaaagatttccagacaagattaccaaatggccatctaaagcaccatagaacttgagggaccttggacaactggacaaagcagtagcagtggatgaatggaacttctcttttccaggaagagaagacagtagattctgccaacttcagactgacacaacttatgtaattgacagacgagatcaaagatgaattattaaacagaaaaggaagtagtaattacaagaaaccaaaatgggttcttgaaaaaaattatatcagagtaactgtatgtctttgttaggagactgaactctgggaaacatgattgattttgtatctggacatttgcaaagctttgaaatattcaacacctaaggaatgcaagaaagacttggagatatttagtctgggaaagtgttggtttggtggagatatcctttcagtttcctcacctatcttggtcaatgttttttataagtgtttcagtaagccatgattcttataccaaatcacaatttcctcaacatcttttatgaaataaaaccactaagtactaaaacaagtattgtatagagtaccatgagtagtcacactcaaaacaacatggccttctgagttaaaaatcaggaaaacgttcaatctaagatgttgtactagacaaacctagaagttaaatggcaagatcacttagggtttaagttctattctttaaaaaaaaaaaaaaagtgtgaattatgcaccaagttattgatttcttggtctacttttgaattaacccattttcactcatagagaaatcatctacagattcatttttaacaaaaaaatcaaaaatactcaaaatgatttttaaaaacactgttttcattttattgttcttgctatactttttccatcctttctgttcatctattctttatttcatacattcacttaacatacatgtatatgttatgtggcactatgtgtcagtagatgtgccatgtgctgggaatagaaagatgagcacaatacactctagcctgtcaaaaagttcagagcataaatgaagactgtgacttgtaaaataacacttatattccagtataatacaagccatttagagatatgcacagagttctctggtaacaaagaggaaagatactgaattttgtatagaatgaagtgttagggaaagctccccaaagaggcttcctcaaaggggaaagaagggaaaggcagaatattgacaggcttgagcatgatgctttcagagctcaacaaattgtctagcaatgatgaggcagagagaaaaaaagtaagataggaggtagaaggggaatgttaggaactgcttcatttaaagacgtaatgctgggtgggaaggacgggattacagatgagcctgaggaaacatttaggggtaatgggtatcttcattatcttcattgttgtaatcatttcatggatgttttcatatgtcaaaattaatcaactgctgtactttaaatatatgccatttattgtgtcagtttaccgaaatgatactttttttaaaaagttttaatgctattctaagaattttgggtaaccgtgtgaaaggctcggggagcaactgaaggaatttagagtcagtgaaacatatttaggggcatttcattctccattttacatctttacaagatcctctatttaatcaaattaaagaattaaccaactgctattttccatgcacctgtcatgtacaaaggaccaatgcgtccctaaaaaaaaatcacatctctatcgttaagtgagttatgcagatcttcattttaattcacttttaaaaccaaacttcaaagatgcaagatacagcagacgtcataaataaaaataaaaagacaagtaagaggcagtgagaaaaattgcaaatatttacaagagtagcgctatagaacatataaggagctcttacaagctacaaggcaataaaataggaaaataaacaatattaataggcaattctaagaaaaaatataaacaaccaataaatacataataactgcttcgatctcatttaataaccaagaaatatgaaataagtaaaataaaagtcaccaactaaaaaagaaaaacaatattaatgattatgcaaggaaaagaatcctcacttatattattcataaaagtgtaagtttggccaggcacggtggctcatgcctgtaatcccagcagtttgggaggccgagacgggcagatcacgaggtcaggagatcgagatcatcctggctaaaatggtgaaaccccgtctctactaaaaacacaaaaaaattagccgggcgtggtggcgggcgcctatagtcccagctactcgggaggctgaggcaggagaatggcgtgaacccgggagccggagcttgcagtgagttgagatcgcgccactgcactccagcctgggcgacagagcgagactctgtctcaaaaaaaaaaaaaaaaaaaaaaaaaaaagtgtaagttcacatgccttctggaaggacaatttgacagtaactagcaagattaaaaaggcctttcaatttagcaattcaaagactaagtatgattgtgagatgatttacatctcttcactctcaatttatttaatcctcagaacaatacaatgtaggtaggcactattactgtccctgttataggcaaaataacggtccctcaaagatatccatgtcctaatacccaaaacttttgaatgtgttgctttacatagcaaaagagactttgcagatgtcattaaggatcttgagatggggaagattatcttggattatctgggaaggcccaatataatcacagggtccttataagagggaagcaggagggtcagagaaggggttgtgatgccaaaaatagaagtcagagcaatgctgaaccatgagccaagaaatgctagcagcttctcaaagctggaaaaggcaaggaaataaatttttcccctagagccctcagaaggaatgcacccaagctaaaccattttggactattgatctccagaattgtaagatcataaacttgtgttgttttaagccaccaagtttgtggtaatttgttatagcagcaacaggaaactaatatagtcctacttcataaataagaaaatggaggtatcaaaaaatgagtaacttccaaagatcatatagctaggaagaggtacagctagaatttaaacccagacaatgtgcaatactaatgcactgccttcaaatacaaagatgtatacagaattattttttaaaaaacctgaggcacggagagaaactacaactaagtgtccttcattaagagaatgattaaaaggaaaaatcataatatgggctatgaaataaaatgcacgaatttaaaaacagtacaacatgaaaaacatattcaaaatatatgacacagccaaaaagtttcagaacaatggattttttaaaatgttcacgtgaacatgcatacattggtaaatacacagaaatggaattagaagtacaacagattgttaaaaatgatcatttgtgtggaatgaaaagaggtagtgggatacgggggacatctacattgtattcaatatttctatgttatttgaatgttttacaacaagaatatatgatgtattttaaagcgagggatttttaatgcagggagatatgcacgaatttcctacaacatttttcattaaaaaggcctcagctgcacaaagtttaaaagccctgccctacagtgacaccaaatggtggtagatcaaaatacagcacacaaacaggacatttgttcgattcaatcttcctataaatgtttgatttctttgaagaacaggaagcttaacagaattaaataacgtggagacaaatactcaaaaacctagaatttttaatcaaagaaagtctagtacaccaagcttcaactgcaaatttttaggcctctttccaaacttcagctaatcttctgatcccactgaatatttacataaatcatttctcacagttaaagcatgccactgtgaacacagtgattttacctaatagcttattgatcaaagaaagcctacaaatacaagaaatgcagtcataaaactaaagtcaggctctactccatcggaatcaacccttggtaagtaggtaatattttggaaagatggacgagaaggtgttggggataaacagggatggaaagaatccaagaagagacacaagcaatgactccaattaatgacaaagtatattttcatttgttaatctagtgatagaaaattaagctgagtaaaagaggaggctattgcctctcaaatatacaccaatttctccacaagaaaattttgtcctggactgtccagggaaaagaatatttcaaattaagcacatcagtcagtattcagtgtcctctgcccagaacctaaaccaacaaaaacagcatgtaaatggccttattcattacaagccactataaaaagatacagagatagaccacctctcagggcactcctctaaaacaccatttggccaggatccttagtcttttagcattaaatgagagtttattggatttttgatgtgttacttttcatataccaaaatctcctagaaaacacaggacatataaatatatgatcatctacaaaaaaaagtcaataatataattaagctctaaggccttgaaatcatataactggatttcaatcctaataggtacaagccaacttacgaccacatgttaccagcactactttaccccactcatggataatcagctctagaacaccttgagagctatcctgatcaaatgagtgcatgtccagtgacaagaaccacaaggagatcagttcaagaaggtaacttaagtttctgaattactatataagtgacagatgaacaactaagaactgagtaccacaaaaagtatccatgtctactacatatacatttatgacttaattagaaagagaggtaatatcagcattaaataattttgcttccaatttcaacagagacataaatatgaacatgaaagtctatattacagaaaatgtgaaaaattaggcacatcacatggtttagtggttagaagtttcaaggatatacaatttaatagaaattgacataattcccacagtaaatttgtataccatactctacaggatatagagccctagaaaactgtatctaagtgatacatgataaaagtaagacatatggccgggtgcagtggctcacacctgtaatcccagcactttgggagatcgaggtgggcagatcacaaggtcaagagatcaagaccatcctggccaacatagtgaaaccccatgtctactaaaaatacaaaaagttggctgggcttggtgttgtgcaccaagctgtagttccagctactaaggtagctgaggcaggggaatcgcttgaacccaggaggcggttgcagtgagccgagatcgtgccactgtactccagcctggtgacagagctagactctgtctcaaaaaaaaaaaaaaaaaaaaaaaaagtaagacatttccagtatacaaactatttctgatatatgctaattgaccttaattgacattggttactaatattttagatgtcttacttttacaccctgcctttctatcaaagaggaaaataacataaacatcaatatcctggtggagctacatcttatgttttttaactaattcttatggagaattaaagttgattatataatgcaagcaacttgactgaatttaatctactgtctcaagttagggtatcagtttaaataaaacacaacctttcagaaaaaattgtaattaatatgaatcaaattaatgaattcacataactggataaaagaaaacttaaacttagtggcaagtaaaaactgtagaattttaactaatttttgttcaaatgaaaatgctagaaatcataacatcagtctacggaacctaaagatgaaagagttaagagctaatttttctacagtgaaaaacaaatgaaaagtcaagctttggtcctatttggagctgggaaagcactaacactaccccaaactcttgactttttcttatatctaactgtgtgatgatttttcaggtaaagatgattagcacatttctaatgtactttaaatctaggctaaatcaagaagtaaacatgtttttaaggcaaggatgtcttgtagaaatctggagtttaattcacttcaagttaattgcccatttttgatacaaacacttcaaaaagtttattactttaaaaatgaaacattattatggaagtcttacagaaatacacttggcaattataaccaatttcttaaaatcatcaaattactgtattattgataatgttgataaactgaaaacacatcattctttagtaagttagcaaaggtttttaatctagaaaggagtacagaaaatttcagacattccagactgtctaacactctttgtccagtattttgttttttttttttttggttaattatcaaggattgtttggagctttaagcaggtttcccacttctctttggagagcaaaagttgagaagtagtagcagccagattggaaatggtgaaaaatagaaatggaaaaaggtaaaatctaagaacattactatttgacaaaaaataaaataaaaatatttcattttgttcctcaactttcattctgatttttccaccaatacaattaccttttaaaatattagtaccacagaaaccagaaccgaaaacaatttgttcaagagtatattgtcataatcaatagatgactaaggcattgttcatattgtctgtagaggatgtttttcaacaacgttattccttccaaattatattccactggcactcaggtatgacccagcatggaatgtgtacattccagattaagtttgagttgacatgtcctgaaagggaagtggtccatcaccatcttaaaatcaaaactattacctctagcattggtatctgggaatccagttgttttaactgctgatccctaaaagtacactttttgtaaatcaaagctctttgatgtgaattcttaatttttaacaaggcataacttggctattttaagtaaattgaaaatatctgcaaatttgagcagtcttcttgaatcactagaacacagaaatagttttaaatctttactataatggtaggcaacataaaaagctacttgttagatagacattttcatataaccttgcatggtatcagatttaatgtacatggaaaatatttcaaaattgtaattttatatattattttaattcaagtgtcaaaacataggtaaaaaaaaaacactctaaatagtctgtggttaaaaatgtaatgcaaattctcccttattcacctattctcttatggaagacatggcaaatagagtatcaaatagacaaactaaccaaataatagaaaagcaagcaagcagggaaataaagaaaaaagaaaggagacagaaaaggggcaggcggggaagagaataccctgaagaattggagtaaaaagtaaaaactttttttgttttcttaaagacaacgaatttaaaagttttagaaaaggccgggtggggtggctcacacctgtaatcccagaactttgggaggcggaggcaggcggatcacctgaggtcaggagttcgagaccagcctggccaacatggtgaaaccccatctctattaaaaatacaaaaaaatagctgagtgtagtgttggccacctataatcccagctactcaggaggctgaggcaggggaatcgcttgaacctgggaggcgcaggttttggtgagtcgagattgcaccacttgcactccagcctgggcgacagagcaagattctgtctcaagtatttaaaaaaaaaaaaaaaaaagttttagaataagaattataagactgtgaacaaggaaaatcatgctttttccttttgtgttctatttggagtttttttttttttaactttggtggtagcaaggagtagaatgcgtttatgaagagataggaaggaatgtaaaagcaaatgtctacaacatgccaaaatatgaggtgcaggcacagctattaagtaaatcaacctgaatttttaaaattctgtcaaacaaatttcatcctggccctggagattattaatataactgaagatgaaagggaaaaaataaacaatcttattagagaaacaacactatagtattgttataatgacaaagtgtaaccgacctaaaaataataatttaatggtaggagaaaagagcacagaaaagaaatcttgataaaaatcttaaaattttaagttgtaatacatttaatatatggcattggaaattcttttcacctctttagaccccagcttctataaaataaaaggctggagcaagatgattatcaaagattttctaaaatgaattcatttttcatcctcattgccaagaaagatactatatttataatttcggtctaaactacgagatgaattcaagtaagtgatcagaacaagaaaccaaagctactcttgcaatatgttggaatacacagctctagaataaatcacaaatatacctctctattcttaagaagtacagtttttactttacattttaacattaaatagagagcaaaaaaattatacatacaattttcaaaagccccttggacttcacttaatgccagagtttcaatatatattttaaatcaaggtaatttcacatgaatatccttaagttaaaaaaaagtaagatggatattaaatgtatgtgattactcacatgcttttttacatttagcgatataaaaacagttgacaggttctcttgtttggcacagtataaaaatcctctctgagactcggtacttaccacaaccacaaactgctcaggttcacataagttgctatattcactcttgaactgagacaatgaatttaattgctcttgatcaggaagatgctttattaagttctaaaaattaaaaccagaaagaaagatcttcactaaatgtacttcttgaattttaaaaatataatttaaaaactactgaaagaaaaccagtgaagttaatcttcagttttatttctaggtaacctccctcctaataagccttaagcaaaattccctgcatcttgaaaacagtcaattttccatttctctatcccagagttattatatattcaaatcaagcactactgaaactgaatgtttatttgattagctatataattgagaaagagaactcaacctataccaaaggaacagctttctcacctggatgaatgtgatccattacatttcagctttagggaattaaatgtcagaaatttcaggcaaagccaaacatattttaacacttcactcagggggataaaagaaatcatcatattgctacaaaaaggcatgggaagggacagaatagaaatcaagggaattttaatggcagtgcttgcaagatttaccaataggattacagttttaataataaaaactgaagatatctctaaaacaaactaacttttctgatgtgaaagaaaattttaaaaggtgttgaagacacatgatgattgatataccttgcagataaaaggcatgtagaggtcctttagaaacttaagtaagccacacacttaaacaacagaactacttgaataaagattaaaggaatacacaagactatgtcttcctgatacaacttaaatgattaaacaatcccttggacaaagtctatatcgatcctctgtatcaaaatacaatcaactataatagcgttacaagaagttagtgcattgatattaaaattaagataaaaaagagtggttggtgctcacaattccaaattacagcatgagtaaattctgtacaagcccaaagttgaatacaaactataattaagcctagatcatgctatatatatttatggggggaaattccccaaaggtgttattagttaaaaatactgttagagaatgttatacatcaaaatcaattagatcaaagaataagttattgactcactgtgtacctttggacaaaaacttggttaactggccaaaaacaaaacaaaaaaaaagtggcattttaagatcatccctagacaaagtattcactattaatactatcaaattgaataaaaataaaagtatatgatttccccacataaatagaaatttctcttagtggaattgcttgagaccaaaagacatgattatttatatttttacccattctagttgacagctggattgttagattttattacttcaggcctctgaatttctttagcatccttttagacaaatccccctgaatatctcatatataatcagattttcatctttcacctgaattttttaattttttcactccattaattttacattctaacataaaaatactattgtgatttttaagtgcgtggttccaacctccctttgtctctccccttacaaattccccacacccttcgcaaatcttaagctactgttcagctaaattctgcacagacaggcacgcatgcccagcttccctcacagcccacagtattattactgccaaaacaattgcccttcactacatttttcatgcaactcctctgctctattctacatctatacctattcaacatttacatacccttgcctccacacatacactcacaaagcatactccctcaacatattctataggtctaaaccaatcttaaaactttgcttaccttgctttacaattatgtatgtaaatgtcatttcccttgtcaaattataaattccaagaaggtcaagtctaattcttattgagcctaatatacagccgggcatggtggctcacgcctttaatccagcactttgagagaccgaggtgggcaaatcacttgaggtcaagagttcaagaccagcctggccaacatggtgaaaccccatttctactaaaaatacaaaaattagctgggagtggtggcgggtgcctgaaatcccagctactcaggaggctgaggcagaagaatagcttgaacccaggaggcagaggttgcagtaagccgagatcgcaccattgcactccagcctggttgacagtctcactctgtctcaaaaaaaaaacaaaagtaataaaacataaaaattattgagcctaatacaatgccctggacatgttgcataaaataaagtatatgaaaaatgaattaataaatgactgatgtgacaaacaaaggtaaatgggtaaaaaatgatgcagaaaagtggcatgaaaaatggcaaaacaatgacatactgctgacctgtacatatatatgaataagtaactaaatatgtcaaaatataaccatcacagtgaacacagagaaccaaaatcatgattattacaacataaagctctgtttccatgccctggtcaaaataggaattcttcgcattaaaatgaggaatatacttttaaaattaagagttcaaatagcaagaaattcttactttttaatgaatatattaaaaccttatatatgttcaaaataaatttttacattttagaaatacccaaggctggttttatatttagaaagtatgataggcacaataatgacatccattcctaaagatgtacatgactaatccccaaaacctatgaaaatattaagttacatggcaaagggaatttaggttatagatggaattaaagttgctatcagctgaccttagagtggttatcctgaattatttggatgtactcaatgtaatcaaaaagttcttataagtggaagaaaaaaacaatagagttggacggagatgtgactatgagacaaaggaattgaggaatgcaagattgctggcttggaagatgaaggaatggttctacaagccatagagtatgagcaaccatgagaagctggaaatacaaacagattcttccctagagcctacgaaaagaaacacaggtcattctgccaatactttgatgttagcatagtaagaccaatatcagacttatgttttacaggaatgtaagataataaatttgtattattttaagcaaataagttcttggtgaatgggtatagtacaaataaaaaactaatacattacaaaatatatggagctgaatgtactttggacatgaattttaaaaagcaaatcatctcttttctattatataacaaaaccacatgttcatttaaaacattcatgtaatcaagctaaaagctactctgtaaatatttaactaattcattataagaaatacaaacaagtattaagtagaaaaattttatttaaggaagttggcatctattcctagcaagaaggcacacatataatcaacatgaacgaagatgaaaatccagtaaaaaacaaactgaaagagaaaaaaaatgcttaaataagagtagctgaatcaggtagtttatgagtctcagcgactcacagcacaaatcactagtgaaattatatgaccactacatttagaagacaagataggaaaggcaaaacttagaacaacttccaaagatatcatttattgattagttaaaatattcagaataattttaattgcttgttggcactaataaatatttggtttctttttattgctaagtaatcattttcctaaatatatccgctatcagaacaaaagatggtaagctgaagataatctctcactatataatttgtgttttgattctccaactttaaattttatcaagatatacattattgatttcttatgtggaactcagcaataacttcgacatgatgctagtattcatttgaaaatactatgaataaaagccattaacaaaaatcttctagctttctgaataaattcagaatactatgtaaacaatctctaatactcataggagcccaaatgactctaagaagaattgttagtaaaggtaactgtaattgaaaactccctcaatcttctaaaccatataataatatcttcataagccaaagaaaaacacattctaaaagggctatagaaacaaattttaagtaacacattaataaagtataacaaaaacaaaaatgtaaaattaaacaatttgcttttcagaaacaataacttaaaatacttaaaatgtaatcatttgatagcattctatttcatgtgcagttaagagaagatgcagctttctctcctggcaatgcagaagttatgctaaaactaattatgcagcaatgattttccagttgaatgatttgggtgaagaattttgcttcacttacagatttctatttaatgagaagcttgcaatgaaatattgaaatttaagctgtgcctgtttgtttacctgaatcatagactctgccaaccgtgtttcatctacttccaatatcatcattctgatttcctcatatggcacccgaaaagagctcaggaagattgctaagaaggagaaagagagaaaggtttataatgaataaggtttaaaaaagtatttcagatgtagttctatttataaaatcaaaaataaattcataaaacaagagaattcaaacatttaatattatgtttgggggaaacatattatgggggaaactttcattactacattttatactcttctctagttttagaactagtgtttaaacaacagtcctgtgttattgcactggatccaaggttgatttttaaatgctcagttatttatctaccataggaatgatgtcaattttcatgtgataacaaaaaatgaaataaggtacactataaaaacatcacattgtaatgaaaataataagaaaaccacagtatgtgcatgtaatatttgtctaagcatatgtattatttgcttgtatctcttctagccttaggaaagagttcaggaaaaagtattttaagaaaactgctaagcagtacattaacacttttacaagtaatagtagcacttcactattcagaaacattgtaaacagtatgctagggaaaccttcacatgtaaccaaagcttaaaatatccagttttagaaaacaaattctcactgaaaattatccaaatgtactagatagtataatatgttattactgagaattctaaacatctttcttgatggctcttatatcaactattataatgattttttcaaaagttactgaagtagaaggatattttcacagcaacagatacaacgcttttgctagttcaacccttattgtactattatgtttttacattcaagatgtcacttcttaaccatactcagcacctgcaaatcaatagcctattatttttctttttatttaatgaatttctatgtcatctggtatgtgtatttctagataaagaaactatgttcagcacctcatatctgtgggttccatattcacaaatctgaccaactgtggatcaaattcaatccacagtaggttgaatctaaagatacagaaaccatggatataaaagcagaatataaggaacttgagcatctgtggattttggtattcatcaggggtcctggaaccaatccctctgatatcaaaggatgactattttttataaaactcaggaaacaggatctacttcttttctgtattgaggttgtattcctgatttgtgagaatatcatgtatcacctacagattaacaagggcatcatctgtattcatatcaccaacacacacagttctgaacccaagaagtcttaaatatgaaatcattacaataaaactcacagatgtctataatccttaatatcccaagaacaagatgaaatatgtaaatggtataagagtaaatagagatttggccaggcacggtggctcacgcctgtaatcccagcactttgggaggcagaggcaggcggatcacgaggtcagcagatcgagatcatcttaactaacatggggaaactccacctctactaaaaatacaaaaaattagccaggtatggtggcatgtgcctgtagtcccagctactcgggaggctgaagcagaagtattgcttgaaactaagaggcagaggttgcagtgagccaagattgcaccactgcactccagcctgggcgacagagtaagactctgtctcaaaaaaaaaaaaaaaaaaaaaaaaaaaagtaagtagaaatttataaaattacaaaagacaactccgtagtagacaatagaacatgcaaaaaatataatcactgaagatggtgaagtagggctctccagtaattctccaccctcacagaaacatgaatttgaactagccacatgtgaaagaaaataccttcaaaagagagaaaacaagtgaaaaatcacagtacctggtatagactaatactaaaaaagatacattgattatgtaaagaatgttttacatcacccgtatcaatccatccaccaacgtcaggcagcacaggaaaaaaaaaaaaaaaagagagagagagagagatactgtccacttgaaaaaaaagagaagtgaacatagaaatttccctttgtcgctaacaacaaatctaccagtataaaatgctcatggactctgattcctgacaggtatctgcagtctaagcatctagactgacactggtaccagacaggaatctaacggtcctttgagaaaagactcgagttctggcctatatcactgacggatgactgcagcgaccttcgtttacagaaaatactcagtggcaaacaggcaacagaagccatgggcttcaggaaccacccaggactgcaacaacattaagaaccacgaaagtaagcctgatgcagggccagctgtgggagccaaaaatttccagcctgggctgcaccacccaaagcacttctaggcttagggcactccctaacactgcaccaacaacagcaacccataccagatggtctactcaaaaaccctagacagacttactgttgaaagatgacctaaaataaagtcacactgagaagaatggaataaatatctacttcttcaacatgcagacagcaacacttgaccacaatgcaaaaagacaatcagggaaacatgacatcaccaaagggacaaaatcagctgccagtgatgtacactagagatggacatgtatgaactatctggcaaggaattcaaagctgtggtttaagaaagttcagtgaacttcaagaaaatacaaaaaaaaaaaaaaaaaatcagtattttttaacaaagaaaacagtttttaaaaattaaacagaaatactaaaatatacaaggtacaaaatgagaaattcagtagagagcatcaactgtacaagtgatcaagcagaagaaaaaaatctgtaaacttaaagacagtttatttaaaaatatactgtaagagaataagaaaaatgaatgaaaaggaatgaagaaaacgtgaaatttattggacagcattaaagagcaaaaacgtgtcattgaggtttgagagagtagataacattgtagaaaacttattttaaaaagtaatagcagaaaactttccaaacctgcaaaaagatataaatatccagatacgggaaggtaaaaggtgtctagtatgattgaatccaatactacaccatgacattataatcaaactgtcaaagatcaaagacaaagaggggatccagaaagcaacaagagaaaataataaaatagcatacaagagagttccagtatacctaacagcagacttctcaacagaaaccttacatgccaggagaaaatatgatgacatattcaaagtgctgaagaaaaacaacttctaagaatactttaccgtcaaaatttatttttcagaaatcaaggagagatagagtttcccagacaaacagaagctaaggaagttcacaatcaacagccctgtcttataaaaattgctaaatgaaattctgccagttgaaagaaaaggatgataatgagaaacataaaaatatctgaaagtataactcaccagtaaaagtaagtacatagtcaaattccgaatattctaataatgtaatagtggtatgtaaatcacttgtatctttaaaagggagaatagaggacaaaactattaaaattaatagtaactacaataaattgttaaggaatattcaatatggaaagatgtgagttgtgacatcaaaaattcaaaattcaaggaaagagtaaaattaatatgtagttttattttttataagtgatcaagtttatcagtttcaaataaattgttgtaactgtaaaaaatcttttagttagcctcataaccacaaagcaaaaatctatactaaatgtactacaaattaaaagcaaaaaaatcaaaacatactattagagaataatcacttatccagaaaggaaaactgtaatagaggaagaaagtaaaaaggatctacaaaacaactagaaaacaatcaacaaaacggtagttataagtccttcactatcaataattatctagcatctaaatggactgaattctcaaattaaaagacagagtggctgaatgaaaacaaaacaaaactacaactatatgctgactattgaagactaacttcacccgtaaagacacatataaaccaagtgtaaagatagaaaaagatatgccatgcacatgaaaaccgaaaaagaacaggagtagctatatttacatcagataaaatatactttaaaccaaaaactgtaaaaggagacaaaggatattacataataaagtgatcaattcagcaaaaggatgtaacacttgtaaacatatatatgtgtatatgcatgtgtgtgcgtgtatatacatatatatgtatatatatatataatttgtatccaacaccaaagcatctaaatatacaaagaaaatagatctacagggagacatacattgcaatacaatattaggagacttcaatgcctcattttcagcaataaaacagtcatctagacagaaaatcaacaaacatgaactagaaaatgaactctaggccaaaaggacctaacagatatttacagaacatttcatataacaaaatcagaataaacatccttctctcaactgcacatggaacattctccaggacagatcatatgttatgccacaaaacatgtcttaacaaatttaaggagactagaatcatatcaagtatattttctgaccacaatggaataaaactagaaatcagtacagaagaaaattcaaaaacttttcaaatgcatgaaaactaaacaacatgcttctaaataaccaatgggtcaatgaagaaattaaaagtcttcaatataaaaatgtatttagaaaattgaaaagggaaacacaacataccaaaatatatgggatatagcaaaagcagatctaagtgagaagtttacagaaataaatgtctacactaaaaaaaaaaaaatctcaaacaacctaacattgcacctggaggaattagaaaaacaagacaaactcaacccaaaattagtagaagcaagaaaatattaaagatccaagcagaaataaatgaaatggagaccagaaaataccaaaaaaaaaaaagaaagaaaaaacaaccaaaaatttcatttttggaaaaaataaaataatcaaatgtttatttagactaagaaaactcaaataaatatagtcataaatgaaaagatattacaactgacaccacaaaaataaaaaaagaattatatgagactattttgaataatttcttatacatcaataaattggataacctagaaaaaaaatggataaaatcctagaaacttataacttaccaagattgaattataaaacaatacaatacctgaataaaccaataaccagtaaggaaactgaaattagtaataagtagtttcccaccaaagaaaagctgaggatctaatacatttgctgcttaattctatcaaacatgtaagtaaaaactattaccaattcttatcacactattcaaaaaaaatcaaagagtagagaatactgccaaactcactccacaaggctggcattcccctgaaaccaaaacctgcaagaatgcaacaaaggaaagctacttgtcaataaccctgaagcaaaaattctcaacaaaatgaattcaatacatgaaaaagatcattcaccatgattaaatgggattcattccagagatgcaaggatggttcaaaacatgcaaatcagtaaatgtgacacaccctattaacagcatggaagacaaaaccatataatcatttcaatagatagaaaaataatttgacagaattcatcattcttttatgataaagaattttaacaaattaggtatagaagaaatgtgtcacaacacaataaatatatgcgttatatatgacaaacatacagctatcatcataacaaacagaaaagttgaaagcttttcctataaaatctggaagaagataaggatctccactttcaccacttctattcaacatattacttgaagtcctagccagggcaattaggtaagagaaaaaaaataggcagaaataagttaagctgtacttgcttgcagaaaacaaccttaaatataaaaaatcataaacaaatgaaacttataaaactcctaagccttctcttgatcctagtgtctggaaacctttatgaactcaaaaatataggaaaccaaaaccacttttaaatagacaagtagataaatgaatgacttttagattctttctccaaagttctaatctagtacatacccataatattctcttcaatgaactttagaaatgaacctttccattttagtatcagtattctactactgaccactgttttatttcaatttatctcattccaaaacagttctaagactcatctcagaattcagactctcaaaactctaaatttcatgacaaaaaactataattacaatgaagatcataggctgctaaagcttcttaaagcttaaatcataatgcctgctaccatcagagaggagaagaataatcttaaaatggattacatcataatatgacatggtataaattctgtatcttttcatcttacactttaaaacatgtttctcaattaaatgaataggatatatatactctagctaaattaaacaaggcaaacaggatctttctccataaaaatgttattctgttttctgtaaaaaggaacagatatacattaaactatataaacattaaaatattttcaaaatgagcaatcttattgaaatcacttaactgctacacccaccagattccctacctatactgttaatgctaatacccacctggtggggttgtagtgaagattaaagggccaaatacagaactagtaaacaaaggtaatcagtatttattagctgttttaattaaatttgaaatcccatgtagaacatgttctgtaatacataaataaataaccgtgttcaaaaagttatttaactatgagatggacatttaggctaacttaccacagctgacccattcagaaagaattctattaaacattatatttcttcgggaactattacaagactatttagaatcaacactagtaatttgtaatgcaggtcatgaacatttttcaaaataaaatcatctcttttagatcacagatacggaactttctgacattatctgacatagttcaaaacacagtgctttgaacctagacaaagttcttttgggagggaaattccctaaaatatgtacatcatgcaaaaaacaaaaaacacaaaatctctgtggtctaagcaaacacacacaaattatttctcatgaagaccatatgttcatcacaccagtttctgttaattattaattatgatccctatatcaggatgatggacaccactctgaatgccattctgggtgccagggggagcttcttcaaccaccaatgaaatgcttccaccccaaaaagtgacattaactccactcccatcttcactggtccaagcatgtcacttggtgactcctaacttgacaggggcagagatgtgcaatcagcagtgcccagaaatagagaattgaatactagacaatacaccaatgccgccatactatccatggggatcttggcaggcctgcattgtagaaaagagatgggtttagatcaaagtgattacgaaggagaggaggttctgaaattttcataaaaggaatgccaactctaccatttgaatatattgcctctaacataactctctctttaatcagtagcatggatctttatcctctcgctgaagaactgttttattccaatacttgctaaaagctcagttgaggcatgtaataattgagggagactaaaaaccatgttaattcttcatcactctagattctccccattattcatatccctcttgcaccatcagaaagtgatatatacagaccatagtatatcatctctaagcataactacctttgatgcatttagagtagttagaaatgagttaagagcaaaactatttgccttcttctctcacagtaatttggtcaagaagataatttaatactgagtatttagctcctgtaacagtaattaaatctaaaatatttctactcagaacttttgaggaaaggctttgaactgctcagatgggataactgaattcactttactcaccatccttatttccgttaatattataacctcctttatgtgtgatcaagtatcacaaatattagagattcagagttataaaagaagcaatacactaccaatttttttcaaaatatgatgtcattacctaaattccttaagtctttatttttatactttaaaaaaagggactttaaagagtagctgtttttttttttcagttatgaaaggtagaatttcattttaaaacctcttcttatttgtattttctaatatgcacttatcttttgaagcatttaatcccataatttacctaaaggagagttatctgtgaatttatcatgcatataataacaaaatgaaaatagcaaataatgaataatcggtcttaaagaaaatgaaatcatttaaagaaatatttccactgtctttgaatggtattggaatatgatacttacaaaggttctgggcaattttagaatctaaaaacttaagttctttaatttttttcttaatcgatttcttctcttcaatatcttcctcttctcttctctctgtaaaaccaagatagatccatgttaggggcagcaattcattcaaatacaaaagtggaaaaagtgaactttttatcattaaataagctaaaaaggatgtaactcttctaaataaaagttataaaaacaaataaaacgatagatatcccaagacctgaactgttgaagatagaaactgggagcttttatgccagagaaactatggaaagtaaatatttgaaggtctaacaggaaaaacaaaaataaaacttatgtatactatggaaaccaataccaatgggtataagaataactacaattagctcatttgaatagcatacaggatacagttataaaaattaaaacacctgcactcaagttgcaagtatattaattggattatgaagctagctctaagaatgctaactaaaacagtcattttatgtctaatatacaataccattcttatttaaaaacataccttatgaaaaattaacagaataaattttattgatcgtgaatgttgaatcatctatgcatccttgaaataaatcccatttgatcatactgtattatcttcgtgatgtactattggatttgttttgctactattttgttgaggatttctgcatctaaattcatcaggaatattggtctaagttttctttttatgttgggtcctcgtcttgtcttggtattagtgtaaagctggccttgtagcatgagttaggaagaattctctcctcttcatatttttggaatagtttgaaaggaattggtgttagttcttccttaaaaccttggtagaattcaacagtgaagccatccagtcttgttggaagactgatcaacttccttactcattattggtctgctcaggtttcctattctttctgatttaatcttggtagctacgtgtccagaaatttcttcatttcttctaggttttccaatgtgttggcaaacatttgttcataattagactctaacaatcctttttatttctgtggtatcagttgtaatatctccttttttgattttgattttattcatttgggttttctctttttcttctaatggtttatcaatttaatttaaaaataaaacaacttttcatttgtttaatctcatattgtttgttttttgtttgttttgagacagggtctcactctgtcacccaggctggagtgcagcagcataatcacagctcactgcaaccttgacttctcaggctcaattgatcctcccacctcagcctcccgtgtaactgggactacagatgtgtgccaccacattcagctaatttctttttatttttcatagagacagagccccactatattgcccaggctcgtcttgaactcctgccctcaagtgatcctcccacctcagcctcccaaagtgctaagattacaggtgtgagccacctcacccagcaatgtgtcttctttttttatctgtttcatttagttctgctctgaactttattatttctttccttctactaactttgggtttggtttgttgttttcctagttccttgaaatacatcactaagttcttgatttgaaatctattttttatgtaggcattttttgctacaaacttccctcctagtactgtttgtgctatattctaaaggttttggtatattttgtttctactttaactcatttcagaaatattttttattttcttaatttcttcataacatattggacattgagactaattgtctaactggacattagagaagcaagctgtataatttccatattatttgtaaagttcccaaagttcctgttgttgatttctagtgttactccattgtgagctacaaagatacttaatataattttgattttttacaagttgttgagacttgttttctggcctaacatatggtctattctggagagtgttccatgagctgaagagaagatgtgtgttgtgcacctactggatgctatgttctgtaaatgtctattagattcatttggtctacagtgcagtttcagattgatagttctttgacaattttctccctagatggtctgacaaatgctgaaagttaaattctccaactacaactatattggagtgtctctctccttgtagatataataatatctgctttaaaaatctgggtgttctggcgctgggcattcacacatttaaaactgttatattctcatgctgaattggtccctttatcattatataatgatcttgtctctttttatctctttttgacaaagtctgttttgactgatacaagtatagcttatccctgcacactttgacttttcatttacatacattacattttttcaatccctttgctttcagtcactgtttatctttacaggtgaagtgagttattgtagacagcatatatttgcatcccatttttttaatccattcagccagtacataactttcaattagagaatttacactacttataatcaaggtcattaatgggttagcacttacttctgtcattttgttgatcattttctaattgttttgtatatcctttgtttctctcttcctctctgtttatctttgtagtttggtggttttctgtaataacaatatttgcatcctttctcatttgtgtgtctgctctatagggagctttttacttttatgtgttttaacagtggtagatacagctttcttttgcttccagatatatgactcccttaagcagggagtctagcagtgatgaattccctcagtgtttgattggctgggaaagactatttctccctcacctgtgaagaacagctatactgagtaaagcattcttacctgacagttattttctttaagcattttgtaggtatcatccaattctctcctagtctgtaaattttctgctaaaaaaaattgatgttggtctgatgggcattctcttatatgtgacttgacacttttctcttgctatttttataaatcactctttgcctttgccttttgaaaatatgaatataatatgtctcacagaagagtttttgagttgaatctatttgggaatctttgagcttcgtgtatctggatgtctatttctttcccaagacttagagagttttcagctattatttcattaaataggttgtctatgccttttcccatctcttctccttccagtaatcccaaaacacaaatatatatttgcttaattttatcccacatgtcacgcagactttttaaatctttttctctatttttctttttttggtttgtctgggttatttcaagaaacctatcttcaaactcagaaattatttcttgtccttgtctagtctactgatgaaggtcttgattatattttttatttcctttattgaattatttgattcaagaatttctatttggctctttttttatatctatctctttgttgaatttctcattctaatcaattgttttcctgatttctttatattgtctacttgtgttctctgcgcttcactgagtttccttacaatcattattttgaattccctttcaggtcttttataaatttctttttatttggggtgtgttatgggagaattactatgttcctttgaggtatcatgtttcctttctttttcagatttttttgtgtgtccctaaagtgatatctgtgcacctcctctaataatcacttctaattttatagagtagctttaataagctaagactttttcctgcagatgtatttacagcatcgattaagtagagtgtttggagttttgggtgggagcagccacatagtctctgtgtgatttcttcagctataatcatcagcagtgtctgagatttcctcagtggcttaggctgcagttgtttgtggaggctttggtatgactttcatagtgatgaagatgaagagccaaacccaaggtgggtctgtccttgagcccaagtggcatgtatatggataccagcaggccctagtcacatcagtccttcatccccggggcagcaaacataggttctgggaagactagtccttgggcccctgggggttgtacttggggaatggcagtaacagtcaggtggcacatgtgatcgtatggcagtcccacactggaggtggcgaggtcgctattggacaaaattgggaacttgataagaaagaagagtgtagcaatgtgttttggtagatatgtaaatcactaaaggtaaagttcaaaatctgaaatgctccaaaatctgaaactttgagtatcaagatgacactcaaaggttatgttcaaaggaaatgttcattggagcatttcagattagagagatttggattagaggtgctcaacccgtaagtattatgcaaacattccaaaatctaaaatacaaaacacttctggtccaaagcatttcagataagggatattcaacctgtatattacaattatatattttggtacatagcatgaggtaagaatcaaattttccatttttcaaaacatttgatatttctgtgtcattttatataattaaccatctttctcaactgattttaagttacactttgatcatataattagtgtctagataagttatttctatttttctgggctactagttctgctacattattctctgtgctactgttaacactgctatcaccctgtcttaagtactatagatttatgatacgttttattcattggctgttcaaattatttttctccatatctaaattttgttcttttttttttttttttttttttttttgagatagagtcttgctctgtcgcccaggccagagtgcagcggtgtgatctcggctcactgcaacctccgcctcccaggttcaagcaattctcctgcctcggcctcctgagtagctgggatttacaggctcatgccattatgcccagctaatttttgtattttttttttttagtagagacagggtttcaccatgttgaccaggttagtctcaaactcctgacctcaagtgatccaccggcctcagcctcccaaagtgttgggattacaggtgtgagccaccatgcccggccctcatttatttctccacatgaactttagagcaatccaaaaggtctaaaaataaaatccatttgaactgtatttgaattgcaaggtaattgcaaatagattctgagagatttaatatcttgacaatttctgaacttccttatcataaacatggcatgtgtttataattattcaacttagcacagtgttcttcatacatgacctgtatattttatgttaagtgttaggtatccaaaggacatttgtactcctaggtattgtgtagaaactttgcctaattttgtatacatgttttataatcaggattttacttattttgtctttcattcagataaaaaaaattattaagcaactaaaaagagactgtgttaggcaacaaagatacaatgctagacaagatagagaaattccttgcctcaaagaatttaaggtctaatagaagtgactataaaataaatgacaattataatacatggatgtattagtgatgttatagtgaaaactacacaagaataaagaagagcaccctaactatgcttgtcaaaaataatccttttgggataaatacctaagcaaagcttgaaaggaaaaatgagtcagccaggtaagaaggtgggggtatgtgggaaagacacaacaatagaagaatagtatttgaaggtgtaaaggtgcaaaaactctaaaggcactgaaagacttgaagataataagaacagaaaatattaaacagaaataaatgacaccagaaatgagtcaggtaccagatcacataagatattttaagccaggctaagacatttggattttattctcacactaatgaggagccactgaagatttaagcacatgagacatcaggataactatattttaggaaaaactcaggctaaagaaggtggattagaagaatggcaaaaattacaatagaagggcaagactgaaggaagttacagtaatccaaacgaaagtcaatggtaccttcaccaagggcaataacaacagggaaggagagtgtggatgagttccaaaagttgattctgtagtgggaaatagactaattattgatccagcccaaatttgtctcttgaactccagacttgaataaccaactgctccctctcaacatctttatttggatgtctaatgagcacctgtacttaacatgcccaaaagcaaactcctgacatatacgtgcctacctccatatctgctctcccaactattttcttcagcttaaaaaatgggaatgttctttttgctattttcaagtcaaacgcttgaattttgctactattcccctcacgataatatcctatccatcagtgaatctagtcgattctaactccaaaatattcactaaagtaatcactcctcaccattgccctggctacaatttctctttttgtggccaacatattttttcacctggaccacagccggtttctaactagtctccttgctttcaggcttgactagctgtagtctctccactacagtgcagcaaatgaatcctgttaaaaacttagtggcaaagccttcccttactgccttatatagaaagcaaactcttcacctggtgttctctatcaccattgttctgacttttttctccttcaaagcacttactccttacatatcataaatttgatattgtccctcttcctccattagaagataagatccttagaggcagaaactttgattgtcactatattcttagcaccaggattaaagcctggaacacatcaggtgctcaacaaatatcttttggatggacatacatgtggtcacttgtgtgtatgtatgtatgaattggcagagtaaaagagaataaagaggatactcaggcttaagcaatcagatagatgataatgatgatgtttatttagataaacgatggtgatgtttatttaattcagcaacagttgaggaacaggtttggactagtccagtttaaaacatgttcagttacagaagctcttgtatatccacattagtcatgtacaagaggcagctggacatacagatgtggagaagagaaaatgggaatgatgatacaggtatcaatcctagtaactactccactaactgtcacaggttttccagataccatataacaacactttcatctccttattcccagaatttaaaacttgtttctggtcttgttgtattagttaaaattttcagatgaaggctaataaaaaagttagtaggattcccttccttaacctgaccaaatagcaatcctcaacttctcagaaaatgtatacattttattttcttgtctttattcttaagagcagactgtaactttttaaaatgtttacttttctcatcattatcagtatccttttacattctgaaacatttcgtagtctacctaaagaaaaacgtcaaagacacaagtaaccgtaaattttaaatcacatttactgaacccctattaagtactgcactgaaggctttctgtttccgtttcttatataattctcattatagtcatcctaatactactactagtatcattgtcatcatcatcatcacaataaggaaaaataacgcttagggtaattttaagcaataaatctgataaaagaatgatgaccacctgacttggactccaatattcttttcactatctatgaagtatgttaggtgtcacagtttaaaaaaaaacaaatacaagcaaccttcaccacttcaacctccaaataagacactgatataatttaaccaattctaccttttgaaaataaaaatgacaaattagactcacttaatttaatgtatcagcatactcaggatggtgagtatatacccagtaaggtaatcctcttctaccatcttcactgctatcatatagtcataggattgttgggacaaaggatcaatggaacttagatagtgagaatatggacaaagggatacaaagaagcagaactgcctaagagagaaaacaacagaaattttaaaaccaaaagagaaatacttttttgttgatatgaagccagataatgagtctattatacaaaaagattgatttggaaaaatctttcatattgagagataacaaaagttttgtttgttttttattttttaatgcaatcagggctgcatcagtggaaaaccagcaaaaatgttttatgcaaagaccactgataaagccgcacataaatgttggcaacaataaggatgaattaaaaacaaatgagaataaaggaggacatttagtgagaatgaagtttttgtacaaaatactatttctgctagccatgctggcaatacctctggtaaaatactagcatgcctggaggaagggcagggtcctctgtctgggaactcaggcctggaatcctgacaacaggttctacatcccagcctgccacatgctagtagctaaacctcattatggctgtgattgctcacctatgatatagggatactggccctctatgagtagttgtgaaaatgaaatgagatgataaataccttcatgtaaccctccccctgtggtgacaaagaagagtacgatcagagtccataaacacaatttagcattcaagagtaaagcacacttcaggctcaaacccatgaatcggtggagctactcttctaaagccagtacaaaatacacttactctgaaagactagattttctcaaatataacatgaaactctgaatcataaagtcagattattagtgccatctatacttgtgatctagctttgttgccattagagttttgtgtttaatcttacttcctagagatgctgtgtaaggctccatttttccaagagaagattaataccgttcaaaaactgttctgatcactaacacagcatatgcagcattttataagggttttatgtcagaatgaagtcaaagatgacaaaagttcctatgttgccaagagccatgaactgaaaaagtctcttttaattacattttctcttcattctttttctattttcaaagtttcaaaaatagtagcaaaattatgtaaagaatatcatttcaaaatcctttctttcatactaaattttccatttaaaaatcataattccatgtcacatggttatacatattattccagttcattttccattatgtactaatcagattgattaaaaatatagctttttaggagtaagatttcatataaatgttatcatacattatttcaccattgcaaaagaaaaaacacctcagaatatgcagtcttaaatgttttagtagtcagtataggcataaaaggtaataaaaaccagttttctctttctataactgagtattttaaatcagtaaatgttactaataagtgtttactctgcttttgttggtgctccctggttaaatgtatcttatgacaataggcacttaaaatattaagccttttaagtttttttctggtatgcctttagcatagatattattaaattttacatgttaatgtttataataaattacctttctaaatagactgtaattacactagccttaagagtatgaaaataagtatatctgaataaataagcaagcattcttctctatgacacagagagaagataataaattcaactcaactaaaaaaataaagtaagcaaaataatttacctagaaaatgaaaaacaccagtccctgacagtcttcaaatggggagatatctatgaattacttgcataatggctgttatttttctttgccttctaactcatgagattctaagaggctgataaagagtatcaaaatttgaaagatacaaatttttgaaccagaacggcccttcagtatggactttaaccacctcattctataaatcaggaaacctaagcagagaatataagctacatgctgaaggtggcacaaggcttggctatgagcagacctgagaccaggaactgaccaccacacagcaagcctagagcatcctctgggacatggaatttgcatgaggaaagcagtctgcaaccaagcacattagaaaggataactccccacactttgcatttacacttgatccaaattttcccttgctgtacatgttcaccaggacagttagtggaaactgaataggcctgagggagggaagagaaatgtttagtctccagaacacaataaacaggatttaaagctttgggaaataactacacagttgactcttgaacaacacgtgcttgcactgcacaggtacacttatatgcaggtatttttcaataaatgtagtcagttttccatattgacagactcccatttgcaaccaaacacagactgaaactacagtattctcaagaagcaaagcctgtggatatgcaaggtcaactgcaggctgggcagaaccaactttaggacttgagtatgtgtggattttagtatctgttgggttcctggaaataatcccctgcaaatacagaaggatgactctggttccaaaggaaaagtcaagaatgcgcctatcactacctctcaagtagtgggtaactttgctttggatagggttcagttattcagcaatatagtagaatggaatacacttgataaacttaaaggtcagaaatggagaataggcaaacgactgagaaaaaaactaaatttctgagagttaacaatataggtggttgataggacaatatggtttcaaagaaggtttaggtagctcaaaagcaaatgatacagaatacataggaaaaaaagtcaaaaaatttggaatgtttttatgagatggcaatagaccgttgggaaaatatcgaagtaaatgctttggtattgaaaatcacattgtataaatcactttagtcatatctggcttcccaaaccaagttttaatatttctaggcacataaataaatgggtgtgtacctaactacatagaaaataatcagtggagaaacagataggctatttttctattcaaatactaatatatgactgccataactaatcaggatattttactagcaaaaagaagtctgtttgacaattcaaggctaagaattatataatatataggaagagtagctgaagccctaaataaaattttgtgaaacagattatttcaactgtagcaatcataaaaaatgtagcagataaatgcgtatttctctttctgtgacattctgttttagcagacaatgtcacaaaacaaacagtcttgaaggtcttttttctgcaagtcaagtcctacatggacaggaataagaatctcactacttaataaacccttcattatgggtatatctagattttttttagccatagtcatatgtacaaaagaactgttaaagtatcgggaaataccttgttaaaaaacttaaagtacatacctcaaaacaataaagatttttacaaaggctacctaaagaatgcttcccctacctctttaatcctatatgaaattaaaaatcaaaatatttcataaaaactgcttaatatccaaggaccttctaaattataataattagcaactttgctcatctcaaaagtacgacccctacaaaaagaaccattttattgaggtctccttgggtataatcaccccctcataaccaaagatttaactagcagaaaaacaagagttcaaatcaaataaaatattaacaccattcaaaataacagatgaaacaactttttaaattcacaagctgtggattagggagaaaaataatcctgaaaagttaagcctatctatcacatatatcttagtgttaactgggttcattacaatttgagatgagctctgactgaatagatctaaggactgagagaagaaagtaaaagatatcaggaaagagagttcaaaacccgactgaaggaaaactgaatcctgttctaacatcatctatcttggctcatcacaacttctccagaaaacatccataaatttttatgtgccctcaaaatctcaccaccataagaaatacttctagtatctggcccctgtgaattcttcttgaatgttggtgtttcccagtcatggaatcatacatgtatattcataaaaattaatttgtccagctgggcacggtggctcacgcctataatcccagcactttgggaggctgaggtgggcggatcatgaggtcaggagatcgagaccatcctggctaacatggtgaaaccccatctctactaaaaatacaaaaaattagctgggcgtggtggcgggttcctgttgtcgcagctactcgggaggctgaggcaggagaatggcttgaaaccgggaggcagagcttgcagtgagctgagattgcaccactgcactccagcctgggcaacagagcaagactccatctcaaaaaaaaaaaaacataataataataatttttccactatttttacgtataacattctctcatatgttctctgatggtagaaatatatctctgctagaataaattacaaaaccaactctgaaagttaatgtatgacatacgaagacatatacaaaagaaagtacaagagaggagaaaagtcatgagtgagaactcagtgtacattcctaatttagaagaactaaatccaaatgataacacaggtaattcaggatctctagcatggtgtcgaatggaaagagttgataaaccagcttactagtatttgtacacacaatgctaagcaacttgagactagaagaagtaacaatacattatattaacaaacagataaaaagcaatgccacattaaatcataggcagaccatcctggcatattcctggggaaaacagaacacaatcatcaaaacagccagagtgattatccaaaacttgatagaagagaagtgatctgacacaaaaatgaccattattccaaaatactgaaaaagaattgactgacagcaaaatggtcaagcttaagtagtagaattttacaataaacttacttctatatttgatgacagcatgcctataattttgtgatcttgttttgggaggtggggaggcaggggaggggacgggaagcaaaaaaagaaagaaaatgctttattgtgtggggaatggagtgtgggtgtgccagggtagaaaagaggaggagaaggtagagacaatacctaggtatttgttcaactgaactcaacttttattatctggactttctgatacgtagttatcctgtctctctctctctgcttttacgttcttgtttttgatagctcagttgggaattcaagtcacttgcccagtttctcagttattaaatctttatttctctgtgctctaagaataatgccccagttagcattccagatcattctggtctccaattggtctagctaattggagttccattatttgcctgatctgtgttctagaataaactattctgtgctagtttctgtccccacaatctcctgaatttggaatttttattaatctgggctgttaaaatttgtagttctatgttatcttaccttctggctggagcttgtgttgtgtacatcctatatagctatttataacacccggcttgcagtggcacaggcctgtaatctcagcactttgggaggccaaggctggagtattgcttgaggccaggatttcaagaccagcctgggcaacaaaatgagtactcatctccacaaaaaacgtaaaaattagctgggcatagtggtatgtacctgtagtgctagctactcaggaggatgaagtgggaggatcacttgtgcccaggagtttgaggctgcagtgagctaagatcatgccactgcattctagcctgggcaacagaggcagaccttgtttggaaaaaaaaaaaaaattaataaaatgcccagctcacatacagacctcttttccactgtaccatctaactgcaacccaaatgttccatatacacttccctagtagtataaggaggtgaggttaaaggaagactagcaggattcattttatattgtgattagaaaatgatatttttaaaaataatcttcctgagagagtagagaatggggagttagtgtttaatgggtacagagtatcagctggagaagataagttctaaagacggatggtactgatggatgcacaacgttagtgttgctaatgccacagaactgtacagttaaacatggttaaaacggtaaaattttgttatgtattcttaaccacaacatttaaaaatagaaaaaaatttctttatgaggcttgatttcaaatcactcattttaatttgacctcttgatttgaaaatttatgtaggaatcatgtagttaaaattttgctttgtcaaatgaagaacaaaaatctaagtggctgtaaaattaatcagaccaaactgggatcatttaaaatgtatacgttctttcccaagaggtgttcaaaggcagagttggtccttattcactgcacacctcaaacttatacattggtttgactatttatataatgatatagataatgctgttacaaaataacgatttctcttctacctctcacccagattacctctccaaattgtacaaagaatttcattcttgggcaattcagtgtttcaagaacctaatcgcatttctatttccttgaatacccagctctcagatttctaagcttatagtagcccatatcaattactccgtcattaaaggtgcatagtgataaagccagggcagacttttacatgaaaggaagatcttcatcttttcctacacagaaactgactctcttcagcttcttgttctttgtcgcataaagacaggtggcacatggataatgtatagaattagattctggaaaggaaacccaagccatccttatgcttaaaagcctcaaaccatttacccaggaccagagaccagggagatgtatttggaatattcagacaaaagccaagttaacaatgaaatggctctttatctaggtttgttgtggatccctgtatatacatattgacttatattgactaaggcaaagtcaccttttattttctagttaaacaatacatatgtatatgtatctacagggagaatgaggcgtgtgtgtgtgtgtgtgtgtgtgtgtgtgtgtgtgtatcactaaggaatcccacaggaaaaatggagagctaagccaagtcaggattcagaaatccctggatggtttataatccttcaagccccaacaaaaactccaaagaatataaaataagcaatactttcatccccttgccaatgtccatatttaaagttaggctacttataaaatgaaaatctcccaatgttttcgagcctgcccccactcccctaaacaatcttaccttcagtgtaacaaccaaatctgctattaaaaagaacgtacttaacagagctgtattgtgaaatggggagcgaggtaacctttcgttaatgggaatgcagtggcttaaattgtattagaaatctcactttaaactcaattactttacaattatgtttggccacctgacacttgggcagagaagaattaacatcttagtgaagaagaatctttacaagaactgaaatatcccttactgtaaactccccaacctaactaattaaaaactatctttaaatgcttcatgaaaatgtcagaaagtaaaagtttttgttcaaaagacatacaccaacaagccaacgcagaacagaacaatactaaacagaatacctctgacatccaggaacacctattaattgggactctggctcatgtcaaaatttctaatctctaaaatgtttgaataaatcatattcatatgcttaagactattttacttcatgttggaaacatcaaatctgtatttcatataatttcttgaatttctgtaagactcaaatcctttttttcccaattaaaatggacagtgggatattatctaatggacagtggaatatcatctaattaaaaaaaatctccaataagaaaccattatttccaataagaaaactaacccataagaggctaagggcctggcaaatgaaaatgaggactctggactctcattcttgtgctgatgccatcctggccattcaaagcctatctagcccatcagtagaaactgcaaatgtgatgacagaagaactaaatgaaattaaaagcagaatgactaagattcattctaccctgcagagaaagtagagccagataataattggagatgataactggagattaatatttttctttcctgaaatttgtccaatagccttgccatttcaggatcaatggcatttatttcctctggggagaaaagataaaccctagaataagaggtcattcctgagcactgagtataaaattagatttctgttaatatctacagtgagacaatagtcttgaaagctatgtggttcaattgcaaaagctggttacttacaggaaaaaaaattaatgcagtcacaaaacattcctttaactatataaaactgagaatagggccctactataaggagtggctaggaaggatgcagcacatgagaaaaggacagagtgtcagacatagggaagacacaaaagcccttcctgggccaagagagaactcgcaggggatcagaaggacaagatcagaattcatatacacctctggagggtgtgctctcttcctcctccctcatggtgcaaggctgaaggagagccacctggggagtaactccaaagaataactaaataactaaagagatattagagacccccagagcagagggtatttgtggccagcttcctgtctggacctccacaggaagaccgcctcacagaagcctctaccaatatggggcaagcgctagagacaaaaatagtgcatagtatgtttagacaagtgtgcttgtgacaatatcttgctttgtaagtggttaatgggagatgtaaaagcactaaaagagtcagcggacatattttcaaaaaatatttactacgttgcactagatttttcaagtaacaactgaaaaattctcattggatataaaatcccctgcaactcaattaggaaaaaaaatgtatactagcagcaaatatcatatttcatatttcaaagaataaggcagcaaagaaggatggcaaaaaaaatctatttcttcccaatatgtacatgcaaaggcccaaaggcattataacatataaaacacgtatttctattgacctatgtaataccttatctcaaattatcaaatttaacatcttatccccatacttagctcttttggcttagtttcccaaatactcataatgatttctcagcttttcacaagctgctccttctaagcctgaagaagatatatatgatttttcacttcatcaattacttccatcctcaaatttgagcaaatattcttcaggataaccattatacagatttccttcattacaaatgagtgtcccttttgatcacaggcaccatttggaataattaactatcaaatatattgctttctgaatggagtttattgaattaatgtaaccctgtgtatgtaatatacttgacaaaaatttctttcactttgaaaagctaaggtcatttctaagctgtaactttaaaaataaaacaaatgactcacagatcttgcaacaatttttttagattcatttatattgactaaggcaaagttgcctttttattttctagttaatacacatcaaaatatataaggatttcaaaaaaatctaaacatgctattccagctaattgccatattattctagatttgtcccccaggaaaagatattgactttttaaagttcattgtgaaacaattcaaacaatatagaagtacaatttttaaaaagtaaagtttccccacacattaatacaaatattccccaaaggaaactattgaaatgatagttattgttaacaaaagctactgctggtagccttctgaaaggctacacatataagtgtataagggtgtacataaacaaaaaagatgtatacacatgtatacaaatatacaattgaagggtttttttccttaattaaatgagctcataccatatacattattttgcattttacttgtttcacaaagcaataaacccagtgtaattttccatgttcatatgtctagatcaacaacatttgttttaacagcttcatagcatatcacctggtaccataatttggctacatataataatttagctattttccttattaatgagcatttaagttgtttataaatctttgctatcaatattactaaaatattcttgcatatttttccatatatatataagcatttgttgcatctacttttaactgtgccgatgtaataatctcgttctcttatgagaaaagacatatgatcaatttaacaccgttagcacatttcctcttctatcgagtctgaacaaaatgggctttctggtttttaaaaaaagtttattttggcagtttatttcttaatgtcaacgaagatcagcagtttcaaagaattgtagaatgttaagctaccaagaactcttattttatagatatgtaactaaggcctggagaattgatttctccaaggcacacagctacctagtggtagattcaagacaagaaatcggcttcctgcttctagaccactgttactgtaccacactccatttcctggggaaggacgaacacagacacacaggaccaagaaagccctgttagaacaataatagcaactggaaatgtaatagctctcaatatggagctcctctgagggcttccctgtcatgataaagaaaatcttaatctatttcgttcattcattcactcactcactccctcccaaatcactgagttaggctctctatagaagaatacagaaaagtcaaatgttaaggcttgctcataaagaatctcggttgaaattggaacaataagatgtgaagatgtgaagatctattggaacaataagatgtgaagatataaaattatacaataacataatcatttatataaagtgaaaagcattacagagttcaagcaaattctgatatttattctatcagaagcccagtaaaagtttattaaaaggatagtaaatttttcaatgaccaaaggctttgattggcctcaattatttgaggtctcactaatacttattaataataacaattactactatttccttgaggccaaccaagggaaaagatgatggaggctgggcacggtagctcatgcctgcaaacccagcactttgagaggtcaaggtggaaggatcacttgaggccaggagttcaagaccagcctgggcaacatggcaagaccatgtctctacaagaaaaattttaaaattagctgggcatactaactcatacttgtagtcccagctacttgagaggctgaggcaggaggatcccttgagcccaggaattcaaggttgcagtgtgtgataatcatgtcactgcactccagcctgggtgactgagcatgacactgtctcaaaaaaaaaaatgatggaggacttagaaagttaaaagaggcaataacatctcagtagatggaccaggaaaatcttcacaaagtaaatggtattacatgtaggccatgaatgattaacaggggacaaaactggaatgcattcctttcctctcttctctatgaagagctattttccaaatataaatatatgcatttgtatacatacagagaaagaagcaaactatggctctgaataagttttccatacagtgtagaagaaaatttgactaaaatatagatgaatccaaaagctttaggcatttgcagttttattttctggaagacaactggagaataggaacacttgtttcaaaaattatcacacataaccaatcttcacaaggaagcagaatcgtaaggactcaaatttggaaagaaaaattgatagatttgacttctactgctacccataccttgtgtacaatgggatttttgatagtttgtttaaatatatacatttattattaatgcatagttgaattaaaaactactatgtttaacactaacttgtttctagcaacttttctgtgtgttagaaaaaaagggggggggctattatcctttatacctccttttagaaccttttagaaaggagagaggcaaaacatgtggaaagaacttgcccttagtaatcaatctttccaggctcataactggccactaactaacttgtaacaccaccactccctcttgcgggccagcaacaccatcatcaacatctacataactatgccctaagctaggggtatttcaatattgtaccaatgcttcctttgcccctaccactcctactgctggattggccctcaccttcctccctgctttcaaaaatcatatactcatgcttcaaaacaactcaaatgtttctttgaagattttccaaaaaatccacacctcaaatctcatctcctgcccttgtctccagtcacactaaacttctgatggatcctagatcacagattctttccaatctgaggaccttccatgactatcctctctaaacacacccctcatcataccttgctcatttactttcatagcacattcaaaaactacagtcatttttgttggcctatttattttctgtcttctccattagattatatactataggaaagcaagaagttatctgctcagcactgtatcccaggagctaggacagtacctttcatgggagaggcatccaatgttatttgctgcttggctgaataactgttcagctggctgcatgatttgccatgatggacccagtaaccaaaacgagagccctgcttactgatagcagatagctgcaatcctaggcatagtactaagtagcagctagccttgagggaatatgacttgtatatccaatttcacttgctgacagaaaaaaaaaaaaagccacactagcactaagacttaagcacttaatacaataggaatcacagagctctgagaagaaatagtccttaagcacaaagctgctgggctaggaaatagggaggccctcttccacagaggaatattgacatgagaaccagggtcaagaggtacaggtgagtatttctgtcctgtttccttcatgactcaaggttaatttacaagtattttccataacaattataattttaccaaaaaaagattaaaaatctatgaattaaaatttaaatgaaagcttcacatattaaaaatatgcttacgaagaaaaaatgaagacgaacactctggcttattactgaaagcttatacattaagtaggcagtgagttacagagagctgtctccatagtggacataaaaaataagaaaatatttctcaatgatcaacaaataacccaaatatgtcaaatgatatctctactggcaacacttttatggcttccatacttagcgctcagatttttttcatctattaaatgagaaaatgatagctatgatctagtaactttacaatcctatgatgattgaacaatcttccacttttttgtacttctgttacatgttgcaaagcattgtgttcctattatattgtcctttcagctaaaatggttaagtaaaaacaaatatttgcacaacattttacagtttacaaagcacagaatccagtttggatacaatgcaccaagttcaagattattaatgatggggaaagtgatgagagaaaaaaacctcccgaacactacctgataccattctttacattgttcatttcttccaaaaaaagagaagtatttgaagtttatgctcaatagatagcatatgaaacacaatgttcacaacaataaattttaaaagttcctaaagagtatatagacagctaatttgaagtagcacacaaataaacaaatgctaaaaaagcacttgagtcatttaaaatacatgcaaacacacaaagagaaacaaacatgttgctgatgagtactggcccatgcttacctacttagacagctattgtgtacaatattttaattcaatcatacttaaaattgcaaagttattcttctaaaaatgtaagtacataacggatatgttattttttttaactataccaccactgccaggcacaactttaaaataaaatgtaatacaaaaatgagaacatttgaaaatctggtacgataagggaaaaaaactcttaagataaaatggatgctgaagtgttgagttgcacccaggggtcaacaacattgtgtctattattcagctgaaacacagaatttgcctttagataccattttaatgttaaatcaagaactgtcaatcagcaccatttgtttgtaatccctcatcagaacccattgcctcagtctgaacattcataggaaagaatgcagagggcatatctgcaaccacttaaccttcatcaaccaacattcatgcatgctcattaacatttttttcatcccactttcgagcatgacacagctcataccggaataataactcgctgataattgttctagacaacagctggacaggcagagtgcagaggtgaacattctcatagattatggggtactgtaatgcattacaattagtaaaagagtcacatgttcgtgttgaatagctttcaacagaagtgaaggaaatgtcattatcacaaacagcaatctcctctaactttaactctgcatggtccaccgcctgattctcttaacgctttcctattttgaaataaaccaatgaaaaacattgaccctgttactgtactatttcatgaaaagaagtaatatttttgatgtgttacaatcagacacgatctaaatttgtgatttaatttaaagacagaaaagcaggaggagggagaggaggaggaagagaagagtttcacatcttactaataacaattgttttgagcatgatggtgtacacctgtagacccagctactcaggaggctgaggtgggaggatcatcacttgagccccggatgcggaggatgcagtgaactgagatcatgccactgcactccagcctgggcaacagagcaagactctgtatttaaaaaaaaaaaacaaacaaaccacaatcgttttgcatgaagtcccataaaatcattatttattatttttgctttaaactgtcaattcagaaaaataaattaatatcactgaagaaatctggaatatcaataaaaaaggagtcctacatagggaagggaatttagaatccagtccaacatcctattcataacagctttgatagctacttctttgccataatgcaataaaaataaaatggaattaatatgataatgataatactagttgccatttttagagtaatgtgagtcaggtatcataccaggcactcaacagacacagtctcttaataatcctaaaagtagtattaactctctttttcagatgagaaaattaaagctaatctgaaagagactgaaaattcatcccaagtcaaaacattatggagacaggattccaaccaggtagtctgattccaaagccgatgcttttcacctggcttcatggttaatttccacattagaatcttgtttattttccattatttcatcccaattccttggctgtacaattctttgactctgtagaattagacctatttctagaaggtctttattccaagacatagcatttatacttccacattttctactctccttgtgtccaagaaacctgctcttaacactcagataatctctagtccctgtacgtctacctagtttccattacacttagtttttgttgttgttgtttttagagatggggtctcacttggtcaccaaggctgaagtgcagtggtgtgatcatagcttactgcagcttcaaaactcctggcctcaagtgatcttcctgccttggcctcccatgtagctagagctacaggcatgggtttatcaggcccagtgtgttttttcgtatatatgttgggtgtttgtttttgtttttgctatattgcccaagctggtcttaaactcctggtctcaagcaatcctcccaccttggcctcccaaagcactggggttgtaggtgtgagctacctcaccagcccatgctttagattttctaatcaaacttcttaatgtggttctttctacaccctttctctgccttgcttgacataaaaagaaagaaggaaggaaggaaggaaggaaggaaggaaggaaggaaggaaggaaggaaggaaggaaggaaggaaacttcaacaaatttcatttaaagatctaatttaaagatcttatacatgattcattaatcaggtagcatctcatctaaaaatgtagaaaagtgccacaataaactgagcagagatggttgattttatagctagagaaggggtaaagaaagcaggaagaaggaacaaaaaacagactggtcatttttgagttactttctttatagggttaaaacaggggacttccttatcatataggctcaggtaaaataggccccttctgattggctgctgcgaatctcctatttttcagaaaactggcacatgttaaagttcaatttgattaaatggcacctagcacaagtgactccattctggtttgatctggcatgttaaggccaagtgcaacagcttagtaaaagacaatggcctcccatgaattttgtttagcaacatttagtcacaaatatctgggagaggggaatcaagaaacctaatagatataacagtctatatctctagtcctacttgtgattggtgctccttgttgaaggaaatcacatcacctgcaatgggatctactataatttaataatataatctgaaataaaacctcagtaatataaccagggtcagcaaactatagccccatgggccaagaccagtttgctacctgttttaataaatgaagtataagaggaacacatatatgaccattagtttatatagagtctgtggctgctttcacactgcaatagcacagctgagtagctgtgacagagaccatatgacctacaaaaacaaaaatatttactattcagtcttgtatagaaaaatgtggccaacttataatctgtagtggagatccataacagtatcttgagtcaagcagataacaataaaacctatttatctttagcctaaaatctacagacaccagcttgattcactctataatcctaaatcatcccatgctctgctttcttcccaaaatctaccagctaatgattgtctaaacctcgtggatcacacttcctcaaagagcttttatagctaatgtactcccatggaagtaacctagattcataaattcatcaccaatgcccttggtaataaaagtagtctcttaattgacattccagtttctggactttacctactgcaacacagagctgtgtgatactaaggtgtcatgctaaaacatagattataatatgttatgtctccatttaaaactttgtgacaatataatattttaatttatttataaacgtgacagaagaaaatataaatgcctagattttgcatataaacctccctaatgtaaacacaactctttctaggttcatcttccagtgacattgtcccatatatatcttctcattctcaaacacagagcagtatatttcactgctgatctttagctcccaagcctacgtgtttccccaaacaccccagcagcacatgtttcagtgcctttgttcacactcttgacttcctctccttatttgtacgttcactcatccatccaacaagcttattaagcaatgataaacatcagacactgccctgagtaaaaggagtagagtaggcagaagacatagttcctaaccactcacacaactaagaattttagtagaattacaaaccagagctatgaatgaaaaataaagggcactgtggggttgaatcacaaaacctatgccaatctgagaagtcatagaaatcatttcccaaaggagatgacacataagccaagaaatgaagtatatgaggtgggcaaagtgaagctatctccttcatgatacttttctaattatcccaattaaaatcaacaggtttttaaatatacttaatagctgtgatataatgactaaatgtaatactatacgatcagtcaagatatgaaggctatttaatagcatgagaaatatgtggaaataactatatatatatattgttatttactctagcagtataaacactgctagaaaacaaaagttttgaaaagcttaaaggaaatttaaattctacgatgaaattgaatagtgtagtggagtttagggtggtatttttttctttcatcaattttctaaattttctgtaacataattattctataatgaataaattatggcagcttaggtaaacaagctttatataatcttaatgaaatacataagtaatgttttatgtgtacttaactattaagacactgatgaggtttggttgcatccccaaccaaatctcctattgtagttcccataatcctcatatgttgtggttgggacccagtgggaggtaactgaatcatgggggcagttaccctcatgctgttcttgtgatagtgagtgaattctcacaaggtctgatggttttataaaaggcattttccccacttcgctcagcacttcttcctgacatcatgtgaaggacgtgtttgcttccccttctgctatgattgtaagtttcctgagacctcccaggccatgctgaactgtgagtcaattaaaccactttcctttgtaaattaccctgtctcaggtatgtctttattagcagcgtgagaatgaactaatacagacatacataatactgtatactgtattacctataacacatatatctttcatgtaaaattgcaagcttctcagtcatatttatgaatcttctgccatcattcactcaataaacttcataattaaatactattttgatcttcatatttccctacttaaagactttattagtttctataataggcattaatatacttgattttctgttatgtcccatcaaacttttataaaagcatcactttcagtaaaattttgaggtttttaaagcttaaaatcaacacctataaaaaattaaaaataacaagtgtgggcaaggatgtggagaaattacaactcttatacattgctaataggaatgtaaaatgattcagctactgtggaaacagcttagcagttcctcaaatagctaaacatagaattaccaaataatacagcaattccaatccaaagtatttatccaaaagaattgaaaacaggtattcaaatacatgtacaccaatgttcacagcaacactatccacaatagccaaaaggcagaatcaccctaaatatccaccagtgaatgaatggataaatcatggtataaaactacaatggaatattattcaaccattaaaagaaacatagcactgacacatgctacaatgcatactcaaaaatattatgtaaagtgaaagccagatacggtaagtcacatattgtgtgattccactgatatgaaacatccagaacacataaatttataggcagaaaacagattggtgattgccaggggctaggggaagtgaataatggggagagactgcttaaggggtccagggttttactttggaatgatgaaaatgttttagaactagatagaggccgtactaaaagccacaattattcatagttaattttatgtgatattaagttttatcacaatttaacaaaaatcaacaccaaacaaaggagcaattttcaggaaaaatacctacaaaatgtgttagagtatgtttgctattaattgctcctggtttgtagacaccaatcagggtgcatccaacaacaacacagaatttacctataatttttactttcctccttcttactttttgctgctaaaacagaaggaaaaaaaaggtgaatcattttagcatctaggtcctgaacctattccactcccaaccaccttcattattctctgaatttttttaacctaatttacaagagtctgctattcactcagagctaaagtcatcagaggcagagttaattggaatctagatcatttaaatatttctactccccttccaaaatttccatttgcttaaaatgaaaaaagacagtttgcttgaggaggctgaaattattgcatttctgctttaaagaaatgaaaaagcattcatttatccagcaaacattcaatgcccatatgtgccaagcattcttctaggtgcttgtgatacatcagtaaatgaaacaaagagctctttagtaaaggagcttaaattccagtgggagtagggagagaataagacaacataccgaatatataagtagctaacagtatgttagaaggagataaatgacatgaaaactacaacacagtagagaaaatggggatggcgtgaggacaaaggaaaacatggcaggattaatttgggagttgagcatgggaacctcattgagaaagcgacatttgagttaagacttgaaggtggtaaggggctcatggagcacatatctggagcatgaatgttcctggcagggaaaagcccatggcaggagtatacctggcatatctggggtacatcatgaaggttgcccagtatggtagaagtgaaagaattgaaagagaggtaataggaaatgaagttggcaagccaaggagtgggagaataaaatgtttccagaagcttcagcattttccagatactgagaaaaaagggctcaactgtttgaaggtagaaagagaactacatggaatgtggaggacaggggcagaatccaggtgggctctccaatgcctggtgaaagacgtactctaagtcagtcagccacagctcccagaaggaaccaataggaattttggtaggagataaagaatgggtaaggattacaaattaaaacactcaaggataaatgatgaggacaaaaggaaggggcaatgaaatgcaaagccaaatttagagaaaaaggagaccaatgttactggagtaaacgatgtgtagagcagaaaagtaacaaggagaaaatagctagatacacaagttagacctgattgcagaaggctacaaatgccagactgagaagtcccttttctttttaatcttttcgtatgtgtgcatacaaagtatatgataaatgggatattcctcaggaccataaatctgaagatagtttgcattattgtctttaaaaaagaatatgaatagaaagagcaatttggaagctatttttttaaagaggtatttgaagaaagtatgtaataaatgaaaggctatcgctgtttctaagtgtcaagaaacaaaataaggcaaaataggagatgtaactgtgctgtataagtagtcagggttcctgacaccaaggtccattccataccaatgcataaggtccttcaagatgcacctagtatgctctcatgcctttccctccctcctgttctctaatgtctgtgaacaggatagagaggaaagaacaaaagttatgaagtcaaaaagtaaattcttgattttcaactcctttctaataatgcaaccttgacagacagagttttaacttttgagtctcaccctcttacattaaaataaggcaaaagcctaaattacaaatgtgaggactgggcaccatccctggggttattatgcaaggcactcatttttcctttaacttgtaagttacttcctttatctcattcccttttgcttctaacagctgctctggccttataaccccaatataatcaaaaataatgataaaatttgggttattatggttgtaggacatgcttattcatcaagaacacattcacaaaacaaccgtcttaataacggatacctcagagatacaaaagtggacaggggatgaccatgtcaggtggttagttgacttctctggattcaactctcttattaaataatataggtgtgtattagtccattctcacactgctataaagaactacctgagactgggtaatttataaaggaaaggggtttaattgactcatagttccataggctgtagagagggcatgactggggaggcctgaggaaatttatagtcacagcagaaggacaaaggggaagccagtacatcctatatgactgaagcaggaggaaaagggagtgaaggggaagtagctacacacttttaaacaaccagatctcatgagaactcaatcatgaggcagcactaaggggatggtgctgaaccattagaaaccacccacatgatccaatcacctcccactaggtcccatctccaacaccagaaattacaattcaacatgagatttgggtggggacatggagacaaaccatatcaaggtaataacaaatgaaataatccaacgattactcaactttagattttctggtttatggaatattctttcatatatatatatacatgtatatatatatatacatgtatatatacacacacacttttatatatatttgtatttgtatttgtacatatgtatttttatatatgaaaaattctattataaaactattactactgatatgctttggctgtgtccccaccaaaatctcatcttgaattctagctcccataatcccatcatgggagggacccagtgggaggtaatcgaatcatgggggcgggtttctcctgtgctgttgtcatgatagtgaataagtttcatgagagctgatatttttataaagggcagttcccctgcacacggtctcctgtctgccaccatgtaagacgtgcctttactcctccttcacattcctacatgattgtgaggccttcccagccatgtggaactgtaagttaattaaacttctttttctttatgaattacccagtctcgggtatatctttattagcagcatgagaagcgactaatacagtaaattggcactgcagagtgggcgctgctgtaaagatacccaaaaatgtggaagcgactttggaactggataacaggcagaggttggaacagtttggagggctcagaagaagacagaaaaatgtgggaaagtttggaccttcctagagacttggagggctcagaagacaggaagatgtgggaaagttcggaacttcctagagacttgttgaatggttttaaccaaaatgctgacagtaatattgacaataaactccaggctgaggtggtctcacatggaaatgaggaacttgttgagaactagaataaaggtgactcctgctatgttttatcaaagagactggcagcattttgcccttgccctagagttctgtggaactttgaaaatgagagagatgatttagagtatctggtggaagaaatttccaagcagcaaagcattcaagatgtgacttgggtgctgttaaaagcattcagttttattcattcagaagatatggtttcaaattggaacttatgtttaaaagggaagtagagcatagaagttcaaaaaatttgcagcctgatgatacaatagaaaagaaaactcattttctgaggagaaattcaaatcagctgcagaaatttgcataagtaatgaggagccaaatgttaatcaccaagccaatggggaaaatgtctccaaggcatgtcagaggtcttcatagcagccactcccatcataggcccggagacctagaagggaaaaatgatttcgtaggcgggccagggccttgctgctttatgcagtctcgggacttggtgccctgtgtcccagctgtagctaaaggggcaaaggtacagctcaggctgttgcatcagagggtgcaagccccaagccttggcggcttacacatggtgtcaggactgtgggtgcaaataagtcaagaactgaggtttgggaacctccacctagatttcagaggatgtatggaaatgccaggatgcccaggcagaggcatgctgcaggggcaaagccctcatggagagcctctgctagggcagtgtggaagggaaatgtggagtgggagcccccacacaaagtccccactagggcactgctgggtggagctgtgagaaggcagccactgtcctccagtccccagaatggtagatccactgacagcttgcaccatgcaccaggaaaacccacagacactcgacaccaccccatgaaagcagccaggagtagagatgtaccctgcaagaccacagaggcagagctgcccaagaccatgggaacacacctcttgcattagtgtgacctagatgtgagacatggagtcaaaggagataattttggagctttaagatttgactgcccagctggatttcagatttgcacggggcctgtagaccctttgatttggccaatttctcccatttggaatgggtgtatttacccgatgcatgtacccccattgtatctaggaagtaactaacttgcttttgattttacaggctcataggtggaaggaacttgccttgtctcagatgagattttggactgtgaacttttgagttaatgctgaaatgagttaagactttgggagactgttgggaagacatgattggttttgaaatgtgaggacgtgatatttgggagggaccaggggtggaatgatatggtttggctgtatctccacccaaatcttatcttgaattgtaactctcataatccccacgtgttgtgggagggacccagtgagaggtaatttaatcatgggggtgggtttttcccatgctgttctcataatagtgaataagtctcacaagatctgatggttttataaagatcagttccccttcacatgctctcttgcctgccaccatgtaagatgggcttttgctcctcctttgcctgtgccatgattgtgggtcctccccagccatgtggaactctgaggccattaaacctctttttctttataaatacccagtctcaggtatgtctttattagcagcatgagaacagacaattatagttaccatgcagaagctgacacaaactgccgtttttcttgctattagtactgaaaaactgccgaatctgcaaaagtatttaatgaaaacacaaacaactggtcaattttaaaatgtatttatgtatatacagatacagaagatacaaaatgaagtaaaataaaacttgggaaagtaaaatattcagaaaaagcctaactttaaaatagaaaaacataaaatctctaaagactaatacccctcatttaaaaacaaacacaattatcccattggctattttagctctcctgggttgaatcttatgctagggaaacagaaagccaaactgtcccactgtgacctgtgaaaccctgaaaaataattggttctctaatcaaaaagaaaagaagattaaaggagaaagaagagccctgcttcaggaagaatgagtctaaggtaatatgatgatagaagagtggactggaaaatgactaagccaacaattaaattaaaataaattgcttattttgtgtgaaatgtcgctgcaatagatcttttgataaatgtgatttccctcagtgataaaatttttccaattaaaataaactttatatactgtatttttaattatccatttaaatatgcaattataataacatatattttccatgttgtgataaaattatatatattcatatccattattaggtctgcgtaacatttgaactaggaaaaggtctctattgccagagtctctatcacatgaacagaaatattcaagtaaaaatatgttgtgaaacatcataaaacaagagtaacaatctgtgttttaaaataaaaactttaagataaggaaacttagtttatcaacaggcaatgtagacattgttatcttttaaaagttaataatgtataaatcttttctctagattagaactagtttctctttcaatcttaaatagtagtgagagtcacaaaaaatgtttttaaatgccaatggctctttaggtttatagaaagtatttccaggtttaaaaacatatatgaaataaaaacatatataatttaattatttcccagaaaaaaatgaagttagtagtatatattgtaaactgcaaaatatataatacactatgatacttgatgcacattaattaaatataatattttgaaaaggaaggggaaaaaatctttcctggtacttaagaaaacacaatataagaatttttcctaaaaatctagaaaggcatttttggctgtggtgacaaaaacatatgttaatgtgacttgatatagatctaaacttcaataaactttttttttttttttttttttttttgagatagagtctcgctcctgttgcccaggctggagagcaatggcacgatctcggctcactgcaacctccgcctcccgggttcaagcgattatcctgcctcagcctcccaaatacttgggattacaggcatccgccatcataccctgctaatttttgtatttttggtagagatggggttttaccatgttgaccaggctggtttcaaattcctgacctcaggtgctccacccacctcagcctcacaaagtgcggagattacaggtgtgagccactgcacccagtcttcaataaaccttttgtgaatagaataaatgatttaagaagttgagtcaaaatgccccaggactcctaaaatggccttcctataaaaggaatgcaagctaaaagaaagtgacataacacaaatatgttcatttaactgtgaaataagaaattttatggcatagagttgttccacagcctctgctgccaaagatatcaatgccctaatttctggacccagtggatattttaccccacatggaaaaaaggaactttgcacatgtgatcaaggttaaggattctgagatggggaagagcagaatggattacccaggtgggcccaatttaagcccgtgtgagtctttaaaagaaccttttgtaacttaggtcagagttagagaaggagatggaatcatggaagccaggcgagagagatctaacaaaatgacttgctcggctattgctggctttgatgatacaggaaggaggccacaagctgaggaatgtgggtggcctctagcgactggaaaaggcaaggaaacacattcttctccagagcatcaagaacatggtcctgttgattttagattagtgagacccatactggacttatatagaattagaagatgataaatttgcatttctaaagctgctaaatctgtagtaatgtgttatagcagcaatagaaaactaatacaaaggccatttgtgagcataatgattcttcctgtctctagctaagctaagctgaaattgaagggaaaactaggaaaaatagatgagaagctaacctagagttctcacatcactgggatattgaattaaccaattctaggaccaccaaccaccagacttcttgttttaatcattccctgcaggcaaatttcctcaatgattcacaagacaagactgatttatatacactaatacagaatgtaaaattctaaggtttttttccaatcacagatttggggggctataagtcatattctgagttgaataattttcacttcaagagttctgtcctcctcatctattacctgtgaagctagtagggaagtataaatattcactttcatttaagctaaaaactaaagacatttctttatgtgtttccttaataatttgtcaccagtttaggaaacaagtatttagttgaaccgtgtgaaggctgcgattgtcaaaatggtataatggcatatagttcactcaactaatttctattagcttgcaccacacaaatggaggagaaaaaaaggagtaatccattcctaaaaaattatcactcttccaaaccttctgctagcaatctatgaaactaaaaacattaagagttatcacgcctcctgcaaacccttgggagaatttagccatacgctttatctggcactcttatttgcctatcaaataaaggctctctatgccttaattcaacccagttccataattatattgagccatctctaccatcctcactaatctctgaaaatgtaaataactgtcaaaaataatgaattattagcaaaaacaagtaatattttatgagactgaatgagcttttcaagatcacccccaaagtcaccagttctatgctctaaaactgaatcacaacaagaaaagcagtttagaatctcagctttcaaatctcaaaattacaaatattattaggccccagtcccataaatgagtcatcaactgaaaggaaaaaagtcatggaaaaaaaaaatcagcaaataaaaacgagctttatatttattcctgattcaacaaatccctgtctcgagaaacttaatgaagcacttgacatttaagacatacataaaaatgaaactagatatacagaataatctattattattttctaaagttaatggtatgaactagtgttacagtagtctccataagtggctattaacataggtcagttaacacagtagtttcatgatttagaaagtttcacttgaaagcaaggctacagtgaacataggccatttaacttgttacattgtggaagattcagagatgatacacaaaactttacaagttgaaatgagttctgtattctcaacatttaagttcagctaacatttcctgagcaactacaatgagctgggcactgcaaaagatgctttacaatatgcattatataatcctcacaataacctcatgatatgggtattatgtcccccattttatagaggaaagaaactacgctgtaaaagccagggtcacacacttgtagggtggactccacaacatccctcacttcgcgtgtatattacacagcatggtgttagtatttacagctcaaatacttacagaagtgaatagaggtacgaaatgatgaaagatggttttaataaaaaatggcaagtttttaaagcctttaatatacattgtggaatgagggtgaactgctgtggggcagtggtaaggtggcagaagatgagaggaaaattattttaaatcaatgcagagcactttaaataaaacataataggatttcttttaatcagagaagcagcatggcatagcacaaagagcaatggctttagactcggatctgtattccattcagaggggctgcttcttttagctgaaattcaccgaagaatgtaactttcttatatataaatgtatacaatatctgccttgattctttcacataaatgtttctgggagcaaataaagtaacataagcaaacatttgactagtaaaaaatacatcaataatatgttgttttattattatctaattaatgagtttcatattttgtccagatttgacctaagtatacttttattaataaatgcatcagagtagtctgctaaagtgagattcaaaaatggacagtctgatgttgaaactgccttaaaacattattctaagttggatgaaatatttcattacatgtattggttctttgaattaaaaaaaagaaaaaaaggcaatataaatttaaataggcagcagttaagctgaggctcaggcccaggtctttgatgttacttcactctcaccactgcacaaattagagagtctaaattaattcttaaccttttttgccaaagaccccattgacagtcaaagaagtggaccctttctcaaaatagtatttttaaatgcataaacaaaaatacataggatttcaaaggaagtaaattatacttgaatgcagctatcaaaatgcattaaacagcagtttatgaaatagtaatacacatgtgaggaagcaatgtagatgtgctgctcagatctccatttaggaagaactttccattcagccgcaaggagtgcatttagctgacaggcttcaagttgttagcacctttagaatcctccttagcttttgagtccaggccacactcctcctgggcagcccccagccaatggctgagcctggcacaagtagtaaggactgccattaggacccaacgagggactcccctcacaggcatcatttgttccagagctccttcctggctagactggctgagaatttatcaggtttacaccatggtctaaggtttttcccgcccggtcttgcatcctgacccttaaaaaaaaacacatttacactccagcatctctgtgtctgcttccaggtggaagcaatcaacaaaatctgcttctttattaatgaattaaataacaagatctagttgcaagtctaataactaccttaattttgaaatactgatcattttaaatgatatttcaacttaactaaaataattctaatgtattttgaaagtatatgtgaattgtactcatggaaacttaataggtactgctatgtttgttacctataattgaagaaaaagctaaatttcaattagaggttaaagtatgtgggttttttttcctattcaagttcagaccccagaattctatttgcagaccccaagttaagaatcctgggataaagtgtctgattttgaaacatccattcttttaagatacagagatgcacttagacaagtgaaagctgtggttaacaaaaggtctctaacctggcttacctactcagatgccaacgcacatgtgaaagcttctattaaatgcacagaatacattataagatcatatgcccaaatgatttaaccttgagggacaagaacagcttatctaaacacatgaatgcataatcacctaaaaatctaaactgtgaaattcaagattctaaaatatataataaagttatttttatacagatttttctaagaatatactatactgtttaacatcaaaatgctacatagaatttactacttactatattataccatttatttgctatactatttatttaataccaaattgctatatagcatttaatctagcaagaagtcctctgtatctacttctgactctcctatcttgaccctattctcttcctgtgttccaaggatggtatcaggttaccattctaactctaggtgattccatctcttctagccaggcaaacagtgtatgtaatgggggggaggggaagggggagaacaggtaaatgaatagctagatttacaaatttttcttcttaaatagagacagggtctcactctatcacccaatctctacttttgtagagacaggtctcaatacattgcccaggctggtcatgaactcctggcctcaagcaatcctcctgtcttggcctcccaaagcactgagattagaggcatgagccattgtgcccagcctcaaaatattattaatgccctaagattacaatagtgcattcagaaggataagcctcatttaaatttccaggtgaataataacaagcactaatttgagccagagtcttgaatgacagaacatgatgcagacaaggcaaagaactgcctaaaatagggaagtgaactttaagcaatcggagggcaactggaattgccctggtgaaatggagagtaaggcagaagacagagaaaatggaagataaattctgagacaaaaggtgtgagataacaacaatgaaatgtaacaactttataattttgttaagggatgatagctacggacacaccactaagaacttactaccaagattaaaatatcaaggtcaacttgtaatatggaaaagcaacagtatcctccaatctaccattcgtcaagtgactccagtcaaatccattaccctagtatctttcctttctccagtagaagtaggaaaggagaaaaaagaaggaaaaagctatgtgtatgtacatacacacaccaatacacatacaccctagtttcctctctttctgtttgtaacatctgtacagtatgcaagaaacatgtctatttatagggattcaaaacagacatgttttttgtatactgtacagatgttacaatgcataaatttctaccacactataccaaagatatgctgtaactaagcatttaaccaaagcattaggtggacttgcaagtcttccttggctccaagctaaataaatccactttctttagcctctgtctttagttcccatttcgctaaagctttcaaaataaatttccatttcttccgcaccccaacagagaatatactataactggtaacaataagatcctttaatgggaagataagatattcttgacccatttcataatttctttaagtctttactacttttgagattcagccacagacaagaaccaaatgatatgtccctagagaaatatttcattctctactgactttctccccaatctttccaaatcagtatttgtgaaatattctgttcttttcaggaaactttactatctataaaacatgttgcatttattttggcatcatctctttattagcatgcattacaaaaaaacatatttctatgtgttcaccttaatgtagccttgtgaggtagtttaaaaaattttatacacatttgtttgtatagaggaataaattatgtttcaaacacaatgcaacatcttgaacaccgccaagttgctgggataatccacgtttatcacctacttcctcaattctttgtccactgaactatgatgtcagaaatctaagcttgatttgtttttaagtggataatccattaactgtttccatatgccataactattcagttgagaaataatttataaaccaatttatgggccctatctggcaaaaatgacacacctgttataaaatatgattacttcagaaagctaacaattgtggaaccacattttcataataaattagtctaagtgaattagactattcatatactttcagaaagccctttaatccctattaacagtttgtgaataatgaaagtagttaatattaattttacttgacaaatccaacaccaataacctgttagtatactctaatccattttccaacagcctgtaaaaattaaccaacagatgcttccaatctggtaaaaaaaaaaaaaaaaatacataggtcattagcattattttgatgataccaaatgttcaatatatgaatattatgattaaatttcagagagatagataaacaatctttttttataaccttgttaagtcttaacagaagctgaatttagtaaaatgtcagtcttttctaaaatcaaaatcagcatttgttattccactccttgttattatgcttcaactaagtacttgactgagtttcatcaggaatgtaaaagcaacatgagtatgggaagcacacctgccttattcatgctggtatccccaatgtcaagcatgaggcacaacatgcaatatgcacccaataaatagttattgagtggaacagtggtagccaataagaaaaagtggaaggtatgaaagaggaggtatgagaaaaagaaaaaacataatctggaaaagtgcttatatacatttccagaataatttaaaatacagaaagctaagatgtctcccaaaaacttacaacagagagaatcaagaaaactgaagtgagctacttaacagcaaaataaagtgtaaaagaaaatgatgtaagtgaatcaggaaaaaattactgatttttcacaggaaaaggattagagaggattcctattcctctacagatatggcacaaggtactttcccacagaagcgttgttgtaaatggtcacaaagattagtttaaaaagcagaataggtaagatctaattggaaaaaaaaaagtaggaatgtaataaaaggcaacaggaattaagaggaaagagccaagcccttaccaagaatatcttggtaatatgtaaatgtaggtagggttggatagtatcacaagaagccagaattgttttgccatcaggagaccaggagaaaagatctcagctgagatacactaaagattaaacaagataatatgaagagaacccagctgaggcactgatatatcacgtatgcacaatatctgatatagatattagctccttttccaactctaagtgtattagacctgtaaatcccagtagtctaaacattagaagtcctgaaaacctaaagtagtgtctaccataagaaaaaagccccacttacttgacaacaaataaagtctacatgacagaaaacttcaaggatctctttaaatgattggattcagttcctttgttcttactacccaatttgaatgcttgggaagcacaaaggattggcatctatcatttaaatgcctgggatggaatgtccatctttgtaatcaaagaaatagcctcggttctcagtccaaacagttactactgcaatgaaaaacagagatacaccatttctctaaaaaacccactattcttcagtaattaccatccttccctacctagttgtgatgaaaatcagccagcagccaatgcctctacctcctgcactggcttgcgaaagggtggaaagacaaatggattttcaccttggagtgaacaatacataagtgaccaggtttacttttgtttgggggtttgcctgtttttgtttttttgtttttttgtgtttttttgagacatagtcttactctgttgcccagactggagtgcagtggcgtgatcctggctcgctgcaacctctgcctcccaggttcaagcgattctcatgcctcagcctccggagtagctgggactacaggtgtgcaccaccatgcctggctatttttttttttaattttttttagtagaaatgagggtctcatcatgttggccaggctggtctcaaactcctggcctcaagtgatcaacccacctcgacctcccaaaatgctgagattacaggcgggagccattgcacccggccatagttttgaattctgcagcaattacaaaattgattcaaacaaagtatgttggactcagggagatacgtgaatgtaacatttggacccaatgcctcagcagccaggccatgaataaaagaccacaagtagacctgtctacttgaccagtcctgtctaagctctctggacatctttctctttccttcctttctgatctttcctattaaatgtctatataaaatcctgtttctctgaacgtagcaatgactggcctttcctataaaatactctgaagtgttttacatgtaaatacacattttaattgtcatatattctccttgattgccagatgaccagtaatgccaaaaagcactcttaggactcctcaaataatgctttctaggaattattctttaaaatgaagtcccaaaaaaatagtcacctttacagctcatctctgcttaccactgagaaatgttagcagggctcggagtcacaaccctgggcttccccactctttgtgttccccctggaaatgtcatctactgtcacagaaaaaaaagaaagcagcatttgagttgaattgagacagaaggtatcatagtcctctgccagcctctaagtcaagtaaagagattccaggccaaaggaccagcagtacaaaggcagagagagatggaaatatggagtatgcaaaaaatgatcaccttttcaccttaatctttctaactagtattagatagagcaaatacatcatttttttattcaaccttgaatctcaaggctaaagttagatgacttaagaattttttaaaggtccaattatttcatttagggctaacattgcagctaaattaaagacatgctaacaagtttcccttttgagcctcattaattaagaaagtaatcagagtaaggagaaaaagagagtagctgtatggcagaattacttaaatagtttttaggtaccaccatttgtacctactaggaaagcaaaaggaaaactaatcaactccagattatgaaatctgaaattctgaagtgttttacatgtaaacacaaattttaactgccatgtattttccttgattgccagaagagtacactaatcttatttgaagaaaattttgatcctccataatcaaaaggtaaaattaaaatcttattcacaaatttactagggtgagcttgctgagaaaattctccctgtgttcaaagaccaaaaatataccatttttaatactttagtcaggataaatggtactcaaaaatatctgttaactgtttttatcaaattctagaaaactaccttaatttacaattaccttttggagagagtttctaatttacattaataatttcttaatttacaattaccttttagaaagagattctaatctttcagaaactcattcaaaggaatactaatacatttttaaaatatctgccagcattctttggctgctgtgctcaagttaaacagatacataaagcatctagcatggtgcctggctaacagtcaacatttaggaagtcaactcaaccctctacacaaaggtctctgacctgtatccatccagtacaatctctccctgccacctcttcctttgttctatgagcccagggatataggtggcataagtctatagtgaaaaatttctttttgaaaattaaaaggtaatgattgatctaagtgttttgcactacagacctaaaatgtaagttttatataatacttaaaaattctgtgtggatatcagccttgaaatgtaagtagcaggcccacgaaattggatgaaataagttcaattttcacttatgtaatacctaaacaattttttaaaaatcacactgcacaggtaaaacctatcacaaaacattttggaaaatgaatgccattgcttttaatgaaaagatcatataacctactcagatacttctctttcaagctaactttgaagacattataaatctgatatttttatcccatgtgactcatagcaattaattaaattatgtgatagtcactgtaattttttttggattatactttaagttctgggatacatgtgcagaacatgcaggtttgttacataggtatacacatgccatggtggtttgctgcacccatcaacccgtcatctacgttgggtatttctcctaatgctatatgctatccctctcctagctcccctagtcactgtaatattaaagggtagtaaaattctaactacaagaaagcacacattttgtttttctatttttcaaactgaaggaccttctcatgccaaaactgtcacagaaaatatcctcttttacaaaagtctaatttatcccaatggaatatcttcaaaaataatatcatatagaaaatttaataatcaaaattttatattaaccttttgcatttttaaaacagaatttactttttaagcactttatttcattataccatttatttgcccattaggaatgtaaaaataacatgtacaggattcataaaataatgttttctgaaaattgatacataaaaagtatatgttaaaattctaaaatcaaattaataaataatcaagatgttaaacttacctttttgttggcaacaaaatgtattctcaagtttacaaagcaaatccacgttttcatacttattttcatttacttttatccagaaacagttttcagtcatttcatgaggtctgatctacaatcagagagaagactgattcatcaataggtgagtgtttcacctgtcccaagtcaagcactatgcatacactgagtatcatagctgtcagcagatatttataaagtcgtatctgtaagatttttccctgaagtgtgttcaataagatacaagttctgcaggatgttaaggtcttattaggaagaaaaggcttccatgatccaatagttgaggatttgaaatacgatttaattagcttcttctcaattgcatttctcatagtctctaataatcttcacctgcactatacattttggtgggcaggacacattatacagcattttccatgtttctgttaccatgaaaccatttttctgcaggattctgaattcttaagatctgactagatattagcttctgacaactagttaacactttcccaacatctatcaatagagaaaatttcctaagaacaccatcatttttttttgagaaacacttcataaacataggattcactgcaataatgtttaattatcaatttaattacaaatcggattccactggaacaacatcaactctcactgtatttataaagcagaaagtcttagtcaatatgaaagggatttgtcccaatactttaaaaaaaaagctattttattgtcactttgattagtgacattagaaattatgtatatataaattaaattatgtaggcataaattaaatctcattagaaattatgtatatataaatccaaaattagatttagatctaagtaaaagtattttcctctattaatttcttttacctttaaccaattcaatcttctcatgctgatttcaggtttaaattctttctttggtttcaacccaaatggcaggattggtagaggaggagaattttgtcctccaaggaatcccaggggaggtggtggaggcacaggaccactgaatggcatccgcattcctggaagtggaggaggtggtgggggaggaggtggaggcggcacccctccaccagaaggcagtggaggcggaggaggaagtgctgagtggccagttccaccttctttagagggaggcaaaggaatattacaatcagctggcaaggcaccaaactggagaaaaaaacaataagagacataactaagaacatatctacaaaacatgtaaatatgcactttactcaaaaataaggcattcatttaaaccaaaaataattacatatcagtaatttcataaggtttaaccaaaaatcaaaattccaacaatttttcttctaatttaagaatataattatagctttttttccctcataaaaacataattgccagaagtataattccctgttttgaggtagttatgaccatctaggtagaaatgtccaggagggaaatgggtatgtggatctagaagatttgaaaatcagtagtctctggagaacagttgaagccagggaagcagagaagttcactcatagtatggagagaatatgtagcatgacaaagggtctatgcacagagttctatggagtgcaagcatttaagtgataagtaagaaataagatttcaacaaaagaacttaaatggtattgccacatcatgactttgctcaaatcttctcaatggtgtcctaatgcacttgagaaaacaacaacaacaacaaactaaaattcttcgtaggacctatataagtatatcatgatctagtccctgctatctggtcttgtaggggactttcttctaattctgtgtatgtgccaacctcatgctaatttcagggcccttgtacatgctggtccctctgcctggaacattctcttcacctgaccatctcctactagcctcttcagtctgagctaacaggtcccttccttgggaaagccttatctgaccactcattttacactgatagcaccttgtacttttcaatagctcttatcaaaagtgagaatttatttaaggaatcattagcatttatctctttgacagatcataagctgatgaggtaagtgactatcttgtattatttactgctctttccccagcacctaaagcagtgactggtgcatgacagctatggaagaaatgcgtaggataaatgcatgaaagacaagaagagaaaaagccaactgggcacagggtcaaaaactatgaatgaagagagcaccacctaaaagactgctttgcagaatcaaatgccacagagaagcaaggtaaaatcaggggtgaaaaaagaaccgcctgtgtccactggtcacttttgtcctcatgtttccatggcataataagaatttaacagatgcatttcgatggatacaaagaagacattctgggttaataaataacttttgtaatatgagtagcttcttgaaattacaaacttcaattctaactacctttaacatttaataaatgttacataattttgaattttcatggcacaattatgaaaaatagaccatgtataaaagctcgaaatcaatgacgtctgaaatcatgacaaagaaaacagtgttataaaagaagttgaggccacaaatcaaaagcatgccttatcaaaaccattaagtataaagaagaaccagttcagtgttactctgggttgctgtgatcaaagatgatacttccttttgaacgtatttaataattaactatcaatgtcttaaagatatggctgaatttctgctctagaatagttcatttgataaagtgtgaagactgacttaaagatatggtttgggaggccagacactgtgactatcttgctcatcactatgtctctccagcacctaaactacctggttgtgaagagactacgggagcaaaggaattaaatcacagataacagaacatattttattcatactcttcatagtcagcatagctttgaacaaaaagaaggatcttaagataaatgcccacatttcataagaaataaaccagaatccaaagaaagaatttgccagttgttcaaacatgaatatggtggccaatattaagtatctaattctaggttttcttctcatagccataaacatgggtcatcactgtatacaatttaaaacaatttaggagattccttgatttaatttcactttcaaaacatacacttattcccattttatgtaaaagcactatgcagcaataacttattcaaaaatggtggatacgttttttataaactggaattttctggagatttacaaacaaaccttcaactgaacataattaaaaagaaaagaaagttcttaaatttacgttaccccagaccaagaaaaacttgttataaatatttcagccactgtctgtaactcagtctgaagtacagacacaatcaaatgtttctttcaatatgagagacaaggaaccatatgggaaagataaaaaaaaaaattcaataaaatgtgatacttccctcttgcagcactaaagaaagaagatgaatgagaataattttcttgtagataggagattttaatttttttctaaaattgaatactaacagatagctatctcttaaggtatctccagacagcctcagcaacaaaactatccactaagcatttaaaagaaaacaaaattgccagtaagataggatatagtatacctgagactatttcaacataactgtaaattaagatgaaaggaaaatagcaaaactatacttattgctcatcatcctgtacgtaaatctacatgaagaaatttagctatgaatattctacctccttacttacatccacataaagcatgcagatgacgtatttcttgctatctaaatgttttatgtgtagagggtgcatgggagctatctgcttcataatccagatttactctcttttttgtcatgttttaaatctgtttactttggaaattgaaaaattatcagaaaatgttctcattcagctagaggttatcttttactgcaagggacccctaggctgaaggttttaaaaaataaatagcttgagcaataatttcttgtagtgggataaagatcagtgatgaataacaaatctgagagtaaaagattttcttactctttatgctgaattacttaggaaacatgtgacattaggaacaaaaccctaacaaaacataagaaagcagattaattagtaaaagcttagatatacatacatatagaaaaaaatgacaaaaaaatagcaaaacacagtacaaataatgctataaaaatatacaagcaaaattaaagtttaaacattttgatgctatgaagatataacataacctttgctccctcactgtgtttttaatacccaaattcactcagagtggaattttacctgagacttaaaagcttgtagctctgcttgaagctcattaatctttgcctcttttttctgcaattcagcctgagtttcttggtggtcggtaaactctttttcaaactgaaacaaattaaaaataataacaaaaacaggaagatgaaaatgaaaagcactattcttcttatagaaatgtgactcgaatgatctgccggtagaacacaaattcctgaattggttttatgaaaggagtgatagagttttgaaaagtcacttacagtctttctctaggcccctccaggtcccaaccaaaatcgttcattcacaagggggcagaaaaaagccatagacaagtctgtgaccttctctctgcagagcaaactggccacagttatctgcagcattggcatttttcttcaaagtctctaaatattattgtgactttgtgtaaaataatagagagcaaagcattgtacaaattccttgcatcttccacctgcaaaaacttattcttgaaacttatctgaagtatatcaacatgatttagaggatttcattttaatattttttattactaaacaactccattctattcagtttctaactttttttcttgtaacaacataatatctcctgatatctttgggaaagtaatgataaattaatttttcaaagtccctagtgaaataccttctggaaaaaaaaggaaacaataaaatttggtgaatccagtgaattttctataataatttatatatccactcatcaccagttctcatcttgcattcaaacacattcaactttgccattattatgactaaaaacctcctttttgctcacaaacacaagcatttgactttcttaagaaaaatgaaaaaaaaaatcaatcaaaaaaatgcaactatctcacaaatgtggcctccacattttaaatacactcaaaccttaattaggaaaataacaacaatgtagaactccaccgtttacaaagggattttatttttacttagtttataaagggaatcttactttgtccttaataacactaagaggcagttgctagtccctcatagctagtaaaagatgtgagattaaaaagccagattccccgccttcagagtctaagttcaaatgaaactatgccacctccctgcaattaacgtttagataatgctttacggttttacttaacagactattttttggagcagttttaggttcacggcaaaactgagcagaaaatagagattttccacatacccccaaccctacacatgcattctctctccccatactttatagcttttgaagcataaaaagaagcattcttaaatttcattacaaaaactctgtgaaataagaaatactgctttaattcccattttacagggaaggaaggtaaatttcagactactgattctctcagtctcaacctgtgttcctttattaaaataacaaaaactaataggtaaaaactgtccaaatgtccttcagttgacgtaagccacagcaacactaccattccccacaactactacggctcctacaaacccctcttaccgttaaataattaaaaagattctaagcctatatctaatcaaattactaactacaaaacaagccatgcatgagtctcagaggtccgcccaccttctcctgtcacccagtgcttccccctaaggacttgctaaatcaattgccttcacacctcccttgcatagtttacctctctgtactttcatccctcattttactccttataaccccttaccataatccctctttagcttaaaagtcaactttttcaaagggtattcttaaaccacactcacttttctgacctgttgaactctgttcatttcattatctatcacacttagctataattcattctaaaaacgctgacttaccaaattccaattccagaagtccaaattccctggactgctctcagcctcatcttaggtgatctctctagggccatgctatttcaatatcatagccactgaccacaaatgattatgtaaatgtaaacttaaattatcaaaaataaataaagtttaaaaattcagttcctcggtcacaccagccattttaaaaagtacactatgggcacatatggctgatgactaccatgcagaacaatatagattataaaacatttccaccatcccatattagacaggccagttctatagcataaatacctacaaataggcctccatattcaacctcttttcctgtatgttccattacaacacacacttctggttctcctgctactccttgagtgctcctaccaattcctgttatgggtttctacaaaatccaacccactaatgatggcattctataggactctttcctcaccctcctcctgcttgtctcatcttccacagccatgtttaaatcaccatgcatacactgatggcttacaaatccctatcaacatctcagcttctcatctgaattccagactacaaatcagtccatgaatatatttccaaccacttaatgaaaacttttcaagacagacgaaaaaacatattttcaaaaccaaacatgtttccccctacaagatttgttttttgaatgttgctattctttgtaaagggcagctcaactaacatgacttctttgttcttaaactatcagtgacttcattataatcattactatctaagaaccctgtaggatctggccctaatctacctatttcccattacgcaataaatatttaacaacacacccgagatatgccccctcagagtggtaggttctgaagacacagttaaacagaatatggtcagtgtacttttagtcagcacagtggctgatggagaagtaaaagcaaactaacaaccctaaatcaattaaaaataccagcaataaagagagagacagagagagactgaaagctggggaatgattcctggaggaatgatgtttgacctcaaagtctgaaaaacttactagcatttcagcgtgtggatgaatgacaagcaatactttgtaaggggcacaaaaagaggtatgagaacaaactgaaggggataaagccagagatgaacacagaaataaaactgctgaaaggaattttgcaataagccaaagagttaatcctcttttcctaaaaatcctggagcattattaggtatgtataataagtaaacaacataatcaaatttttactttcaaaaactcaaccagcagcagtgtgaaagatgggctgaaaaagacatactagaggcatggaaattggtttggaggctattgtagttatccaagcgagaactgaaggccttcctgaattgaggtggaggagagggtaatgacaaagaaatgaaaaaagactacagaatccaaaaatgttagtatctgaccgaatgaaggaaatgagcgagaggagtgtatctaagatgactacagggttttgttgttttacaagctagaaaaaaagtgttgttatttggggaaaataaataaggttataaaatgcagggggaaaagatatttttagggagaagaaagataaatttggtttggatatgctcagcttgagataggtataggaaattcaaaagaaatttagatatgcatccttcttggctatctcgcgttgttcttcatactgattcctcaaggctcagattagacatcacttccttggagaaggcttccctggccacccatgactaggtgagggacctttcctctaggtttacataccacatagggtttgtctaccataccaattgcacactgtaatataaaattgtcaaaataacactcaccaacctgaaagctcataaatgtgagaaacttttctattttattcatcacctttccagtgtcttacatctataattaaagtcaaataaatatttgttgaacgaagtgatgagccaacctcgtcaaatcttcctttatatgttgaatgactatgtcaacatagtcactctcccagcatcagaaatctttgagaggtcattttctctttttgacaactaagacaaagttcactgttacacagcaagaaaaaaaattacgttcttatgagagtaagaatgaaaaagcctttctacaatatcaatatgtgaattatgaaatatctatttcataaatcctagactaaaattcataaggaaaaagaattatttcgggacttaagataaaaattataaaaacaaccacagtcataatgagtacattctaagaacatttattaaattaacttgctaatactaaagtaactgtattacttatgaaaaaataagtttccacatcctcgcctataaaaagatagctgaaatataaactttgttttagcatttttgtaatatctatagtcaaatcactgtagccttggggaaaaaatgaatctccattaaaagcacaccttataaaaactgatatgatagccttctccaaaaagagttactagagcgatattacacttacaaaattacatgcaaaaaaatgttgaaagacacagttaaggttgaggctctgcttaatttcattctctagggtgaatgtattagtgcatctgtacaagaaggttgataattcaatattctctatatactttctgacatttctggtcttcatttttcaaatttatgcaccaaaataaagaatgtgtctagcaaccatgatagcttcctgcctaaagcaaagtatttacatgtgtccttataaaactatcagaacaaagtttttgctgatatatacaaaatgatatggcaatagaaatattttatggagcaaatagtattttctgaatctaactaacacatataatttctgactaaaaggagacaagtaaccttgaacaaggtctttcttctatttatatatttaaaacctacaatttgtttaaaaatctgttgagaaactttaactccattcatgtttgactccattcatatatactatatacctaaaaatgataacaaaatcaaatttatactatctgggatgtatccaaatcaagtacttgaaagtctactactactttcctatgaagagttaaagtgcttatccagcttagaatacaatgttggctgggggaagggtcaccccacaacatgaacatctatccactgtaacactatgagactaaatttaaatgatccattaatttgtttcccccactaaactaagtcacttcagagcaacaacaatattatattcacaactgtaatcctaacctgcagccgaaggcgtgggaaataacaacctctcatttagcgtttggtaaagtcagaaccttaaggccccttaggacatttataatgttttacctaagttactcttaacttacaaaacagtgcctataatttgtaagttatgttttatcttcaaagctatagaaatgtgcaactgcctcaagatacatttagtatctgctacatcaaaaacctatactccttggcatgatgcctaacacacaggaaatattcacttcgtaaatgtttgctgtgggttcatcatggtgacaacagtagtaagaattatcgtcactccttcaatgtgaaaaaccacctgaataattcaaatcagattgactatttaaaatgcaaagaattggaataacaaattaaaagtctaataggtacttgctaagccagagataaaaggacaaaacaataccttaaatttatgcctactgttccattattggaacgctgagcatgtggaagttatttatatcctactgcttaaggtcactgccaatgtctgatttttcaaaactcaaaaaaattgcaatctcaggcataaatgggttaaagaaaagtaaggaattggctggatggttagaaatactactgagttgaaacaaaactggttttgtttgtgtaatatccaacagctatgacctatgaaaatggcaattttataaagttcaacttaatataatgaagcaactttaatcaaaactaaaagcaagttaacttttctcttaaaatttttatatatgatttcattcttaagggcttaatatcatttcttgagaattaccacaaccttaaaattttgattacatacattttgctccatcatccactcattcaaaaaggatctttttagttcttacaaagggccaggaattgttcctggtgcagggatagtgaataaaacaaacaaaatgcctcaaagtttactgttagggtgaaatagataagtcattcacatataaatacataaactatgtagcatgtgagatgatgataaatacattcaaagaaaaataaggaaagaagaatagggaaggtcaaggttgggagtggggagttaagactttttagatacagtagtcctccttggtggagggcatctatgcacacacctgaagcagataaagaagaaagaacgaataacaagcaaattccctgaggcagaagcatgcctgcagtggttccccacagaatactataaagttagtgaaaactacttactttcttgtaaagttctgatgctttctcttcaaactcttctagttttgcttgatctatgcaaatgtctaaaattgcaatgacaggaaatttttaatgtgaaacttcttaaactcattatgacttcaaaagtttagaaagaaaaaagatcatagaaaataattaaatactgatactaccagtaataaacaaaatggaaaaaatattataatgttggaatgaaaaaggcttttctaagcatgataccagaaaacagaaaacacaggaaaagccaaactcaataacaattttaaacttctagcaggcaaaaggagatgttcaattgtaataacactcaaatgtttctatcaccaactcgtacatattttaaagaaaaaagatgatgtctataaacaagcttaaaaaaaacagccaacagtaataaacagaaaattagaaaaattgatactaaaaaatcaccaaaacagatgaataaatgtttattattccctaacaatatgaaaattagcaatatgaatgtgaagattaaatgactgataatgccaagtgttggagttgacatgaggaaaccaatagtgaaagctaagaactttgctgatgaaaaactaggcaatatatactaaaattgtaaatatggattttcttttaacctagcaattccatttctgagacttggccattaggcctgaaaactcattaaaatattttttgatgttagacaaaaaaaaaaaaaactgaaaataacttaaatgcccatcaataatgaactgcttaaataagttatgatatatatacatgatagaatacaatgtagaagtaattcatatggatttcccatatgttatcccttcttttttattaaatgaaagcgatacatgaacaaagtttataaaaatatattacagaagaatttataataaaaaataagtcaacaaagttactgtatccaaatcttaatcacacttcctaaatgcaacctcttattaccatttctatactagattattttggtggttagtttcttaactgtaaataaaatgtacataagtattatttcttgatttatctatttaagacattatagataactttctattataaaagattaagacagtatttgttctctaatcctaatttttgatattttatttactaaactggattgctccagagcatgaaatatttaattttgattcccattacattaagaataacttaaaattcttgccacagtatgtcaaattatctgtgcctcatgctttccaataccttttctcccctattgcccacctttggttcttctctcacctattcatagaaatacaatgacattctcttctgtatttaaatcttttgtatttacttatgagattattctaaatatttaaaaatcagtaaatacaattaatttattaaaactacataagcacgcatcacttatacaaccaaatggtgttcaaatattttatttccttctcaagagctcagtgaaaaaaacctctcagctgccattcctaaatgacccagtggaatacattttttcagatactattcaaaatcattccacattttagtttgctgcatatttacagcaccattttcttaatttctgcttcctcttcccactccccccaccccaggaacttctaattgcttatctcttatagagagaaacaagcattttcattaatattatctagttcttcactaattatatttcattcttctcccaggactcagataatatacgaaaagaaacataaccctgcacagatacatagctgaaaatgagaggtgtattttaatagccttttcaaatcattgtgggtaatcttctttgatgttatatcgaaatctgacaaatggtgacttcttaaacagtagttacaatgtggaatcacatatcatatcaattaacttgtactctgttaccctaaaatctcttgataaatgttgcacttttaatagatcttttgcctatgcagaatttgtaatatcaggcactggtcatatggaaagaatggtgtgctgagtcatgcaaatgttccgaacgttaacaggtctttatacaatatcacaatgaataatcagataggttaataacaccagtgacatcaggaaataattttagtattgagaacctgtcagcctaaaagcagcagatacaagttttccaaaattcaaatttccacttaaaaactcaaattttctcattggcagcctatttatcggccattttctttgaagttataggctcactttatttcatttttaagaaagcaagtgcctgacgaaaactttaataaaaactcaaatgttacaacactaaataataatgctttatctttaaaaaaaaaaaaaaaaaaaactctcaagttatagaagccatcgtctgtatgagtcattccaagtttaaaaaaaaaaaaaaaaaggcttcgggggggacaggcaattctgcttgcaactcaattacacaaatattttcttattgaactcttttaatagatctttgcctatggagaatttgtaacatcaggcactggtcatatgcagcagaagtactgtatgtataaatcccatttgttaacacagaatattaaaacagtgtgtatacaagggtcaggctttaataaagttaacatttttaggaccttatcaaaggcattcttaagtaaaaaatggcagtttttgttgttttattgacagtaaagatgataatgactactcccacagtttagtgccactgccttgattcataacaaagtgccaggagttttactcaccattgttctgcaccaccagtgcaaaataccaacccaataaaaaaggcgaataatgtttttgtgctattatgaaaacagttttgacaattagggccctcaggagtccagagacacaacccgagaaccaatgccctagagctcattcatagaataagagacaataagatatttctatttaaataataaatactcacctacaaactgggttaaatctaaatctagtctttttcgatatgtgaagtctggatccattccatctctatgcaatacaatctgggatacacactcatcaattaatttgaagtattgttgcctaaaaccaaagaaaagagtaaatgtacaattgataattagtgtaactttacatcaaaacaaaactttttggctaagattgatttcaagttcaacaatttattagtaatataatttcaatagttgacacaacagattttacctgggagtgagagtaaatacaattgtcatcactttgcttttaatgaattcaaaacatcatttttatagtcttttaggaaatacagtatcccttaattttcttataaaagtcaaaaccttgaattaagtaaattagctgaaagtgaagtgataagtgcttaaaatttgtgctcagaggtcatcaactttccactgtaccacactgaaatagctatcattaattcacttcattaatacaaccaaaataaacaaaaattttctctaaaaagttttatgggagtatgtggtatactgttttccaagtgtttgtgaaatcaaatttaaaactggtactgtaagttatatataatatcaaattcatatttcttactcaaagggaaatagaaaaattcagtataataatatttgtccaaaaatcgaagtttaactaaaacctccaagtagatttcatgttgtcattacagttaagtctagtccatctacactggtcataggtgaaacatcccttaagattttgaaaggatcaacaaaattgatagatcgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttcaatctctgaatagaccaataacaggagctgaaattggggcaataatcaatagtttaccaaccaaaaagagtccaggaccagatggattcacagccgaattctaccagaggtacaaggaggaactggtaccattccttctgaaactattccaatcaatagaaaaagagggaaccctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggctcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtattggaagttctggccagggcaatcaggcaggagaaggaaataaagggtattcaattaggaaaagaggaagtcaaattgtccctgtgtgcagacgacatgattgtttatctagaaaaccccatcgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaaaagaataaaatacctaggaatccaacttacaagggatgtgaaggacctcttcaaggagaactacaaaccactgctcaaggaaataaaagaggatacaaacaactggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaatggctaatatccagaatctacaatgaactcaaacaaatttacaagaaaaaaacaaacaaccccatcaaaaagtgggtgaaggacatgaacagacacttctcaaaagaagatatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgttggagaggatgtggagaaataggaacacttttacactgttggtgggactataaactagttcaaccattgtggaagtcagtgtggcgattcctcagggatctagaactagaaataccatttgacccagccatcccattactgggtatatacccaaatgactataaatcatgctgctataaagacacatgcacgtgtatgtttattgcggcattattcacgatagcaaagacttggaaccaacccaaatgtccaacaatgatagactggattaagaaaatgtggcacatatacaccatggaatactatgcagccataaaaaatgatgagttcaagtcctttgtagggacatggatgaaattggaaatcatcattctcagtaaactatcgcaagaacgaaaaaccaaacaccgcatattctcactcataggtgggaactgaacaatgagatcacatggacacatgaaggggaatatcacactctggggactgtggtggggtggggggagtggggagggatagcatttggagatatacctaaggctagatgacgagttagtgggtgcagcgcaccagcatggcacatgtatacatatgtaactaacctgcacaatgtgcacatgtaccctaaaacttaaagtataataaaaaaaaaaaaaagaaaaaaaaaaaagaccaaaccaaaaaaaaaaaaagttatttgagattagttgagcatgagtaggtatttattgctttctttttggccagaaacttgttagtgaaataaggctaatggtagaaatatttcctcttgtaaagcataatcatctcttcttgagaagactggttttaaaatatcctagtgcttttagatattgtacctttttggttatgccaaatattagttcactttggaaagccggtaatatgaaaaatgatgtcactcatcattagtacagaggattaaagagaaaactggaacaagaaagatgtctcagaaagggacaaaaaaaaaaagatttaataaatgtaaataaaacagataaaagattttataagcaaaaccaaactaaagtgataaacaggttgggtactattctaatgaagcacagtcctccatctcagatcatcccctagaacttctttccttaatgacttttaacatacttttcctctctaaattctaaagtgtgggtccctcaagccatttagactttcctttccataaactatgacccactgctcttgacctacttaccttacacctaataaaccatctattacagtgaagaaaatccactacagcttaacactagcaaagatgactaatgatcattaactgtcatagagtgaaaatgtttaagaaacggttcctgggtacaaatcaaaagtgttaatctatgcttgcctctatttgttcaagttctttcaagacattatctcccatccccaaatatttctgccataataaccacatttacacgtggtacatacatttaaacacatttacatctattacatttaaaaatctagatgatgtatttcttttctactcaacattattctaatgtttttaaaatgaaaatgttttaaattaacaacacaagctatttcatgtcatctttttaagaaatcataattttagtaagtttttcctcaactccacaatgtccaattatgagttcatctataatgtggctgaaatttcatgcaaaaactcactggggaggcaatactatcaaagaataatacacaacatttctggattccagaaatgtcaatctagaaaataatctccatgagcaatattggtgaggtagtaaatgtgtctgaggaatatgtgaataacttaattaagggatgaacattaagttgtcattactgacaaaatgctatttttgttggaggagtttttgaaatcttcacttttctctgtggtattgttaacaaatatcagaaattatctcccatgcgcatttaactagcgtggtattttacacatggtaagccttaattatttggtgtaaaactgaatttgatcttctccacccaattatcttgctgtatttcagccccctccctttttcccagggaaaaggggctgcctttgacatatattctccaatcgaattccatttctgtcaaactttcttttgtcccaaaagtggaaatgaaaaaagattctaatttttccatccaccaattctttcaaatgagaacatttaacattctgcaatagaacaatctactgtttgtaaaaagaaaaagaaaaattatgtgtgttcgtatcaaaagtagtttaaagagctcattaaacaaaaaatgttacaggttatctaagattgctgaaaaggtaaaatagaggtccttctgaggtagatgaaaccaaaaaatgaaggtaaaaaccaaaaaaacaacactcatagacgtgtacaccaacaagagtaagttttactgtatgtaaataaataaaattttaaaaaataaatgcatgacaaaaatatatgtaaattatcacaattctgacacaatcttggaataaaagcatattttaagaaatatttttaagaatttttttaagaaatttttttaaagaaatattaacaacaacaataataaataggagagtttggaaacatgaggaaaaaactgatggagttgtcttgagtctagcagtcacaggaagaacactgcctttgtggcaaccatatctggaatcaagatacccggggtttaaagagccaaagaaggaattaacataggtgaacatcaaatgtaaaagttcatactcaaaagatggccaaatatctaaatttctatgccttaatgtcattttggtaatgccacaatttaatctttctccaagactcttgatttaactcaaatgatagtatcacctgaacataacccaaaacagttgtgttttttaatctgttttgaagctagatacaaccacatgctctcttggggcacagatgaagggatcaaagtcataagtatgataaaacccctgcaggactacaggcatgttcaaaccattgaaaacaaacaacagtcttaaattcttgggtactcaaacagcatcaaacttccagaagacgacaggactgaccacacacagatcaaaaaatgtatggagtttactttagagtaaatagaagtttcaatgtcatttttaagtaaatttggagtagaaatatagtatcataaacagcatggtacaaatgatattttaaaaatctaaattagcaattcttaatctagcatttataatataaatatttaaactggtttatttttaataaaatatcagaaaggagcaaattaaaaaaatcagttactaaactcatattttagaatatcagtgggatttctggctacaaagagagtaattttgatgcatgtcctatcctcatcctgaaaaacctaaagttttaacattttgggtctcctccttgcttgttaggtacatcaaaaaatcactgagtcataccctctgatgttaccccgaggacacagcctgaatgaagcttgtctaaaaaactcttctacttgaaattaagtagaaaagaaaaaaacacccaaagtataagagaatgaaatttcagcaaacctaaattggtggcaacaaaatgattttatattcaaagagctcagcttccaccataaaacagtaatagaaatggaaagtagatatagagaacatttactaagcatacaccatatgccaagggtttggctagaacttttacccacattcccatatttcatctgcctaacaacccagtgagttaggcactaatctccatatttagtcacattataatgtagatgaggttaaaagaaagataaataatttgttaacctcagatggctaggatataatcaatctttaaaagccatttgtctggctttttgatatattagcaacattaaacgcaactgtattattaagacttgccagctacttaaacactaataaaagcaatgtttagtgcccttcatgtaacttataagaagaaacttatcaacatcattcctactgcctaagaaataactagaaaatattatctgtcacatgataaactagtaatttgttgctagtttgcatttttattcagatgaaaggttgtaaccaggaatccacaggagcttaaaaagtaatagtaatatcattttaccatcgtctacctaaatatatgcccagagaaaacaacacattctatgaatcagtgttatgacaaaaataaaaatcatttgcttgtcaaaggcaaatatgatgtgaatttcacaattaatagatttttattagtgaaagaaaacattagaatacaacttcctcttaccttataaaataatcatttcgaatcagcaaaagatgctgaagaatagaaataaaatatccctctgctctagtttctttaactgtgctccacaccatgttgtaaacatcatatgcttcagtgagttgattaaggaatatatggatttatttatactctacaccaaacaactataataatatgacagaatttgtcctgtaaggttttggaactgtaatacaggcatcttatatattcaacataaaatacagatatttaggattgagggtagtggaaaaactctggaaatggtgacttaacctgacacttcctgacttcccttctacaatcagttccaactaatctgtctcccctaagcacagatgctgttgggaacaaaggtagtagggaagctggctatgaatactgtgttgaattctaaaggttgcctgaccaacagagctggtggtcaggttaattatctaccatgaagaagccccaggtgaggataggaacctgttgggtctcatgaggagcacagacgtctgcagacccacagattaacatgcgacccatgagtatgcacccaagatgcagggaaagagcagccagtgactaaggctgccctattcctaatgctaaaaagccctaagtagaaggaaaagtgtcaaatataaaaagaaaacaaaatagattgcacacatacatataagaaaccaatctacagaatccatttgttagttgcagcatacgcttacatatatgtgtattcataaaaacacacaaattaataaaataataacattcttctgatgcatgaaggtttgatttcatgttgtttatatagaaatgagctaaatatttgtggctgagtattttggatttagcaataattttatatatgatttgactagacttcagaacaaaaggatattcaagttcagctctaatatcttcaaggcgatgggataactcaaacaaatcttcttctttatgctcatcaaagactttaagttggatatccaggccatcattcttaatgcattttaaattctagagatatgaaatagaaattatgatgaatgattttgtttttaattatgcaaaagaataaaaaacatataaacaataaaccaaccattcaacttgatttatagcattcgaacatttaaagtgttaaataacactcgaatcttatcatctatatttcaaaaatagattttttaactcaagccttttcccacagataaattattcttcaaggtaatttatctaaatttccccctactcaagtactcttttaatttaaatattaataaggagactgcagggcacttactggcaatatctctttcaatccacaacgcataaattcatttctgatgtgaagcctgaaatccaaatcatcaggagatgtaaccagggcattgatgagctgcatacaagctacctacaagagatcaaacagtgagacagactgggtttccaacattaaagaaagagtaacaaacgtaaacttcaaggttttgttccagcattattaaatatctttcctattaaaacaatttgtaagcaaaatatttcagtcagttataaactacagaagaaataaagtttcagtggcgttttttatttctcatttatttgagggttactgaggtgaaaggaagatggaaaaatattagccgttactactgctccataaaaaaatagaaaaaaaaaaaaaaaaacacttgtaaccaaaagctaagttcttgtccaataatatcactctacacacatacaacagaaattgaacatatccaatatacctattggatagataacacttacctaaaataggataataaaatagttttccattcatcaagagagactcaaagtcccaaagacttcaaggtcaacaagggtcttaactctagttaacaaggttataaataaacactgtataattaatttctagaagttaatttatcaggcaatggttctcatactttggcaaaaattcaaaattaccctatgttttaaccagaaataaataacagagctcactaaatcctttaatatatagcttaaatgataaaaatttttaaatcacaaaattttcagctcatgtttaacacttcaactttcaacttctccacttttttcatccctggctaaaatatatctttcatcctccaaaatccataaaatggaaacaaaagacagtctttctagagaagcattctttgttgttgttgataatactatttttctaaagtctacattctatccaagtctagcaagaactactggactactgatcaatatgtttaacctcatgctgttccctaaattgtcttttctccatcccttaaggcaaggtttatatgaatttaaaatgctgttttggagtaagacaccaacagaattctcaattcctgctgtttgaaatatatagtaattgttatatttgatatctaagcattaaaatctgaccagcatgcctctactgtcgaaacttaaggttgtttaaagtgggaatgggaaatatgtcagaagagagaggaagaagagaaacatacttaaaaaaaaaaaaaaaaaaaacttaacagaatctacctttccagtacatgttcattcagctgtaaccagttcatgtcaaaaagtcaagtttaaaatgttttccttccacccccttgccagtcattacccaggacccacaaatgttttcttcagcaatgccatataatttttaaagatctcaaagagcaaataatgcttctctacattcagagaaactaaatcaaactcagtcacctggcttctagaaaaacacaaattacagataactcacagaaagtagcaaaaacaaggaacacaaaaactagcagcaaatattacctaaatggaaaatacatatatgtagacaacagtagcatgaaatttagaaataagggaaaggataatccaaattatttccgggaactattcaaaaaggtgattctccatagaagaaaaaaaataggaaattaaattgaaataatgaattcaagttaaatttataaaattgcttcccaattctaatcataatttgccattagcatggcttacaatctatttaatttaaatcatgcaaacatgtctgtgaatacacataggtatgcactaaaatgcattgtttctttatggataaataattctataatcaaggtaaagaccaaggagttccttgtaggttttatacataatgagatacatacctgcggtatcacacaatttcacaataatttagcataccagcagaagggagtgtcaatcagcatttatgccatatcaatcaacgcctagagatatcgagaaacgttaaaaaactacaaaggttaacaggacattttgcctgtccaatgaagatatatcagtaaaatgataaaaatatactatatactgtaagaaatatgtttggtaaataatgggaatatggagatgctaaatgagaactaagacagctgaataaagtactaactaaaggattaataaaatggcctgatgaagaagtgaagaaggaagatctaagccgaggaattaacatgttcaaagacatggaacctttaaattacaagcaattcaaattttatgagcggtttgtcaaggtagaaaggggagtaacgggaagaagtcaagaaatgaggttgaacaaggagacaggagagagggcatagccttgtgtgtcaagtcacaaaattcagattcaaccagaaatagtgaaaatcataaggaattttatgcaacaggggcacaataacagaggcaatagattcaagttcagaagctgttgtagaagtaaatttttgagcaaggaggaaggttcaaacatttgaaatatgaagaaaaattgatagaatgaggtagaagaaaagcatttacaagaggcctcccacttttgttatttaactagatagaaagtggtaccattagcagacatacaaaatgtaagaagagcaacaggttttagagaataggataaatcctactttcaaaattctgattgagatgtatattagaatcattcattcattaaaaaaacaattactgactacctacaacttctgtcaactggagatactcatactcaaaaaatgagaaccaaaagtgagatgttcgtcataaggaagtaatctctgtgctctagttgatgttccaaaaatgtagcatatgatctctcttaatttgcatgttacagaaatcgttatgatacattacaaaaccaacctccctctgcgctaataagggtaagaaaacaaggaacttccatcttcttgagagcatctagttaactaaaggttccatcttagggcatcagaagcagtttaccccgatattggctcacatacttcattccttcaaagcctatttattgatgcctactatataccaggcactgttcttggtgctagacatacagctgtgaaaaaagatggaaatttctttgagagaaagaggagtcaagactgactccaaggttttgggcctgagcaacttaaaggatgaaattgtaatttattgaaacagaaatgaccacgggagaaaacaggcttgggaagagagaggaaatcagttttggagatgataagttggaaatgcctattagtgatctaaatcttaaaagctgcgaaggaaattgaagatagaagactccagttcaaaataaagcaattgccatagcaataatacgtaaaaaccaagacctcagatggaatcacgacagtatagaggaaaaaggaggtgtcagaactgtttagggcattttcaaccgtaggtttcaacatggagattagagaaataagttaaagaaaaagaaaagttaaaaaccataagtgaggtagaaggaaaacaaggagattgtggtgtcctggaagtatggaaagtggtctcaacagtgagagagtgatcaactgtgtcaactggtcaaataaaacaaggactaatcaattaccactgcatttggcaaaatgaaaacactggtgacttgacaagaatagtttctacaaagggatagagttactgttccaagcagaaactacttgcctccccacagatgccatatgcagccagtaaacaaacaattgctgtaaaatattctcctctttgccctaaatgcatctttatatgttagaagtaactgctcctttatctttgtttttaaaaagtctatgtaaagacacttatctctaggtgttatggattacaaattcaattctaatggtttggaaagccaatactgtaagctcactttattactcttgtgtcaattatcaaaaagggtcttctgtgagaaaaggtattttaaacgtaacttctagctggaggggtgtgtgtccatctatgattcaggatagttgaggatttccttagggcagcagtaaactaaaagtatagtacaaggactgacatcagcaaactccagacagcctaagactggaaagcgagcggccaaaaaggtaatgacaaagagtgggacaaaagtcagcaataccataaagtaggaaggtaaagacataacaggggccaataaagtagataagctgtaaatagaaatctcaaagatattcaatatgtggggcagagcgagtcaaaggccatcttaagaacagggcaaacgatcaaaggaaaatcattagaagccgaaagaggttaacaacaagatagaggaacatgccactacatctacatcactgaatcagcaaagtggctttctgcccttgaaaataaagtgagaagttttcttcatatgtgaatatatagtacctaaatttcctttggtacataatttactgcaattactatgttcaacacaaatatgagaaaagacaaatgtgtttatttgtacaaatttattgtacatgagaaatcttgttacatgcatataaggtgcagtgatcaagtcaaggtatttagggtgtctattccccaagtacaacatatttatttggtcagatacagtcactctattctgctatcaaacattaaacttatcccttctaccatatgtttgcaccctttacacacttctcttcatccttcctcctctgcccccactcactcttcccagactgttatctttccactttctacatccatgtgatcacaatttttagctccaacatataagtgagaacatgtgatatttgtctctctgtgcttagctgatttttcttaatagcctccagttccatctatgttgctgcaaatgacaggagttcgttcctttttatggctgaatagtattccacagtgaatatgtaccacattttctttatccattcatccactgataaacacttaggtttattccatatctttgctattgtgaatagtgctgtaataaacacatgagtgccagcatccctttgaaatatttatttattttcttttgggtggatactcggtaatgagactgtttttttctaacctttggttccctgacccttttttggacaacaaacttaagcacaaaattcaaggttcactaacaggtactatccctgagccccatccacgaggaccatccagtttttccaaaggccgacagagcagaagctttcaacctgattgcgctgatgagatttagaaagttgtctaatagcaaaagtaagtagttcttagaaagtttactcttgagtcaacatgttcatcctgggtataagtagatgtttttacaattaaatcgtggctctacaatgcaacaacatatcagcttcaggagctaaatccagattgaaaacaagaaccagtaaaatacttaaataaaaattctatcagaggctgcaaaagcttattatctgggcctggaagatacagtttagactgctattcatctttcctaccccatagcagaaatcatctgtctctctttgcacaattaaatttcacatttatcaagttaaaatgagtaaatgatgcttatggagaaatattttgcctctagtgtaaatagagaaattccaaagattttaaaattttatacacatgcattgaagtaactgcatataccccacattgactcagagaaataaaatgcaggactcaagaagctataatttataccagggatactaaagaacaaacttgaattcttaaaatatttatttgaaaactcccccaagacatcattaatttcttctatgtcctcccatgcctttttctaaaactgcctttattgcaattttcgtatgaaatgttagatggctttaaattcttgagtataagcttcttaagggcagaggtgtatttcactcaactttgtagttccaatacccagcatagcccagtacctagcagtcactgaataactaagtaattgatcggttaattatgaaactttttagttaccttcaagacattaattatctttctagttgtccactgtagaataaatgaagaaatgtattatatagacttattaggtagattcagaaaactgccagtaaactctagataatgataaccattagtttatacttgggtatgctccatatgataatatgagttcacattagaatattatctgttcctttaatgtctactagcatactggcttattatttactgatccattttaatatggttgatgttttaattgattggtacttatatatcaaccctattcatgcaaacctcaataaaagtagtagtcagaagagaaaggaattaaaacaaattaacatttgcatccttccgggatagctcaacaatgatcctaaaaataagccttttactaatagtctgtattcttcatttagtccttcactaaatgtgagaaaagtttatttaaaatagaaaattaattaataattatttgatggaacagaagagacacttaaaacaaaaaatagtaaatcaagatataactgtttattataagacctttacttggtcttgggcataataaaacctgggtaaactttgaagattaaagtggtaggtggaacaaaatcaaccaaagcaaatatacttggctaaatccagaaaggcatttaacctctaatttgttttaatgtgagtattcaatggcatatttgtctgattattgcccattgacaaatttcaaaatatagtgattatccctcacttaagaaaggtttttggtactatttttgatactttaatgaaactatttatataatgataaaaagttatcctttttaatttataaaaatattgctttttctactttttcagacatggaaaaatgcaatcccatcaaactttcaaagatctatcttctaattaaacttaatgaaatccacagattgaagagtttttttttaagttaaggaaaaatttaactatctttgcagcagccataacaatgcaactctcagtctttgactgcaggaaacataaatggcctacagccccagctgctaccttctgaaagctatcacagcatttgaattgaagtcacagttccctgctcccagccaaggcttgagcacagcaagtatactaaaatagacctgttcctgggacacatgggactttggctcaaggattccccaacaggcttgtcaagctctcttagaatttcagggcagcctgagacactttcaccccatctccactccttcccactctccttcacctagagtcagatctgcattgagtttgacagttctcccagcctcccccagctcctcctccagggtctctcacaggcatttcctctagtcccttacacatcaaacctcttgcttctcatagaaccaagactaacagcctcatttcacaatgcaagtttcaacaagggttatcattttcaaattgtcagactcataagtattataactgaagcttaatcaaatttcttattttttaggtatttaacagaacacttttgctttttcttcttgttctttatatatgaccagcttctgtattttcatatgttactatgagatacgggttaagaccatgtgtatgccagacactgaaatacatttggaacacagattttctctagtaatatttccagagacaccaatagcctggattatattccttgcttttgcttccttgaaaaatatattctagggtagagaaatatctaccacaggaatcctagaaagacataccaaccatcaatcacccctgtccagtactgcatcactgttatcaccatagcttaagaagcctgaagatataagggttgcacaacaatgtgaatgtgtttaatgtcactgaactatactctcaaagatggttaaaatggtaaatttcatgttatatatatcctaccacaataggaaaaaaaaaaacctaaagcaaacaatggctatgtatttcaacagtgggtaaagaaatgacaagatctgggtcatctttactagataatcataacaagtagagatccacagaaggacaacataaacccagctattggtattatatctaaagagtatactaaaatcagatatttagaaccctgaatgaaattaagtaaaaggatttaagtatatattttaagtgagcaagctcagaactaaagatgctacagattcacatcaaaccatcaaagacaaccaaacaattttttctctctgaaacaagcttcccatcttttcctttatttgctctctgacataattatttctcctctctggactcagaaactttggaaatcatgttttccctttattcagtaactaacatagggaaaatattcttgaggtatttccaagaatcaaaattaatgagggtttcattccattcaatctacatccaagataaaaccaatgtataggaacaacattagaagaaccgggctaaaggaaaagtagccaaggtgacactaggagatttgtggtcttctgtctgttgcaagacaattctccctgggtctctcatatttcatttccacttgtattgcaagtaaagacattgatggtctttgatctagatgctcttcaaggatgtgtgtatacaaaacaatcttggaaaacagcatatctctccagagcaaagagcaggctcacttcatgtctagtataataaagataatgtcttttagagcaaagtgcaggcaagttcaaagttcctctcctacagcacatcctgccatttaccaccagaaagttctgaccatgatttgattaccattacctacactttactaagaggtcaatcagaatagatccagctcctgcatctcccatgcaaaacatcttcccttctctctggatgtcaaccccattccaactcccataactgtagctcagtcattctgtggagtgggtgaatggcactgacaaaaaggaataagttggactgactgtcttcagacagtccctccaaaaattgttagacttaattatttcctgaaccaagaactgtaaaatttatcagccacctggaagccaagttgaaagctctgccaccctgtagtcccttaactaataaagttcctatttgggtagtcccaacaactacaaacaacactttccttccaggagcaccatgtacacctttcaagactatttatcttatgtgaaagacaggcattaacttgcctctctcttcaaaaacaccatgacttgaaccctacaggtatgatcataagaaatgttcaagtgtttaaagaaatgccaccagtatgtcatgcaactcttaggcaactatggagttctctccaaatggaagctatgcttagttactctggggagcttcctggagaaaaaaactgacttactatgtgtactctgcaggcagttatccctacaatgggaagtggtaaaaaatctgtgcctgatttcagctaaagtgatcagtgacaccacatcagccctgggaggcaatcaggtcagcttcaactcactgaccaggattgttatgaagaaagaattgtcctagacttctttgctgaacaaggggaagtttgcgcaatcactaacacatcatactgtatctgaattaacacctcgggccaagtggaaagatgaatcaaaaaatttaaaaagaaagccacctggtgttctaaggtagactctgatgatttactggattatgggatttgttcagctgactagatctgggacctggaaggcaggactgaggcaaatacttcagacaggactcattctgctgcccacagtctctcctgaacttaattaagtatgctatgaaacaaactgaacagatttcatcatagcctgtatcaatcagatcaattacagtcattgctgcccataatataaaagtaatattccctatgctcaaggtttctctcctaaaacacaacccactgcaactggcagtattcacattacactatgagtgtcacaatatgggctttgggactgacacaaagctgatactcagcctactgctattgctgtgagcaataaaatcctttgtttttaacctaggagttcacgtcttttgacagcaccaatagaactatgacagactaacatgtcagtttacaagtggcagatcgtctaagaccattcatgttcctgaccctcccatcagcaacttcatgggtactggatcagggagaaaccacaggaaaaggaagttacagcattctatcactgcagacctgaggacatatacacagaagaagaaccaaatatccacccaaaatgctctaggattcccatgttttggttcccttccaaaaatatatcacaattcaatcagtcgtatgaccaacagcaagggtttcaacaaactctttgaaatctagaaaatgctcttgatactccaggaaagtatgaccctgacaagagtagacagaagacacagaaaggaaaagaaaaagaggagagaaataaaaataacagaagattaaaggacggcagaaactagagattggttaaccaatacttatcccagtccttttctactaaggaaaaactggccaacatgagggacaagcacacacatgaacaatggacactacgatggagggtttggttctcctggggcaactgtggcagaaggctgtctgtccctggtgtcacaagtgctgaccacagcagagagttgggagtggcacttccattagagcattgctgtgatacagtgcagcgtatcttctgtattacttctagctacagaccacccacatgattccctgggcctaccagaaattttgtaaggtaggtacaaaatttgtgaagtaattaattgatataggctatgatgaaatctgttcaatttgtttcatagcatatttaattttgtaataacattttctgcttaaattacccagagtgattatgttgcttgcagctgagaaaccctgtctgatgtttgaaaaaaaagtaatgtatgcttattttaagtcctagatttatatttgtactttctttcctgataatatatatgtatgtgtgtatacatatatatatagatatatctatctatctatatatagatagatagatagatatagatatatatatattttttatgagatggagtcttgctctgtcagccaggctggagtgcagtggcgcgatctcggctcactgcaagcaccgcctcctgggttcacgccattctcctgcctcagcctcccgagtagctgggactataggcacccaccaacacgcaaggcaattttttttttctttgtatttttagtagagacggggtttcaccaggttagccaggatggtctcaatctcctgaccttgtgattcgtctgtctcggcctcccaaagtgctgggattacagacgtgggccaccacgcacggcccctgataatattcttcaaggcctgagaataaagttattccaagtacaaagtttaacattttcttactatataatatcaaatgggggaagtgtgcacaattctatcataatcataaacaaattatcattattaggatcagaataacaaaaaagtaacaattctccttattctcctttaaaaaaaatactttgtcataaatatactttgcagtaaaagaataatgaagaatgtgtttattttgctatctcattttctccaatttaaaagtaaacaattggttcctattttattcaccaataaacaagttttatttttaattggcgatttgctaatgtcatctagtttagcacattttaataatgcaatttattaaaatggaataaaatgggtacaaatagttttataggaaaattgatagccagccacctcaaaatttactttatttgtggaaaattcagaaagacagagaaataggtatttttagatattactacaatttttagaaagagcataacctgcaatatgcagaaaagagtatctatgttacctttttttgtttgtttggcctaagttagcactatagaaaatggtatcttttactctgaagcctgctacctgctagctatttcacacattaggcttaaaaacaatgagaaacctttattaaggagtaaaagccttcaacaaaatatttgaatagaaaaaataagaatgtaaaacaattctttccattttctattcccaattaagagcatggaaatttaacctgaacatatcagaaaaatgagaaagaaataaatttgaatgatgctaaaataatctttcacttcttaaaaattaagctctaagaactatatcaagaaatttattttagtgtttacaggatatcaaataattaacactactactaactgtaacagaaaatataattacaactaaagcaattagtttcataaaagcaaatataatcagctacttatatattggcaaaaatttttcaaaaattgaatcatcacctactatgtcccacaaaaattaaaaattaaaaagaaactgtatcattcccgtgacttccataactacggaaggaaaacattgctctaagctctcctcctccctacctctattcactcaacactaaatatggcaaataagcagtagtttaaaaagaaatcaactccacaaatgttcacagcagcatttttcataacagccaaagagtagaaacaacctgaatgtctgtcgactgacagctgataaaatgtggtacactcatgacagacgattatgtggcgattttttaaaatgcagtactccaacatgaacgaacctctaaaatattttgctattaataagtaaaaaaagccaatcacaaagatccacataatgcatgattacatttacgtgaaatgtctggaatatgcaactctataaagacagaaagtagatcaatagttgtctcaggctagagagaatcaaagattgtggagttatagctaagggatggggactttcttttgggtggcaatgaaaatcttctaaaattgactgtggtaaagattccacaaagctgttaatatacaaaaaatattgaatcacactttttttcttttttttgagacagagagtcttgctctgttgcccaggctggagtgcagtggcatgttctcaactcactgaaagctccgcctcctgggttcacaccattctcctgcctcagcttcccgagtagctgggactacaggcacccaccaccatgcccggctaatttttttgtatttttagtagagacggggtttcaccatgttagccaggatggtctcgatctcctgacctcatgatctgcccgccttggcctcccaaagtgctaggattacaggcatgagccaccacaacctgacctgaaacgcacattttaaatgggtaaattttatgatacgttaatttagtctgactagagctgttaataaaagaaattaaacctgtatcaaaactttatataaacagaattcttaatatttatttaagtcttaatatcttctatagaatagtaacctataaaatcccaaacttttaactgatagttctctttctagatatttactgactaaatataagtttatcatgactatagaaatgttatttttccacagaagagcaccttcaataaaagcagaactacctataaaagaaattacttaatttaccccctaaattttttaaatcaacgtagtttgccttcaagttcatactcatcaatttaatttgtagttaattaaaataaaggtcagatatatttacctttatgtctaacagccaaaacaaatattccaaataaccaagaattagactgcaatagtcgaaactttccaataaatgaggagatcatgtcatttaccaggacaaaacagggctttgtctttaacaagccattatttatctcttcccttacagtttaaaacctcatgtaatgtaatactgttgtaaacaaaaggatgggaccccagttttaccaatattttcataaaacttttactctcaaataattatagattcatagatagttgcaaaaaaaaatcagataaagtaatggttcaactttcctctacaaagttttctttagggctactcttcattaatcttcagatgaataaaaagcctgggaccagatgacaaagaaacttgttcaaagcaccagatgacagcagatcaacctgacaaggaaagacataaaaaatagaaaggaaaaagaaaagcaataggaaggaaaaggagagcagggaagggggagctcagagatgaggtgggagagaagagacaagaaagcaagagaaaagaaaagaggaggagactggaaatgaggctagcagtacatgaattaaaagactctagtctctcaagcaactaaatgggcaaggtcgatgtcacagatggggaacacatcccagacctcgaagccaatgtcatctaacaagcccagaatgcatgaaaaggggctctcttacagaggttcctgcaggacccatgccatagagaccctctggtcagatcttcaatcctgcctattcgaagagaaccaaatcacaacatagggttcctcactggctattcactaacactgtcatctgaaatgtcatactaaattattagtttcacagctcctatcatattctcattttttttttttcttgagtcagagtctcgctcagtcacccaggctggagtgcagtggcacgatcttggctcactgcaaccactgtctccggggttcaagtgattctcctgttttagcctcctgagtagctgggattacaggcacctgccatcatgcccggctaatttttgtattttagtagagatggggtttcaccatgttggccaggctggtcttgaactcctgacatcaggtgatctgcctgcctcagcctcccaaagtgctaggattacaggcatgagccaccgcgcccagcctattatttttaaaataccatttgtttacttttaatttttcactttatttttttatttcagatttagcttttctattcctaatataccaagaaacaataaaatggccaagcacccagaacctttaaaaaaaaactataactttttacttttattaagtgtgaaagagatttacttcatatctattaacacattggctttgaaactttgctgcacgttaggatcacctgaggatcattttaaatttcccaatgtccaggtcacaccatgccaattaagttttagaagtacggaggtgagaatcaggtattagtattttttaagatgaccacttttgaacaattataccaataaaagcctcttttcctttttttaaaaaaagaaagagaaattaaatgaatattattcagcttgaatacttaaatgtttaagtctaaatgtgtctttttagcagtatttttggaaacatctataaccttgggtttccttattattcacgtaagctcaacttttcagttattaaaacaatgaaaagccctaatcgacctaattggcaaaacatctcaaaagttaaagtaatttaagagactaacatagaataaacagttcatagaactatgataatatctcatacagggaaatctaataattctactacacgaaaagcaacctaggaaataaccattgttgtgtgccaagatgtatctataagataaattatgacacagtacaaataggaattctatattctaaaaataatgctaggccggacgcagtggctcatgcctgtaatcccagcactttgggaggccgacgcgggtagatcacgagatcaggagatcgagaccatcctggctaacacaatgaaaccccgtctctactaaaaatacaaaaaaaaattagctgggcatggtggcaggcgcctgtagtcccagctactcgggaggctgaggcagaagaatggtgtgaacccaggaggcagagctttcagtgagctgagaacgcgccactgcactccagcctgggcgacaaagcaagactccgtctcaaataaataaataaataaataatgctataaaagaatattaaaaggcatgcagagcttcataacaatgttttcatataaaccaatcataaaaccgttaaaagtaatatatgccatttaaaaacagattttatatacacacaaaacttacttgcagttgaactgaattgtgccggaggccttccacaatacaaaaaaatctgtcaatttttttttcttcaccagctgaagttaaagcttctaaaacttcttcaaggctattggaaaatttgagtcaattaaattgcaagtagcaaacacaaatgccataatacaattgctttatcctactaaagaagtcaataccctaagcagccaatatattttagaagtagattactgagtacataccatgtatcaagcacagttctaagcatgttacattttaatcatttatccctgacaataaccctgtgaagatgtttatcaagcatttatataatgcttactacacatcaggcaccatttaagccactttacaaacatcaactcattttaaagtatataacaattgtttgaggtaggtactataattaacccgtattatagattaggagactaaggcagaaaaaggttaagcaatctgtccaaggtctcatatctgtgaaatggtggagcaagaatctgaaaccagacagtttatgtggtgggcaccatataaatgctctcaaccactgcactcttatgcctcacaagtttaagtaaatgaagctgagtgatagtcgaaaatatataatagtatggtattataaatattcaaatataaaatataataattatgcaaaaactatacttcctcttcttttaagtaatagttaacagcatccagcacactggagaagctcacagttcgtggacatgggcatgcagtcctaaatgttacttacaggatcttgatacccattctgaagtcaagaaacaaggaaaagggaaggataacagaatagggaagggaaaagaaaagcaaggaagagtccaagaggaaagaggaggaagaaaagggaaaaagaggaggttaaaagacagaattaaaaaatgatgggggaaaggggaaaggaagaaagtgggaagggaagctcagaaagtatcatatgtccacataaatttcactcttagatttgtacaccaacatttatatggccttaaatactgaagctgtatgcctggctttgcacgcttgggactgctgctgggtgtggcaacacctcttctatagataaacactgtaggcacactttgcgggcagactgccaggctgaggccgagtggtgtctttgactatccaaccatcaagccgaacctgctcaatcccaccaactccagcaggacctccacaaggctgattttcaaacgaacacaggaggctccccttacaggactctgccaacccctacatatgggggatatttctgttagttcttttgcctgtttagtttttacatttttatcttttttaaaaggcattttaaataatttttaaatgcttcctgataattagaaccctaatttttaaaaatctttatctttataattatctttaatatgtatgtaatggtatttaattatactcctaacaaatgtggttaagttctttacagctctagtgtgtgctttatgctcaaggactttgtaccctcaaccagtaaactactattacataaatcactttctaatctgccttatatatagatttccaaatcgtaatatgtttgcttttacaaggggatagagaagacctacagtttgaaataattctatgtggggaaaaaaaatcacataagaaatagaaccatttgtatattttcaaagcctccatttagaattttttttaatttagggtttcagttaaaaaaacagtttaaatatgataaggaaatcagtttttcatagaagtatgttagaccataactaataaatcaattaagagaaataattactcaaaaatttccagccaataagaaactatattagctgcttaaatatacctcaacatttatttaaattctagtaaattctagcctagagtagataatgaaacattaaatgaatcaatctgtattaaattattatataattaggggaatatgttgataacacttacatgctttcttcccctacaatgcataccgcagagagaagtttaaccacatctgtcatcatattggggtgtctgggatccacggctttggccaataaggaaaggctcctctcctcactcataattctttccaagccatactataatattttgaaaataagaggtcaaatgttagaaattagttagaaaaataataccctgaaggaaatgtagttattaaaaaaaatttataggacatttttacacttactaaagctaaaaaatatagactgtgtaacactctaaaaagttcatggctgggcacggtggttcacgcctgtaatcccagaactttgggaggcagaggcgggcagattacctgaggtcgggagtttgagaccagcctgagcaacatggagaaaccccctctctactaaaaatacaaaattagccaggcatggtggtgcatgcctgtaatctcagctactcggtaggctgaggcaggagaatcacttggacccgagaggtggacattgcagtaagccaagatcacgccattgcactccagcctgggcaacaagagcaaaactccgtctcaaaaaaaaaataaaataaaaagttcataagggtattcactttatgtcaagaaccacaaaactaaaccaaataaagataactcaaggtgatcttacaacaatacagctgacaattattaagacaggttaagtagccaaattgagaaagtgggaagcagtcagaaacatgggatttgccaacagaagcatatgaaacaaacagccagatacggaaccagacactgaggccatgaaaatctttttcctgggaaggaaggttggtaagagatatattatcataagcaaacacacagatcaacactgtccaagagaaatataatgtaaaccacatgagtaatttaaaaatttcaagcaagcaaaactattttcaataaaattaatccaatataccccaaatattaccatttcaacatataaccaatataaaacatttattgatgacatttcacttctttttcttcctaaatagttgaaatccagtgtgtattttatactgtagcacatctcaattcagactagccacacttcaaatgctcagaagccacatgtagctaccatattacaaaatacaggcctagatattagcacttagttcataaataagcaaaaactgaaggatgatttgagcagataccatgtagaaactgccacaatgggcacaggtattctaatcacaatggtatttattataaggaaaacaatgcagttgtaaactcattctataaatgagacgattgggattaggataaagtttatttactactgccaggaagtcaaatccaattagaagataagttatgttaatgatgtatctatgaaagataactgtcaaaatacagaagatgaatagaaacaataaaacagtactatttatctagcatgcatctcagaggatcctactaaagcatgagaactgactaatcagagttactaccaaacactaaaaaagggccttattcccaattacaagcctatgaactaaactcaaaatcagcactacatgtaagcattgaagttgaatctataaccagcttagacccaagtactttgattgtgataaaatcctatttataactttcctatcttgtatatggccatttatgcaaagaaaccttgtactgggctgaaatactccatttactttaaaccactatctgagaaacacaggaacaatggagaaagtatgaggaaaggccaagggcccaagaatatgaattttggagagattactctgtcttgttagtaatagggaaaagtttacaacaagacagctaaacagtcaggaaatacttacttttatgatagcctgggctattacctaactggaaaaagaatgaaaaggcaggcacaggaccagaaactacaatatgccttgctaatcattccagggaattgtcaggtttataaagtaccacttagattcaattcagaaagtcagtcaatgattaccaagtacacaagagctggctctgtcctaataaatctgggaattgagtaaagcttgcctctagcatttccccttcttttcccacctacctggttgtccttagctaacacctgcccttctagaatcagaatcctgtgactcctccagccacccaaggtgactcatgctgacttcctccaagtgatactacctgccttctctgccaaaccctctggccctaacctatcatgtatgaaaggtgaaataggagcatactctgatttcacagttttaaccatcatcctgtgaccccaaaagtccatcacaggtaacgttctctgattttggtaatgcaaaaatgtgtcacactcattttaagactggaatgaggccaattactactactcagtatctataaatacagaattgctacttgtataaattactctcaattatttaaaaaacatagcaaaacaaaacaaaaactgttgactctgtgtgagaagttgtcaacttaccagtgctcggattaaagtgcatttaatgagggctgttttaggttagagaggcatgacaaattttgaaaggtctaaggatgtatctttcctgaatgtcaaggacccactccggacaatatggtaactggcctgttctaaactgaggatcaatgccaggttccgcctgcattccacatgaggcctattattagctaatagatggaatttcaggcactgaagatgatgttttaggtagaggaaagttaatgctctaaatcctcgtgtaggacgcccaacatctggacgcacacagcatgactactagtgctgagcagccacccacagtgagttaatcccagtagcagaaataatgtggttaaagttgctggcttcagaagcaaagcacccgcaccttgggtgcactcttcaaagcaacacacacagttaactgaccaaactgaagtctctgttctaattacctttcaatttgaatatactaacttttcatccttattatcttttctttcccctacgcaattaaaattctcttccatttaaaaaatactcttagtccaatttaatgttataagaaattcactttcatgtaatgttatcaaatttgcccattaattgtataattaattactagtaccaaataaggtaccacatttttttcctcttaaaacttatattttcaccattcaatgaatgctaataaagactgtataagtgaggtttaacaaattttgtacttatagatgtgatcaaataaagattaagacaaccattaaccaatcttgaagggaaaaaaaacttcaccaaaaatttcacatattgctaggtttagagttcagacactataatactaagtaacaataacttaaattaactttttattcttaataacacagataaaagcaccaaataaaatggcaatattttatagctccatgtatataaactacaagcaacaaaaatctcttaagagaaaaatagtatattaattagaaaataaagttcaatcttcctcagattcattatgaaacaaagtaagaatattatcttctatttaccaccttaatttaaccatgatattcttcttaaattcaaattatgatccaaatgtccctttggtttaaaaaaagttcctagattttttctacttttggcttttccatcaccaatgaaatttccaatttctatattctcactttaaaaagggcttcctaaaccagttctatgtacttagtgggcaaagacctctccctatcagcaatttgattctttcattcatttactcttaaaacagatatgtaaaaagctaccttatatatctaatatctgattttcaaagaaccgtgaattcagcatagaaaggagttgtgattcctacatcacatattttctttgaaaataatatctgtttagaggaggcaaggaagaaaaaatatttcattggttaaaaatagaaagcttagctccagaaaatgcttaaaaatacacagtttaacaagacaaaaataattagaaaatataaatatttgctaatacatgtagtaaaataaatataaaataaatcaataatttacgtactagtacttaagtgtgtagccctataaaagtttgtttttaaattagaataaggcaaaatattataattaaaattaatcagaaatatacagatgcttttgctataaaacaaaaataatcgtaccaccacaggtaaaatttccccccctgctgtctaacagcaacttaaacacctatcatcacttcacacatcatgaggtaaatgtgtttagatgctggagcttaaagaaacagcataggataatgctaatttctacagttaacagtataaaagcaaaaaagaaacattgctagataaacctaaaatctaacttcagtaaagagcttaagaattcctctttttttctagtttttttgttttgttttgttttgttttgttttgttttgttttgtttaaggacagggattcactttgtctcccaggctggagtgcagtgattcgatcacagttcactataacctcaaactcctgggctcaagccaccctttcatctcagcctcctgagtagctgggactgcaggcatgtgccgccatgcccagctatttgttttactttttgtagagatggcgtctcactatgttgcccaggctggtctcaaactcctagcctcaagcaatccctcctgcctcggcatcccaaagcggtaagattataggtgagagccacaagcaggtttctcccttctaatgtaacctctttaactatgcaaattcctccatattacgtttattctcaatattacttgggttaagcctcattgctctatttctgagacctgcttatatctgtttacattaatttcattgtagattttaaattcctagaatataagaaatcttcctaacttgaacctttggtaataagtattattgcagctcacatttaataatcatgatcttaaagctgactcacgccgtacttttgagagttaggagagggaggaaatgaaggaaggaagaaaagaggaagagtaggacaaaaaagcagagaaagggtggtgggtggagagaaaaaaagaaagaagatggggttggggtgggcagggttgagagggaggaaagggtggggagagataattaacctatacatgaggagttcagcaccagaagaggtttattcattatcaagtttctcctattgcaagacagttgaaactagaattcaataaaattcaatatttttccatcatgtactaaaaaacacatcagaacaatttaccatcactttactgcaactgaaaatcatatattacaaaattggtgacggacaaatactaattacgtatgtacatacctgcgtattcatcagggcttttagacactgtatgactttatgttgatttttctttacaactttttcttggctgtattgacataaaaaatagcagtgttggaattataattggacatatgaatgatgcttacttgaaaataattattagcaatacttacatttttccactaatcagtttttccaaaatgtctaataataatccaagcccttcatgtccaaagctttccacccaactgaaaaacagaaaaaagacagttacacattgtcagtaacgcagcttgtgttatcatattatatacctacaagtattttatatttgctatattcctaatcgtaactaaaacataagaataacaccatatataaaaattattcatgactcatcttagttgtgaaagaagcaaagatggatatgccaatagtgtgctaaactccgcttgcacaggcttgtaagagcagactgtgcccatctcttccatggttcatgtttagggacatcacgtgggtagcttgaaatcagccacagtgaaagtattcacaccaaagaaactggcaaaccaatcagagcctcccccacccacgcacccagagctggctctaaacatttaccagcataccactaattacagcccatttggggctatgccaaagaagacaaattgtacaagtgagtaaagatctatggaggaaagatgtagatcaacataaagaaaaagattactggcaaaaattaattaaaaaaaagagatgctttagcagaattccccaaaccactgaaatacattcctacaaatgttaagaatttcctaagtttcaaagttcagttgctttaaaaacaaacaaacaaacaaacaaactgcatcactgggttttaaatgagttatctccatgttcaccaaaccaaacctgtcccataaacccactgacccaatcacaggcctttacataactagaacattactgtcactagacaacagcttgcctggattacatgaaaactacctcgctagaaatgaataccttttctcagtggagattagtaaacctaggccaataaataataacaatgataataatctgtcaccaaaagaatgaaggaaagaaaagatatatgtgtgtatatttatttgtatgcctgtacttatatatgtgattttatatatgtgtatgtgtactgtttgaacagtaagatgttaaaaacaaaatttcggccaggcgtggtggctcctgcctgtaatcccagcactttgggaggcagaggcgggtagatcacctgaggtcaggagttcgagaccagcctgaccaacatggtgaaaccccatctctactaaaaatacgaaattagccaggggtggtggtgcatgcctataatcccagctactcggagaggctaaggcaggagaatcacttcaacccaggaggcagaggttgcagtgagccgagatcgcgccatcgtactccagcctgggcaacaagagcaaaactccatcacaaaaaaaaaaaaaaattcaaggaatgaaaaacagaacactataaagaataaaaacaagcttaagtcatatatcagaaaataccaaaatatcattttttcttaagatacaacatttccagtgaaaagagaataaaaaccaaatgcaacatatttatataaaaaatacaaatattgagtaaaatccagcttcttcatttgcatatttctgtaaatacaacttgacacctatcaatgttgaggatttctgattttacaaaaaagaaaaagaaatttgccatttagactggcaatctcttgtcagacaatattttactcatctcttgccagtgaaagccatgaaataactaatttttaaaatgcacttaaacaggaaagatactctcttgtaaaagactgaagattgctattatagttaaggtaaggaaaaaagttaaacagaggttgttttcaaaccaggctgctacttcaaaagtgaagggtttactcttcactatcagcgacacacagattatctgtaggcattttgaatcttgtttttatgtttcatgaaaacaactacagcatctcacttaactgtttgccttgttgacatcctattctgaatttattcctatttcacatgcagcagggaagtgaggagaaatctgagagttttacttgggctgacattgagatgcatggagagagactgttcataaggcactcctctttaatacttcacagagggccttcaatattttgtttgaagtaagttttcaacaatatccatattcaaaagtatagccacaaagatattctaaagccaatataaatggtttcagattattcatactgctatcacctttaatcattgtgaagaataaaatcactgttcatcaaactgcctcacaccaaaataggcaaagtaattttaaattatgttaatataacaaaaagactttgttacacttaatatgcttatattatgacccactataaaatttaagaaacacaaatccatgtaaatcagtaagttctctgatctacataattaataataaaaaatagctatttaaaatgtattacctttaacataattataactagaatagtgtgactcatagatggtctaaagtcaactatttctagacccactatataactctcttctaaactacagaatatgaactattcaaatagaatgtatgcctactcatgtattttatatataaactaattctctataaaacaaaacttattaaagttccgtgtaaagaggcattaaaccaaatcacttcatctattacaatcttttaagtcactgtgggaatttctcaacaacaataaaatgagagttgggcaatggccttctgaaaaccagattatacattatatctcataaaacatgtcaaaaacaagaaaagtgggacagggtacagggaaagaaaactgagacacctgacaaccaaagaaacaatataagaattaaaagaaagctaacaaaagtacttactaaaaagattaaaaattaaatatgcataaaacatctccctgttttcttaaaaatttgcaaactcaacatactgttgtattaacaggtgtcactcacaaagcaataatctcaagtgtttcaccctcacccctactattttcagcaatattatttttaaagataggggtatgaatatcacttcctatttccactggaaaagatgttcaagataaaaagtgatattgagtaggcaggtctgtagtcttgacagaggtttattgagatccatagctttctacaaaaatgaaaaaatttctcatcatcagtgtaagaagcaacctagaaaaaaattatcaactgatctataaatgattaatttccacgaactaaaatctgcactatttgttctatgcctgtcagcacagtaccatcaggcattatgtggtttaactataaactgcattcatggataaatatgcacgtttcttcttcatgaatagaaatgacatagagatcagtatgacatttgtatcagaaaaaaactgctttaaaacagcaaccgtagtgtgctaaatactaaatctacctcttaaaattctgtaacaggaaatattaaactcttctaattgcttcaaggaaaacttctaagtatattacccttcagcatttcctagtaggggtctcaatataggagaaaagaagagatgaagaggtaataaaacttaataaaaattaaaaaaaaaaaaaacagagggagagggagaacaggttcccagaattacaatgtttaacccgcctttaaatgttcaaaagcagcttagactttgaaattcagttactacttccagaaacacaggatgaaactgaaagtgtgtaaagtggtttctgacatgttgttggctttaatacagaagtaaatacagtcagtcacctcattgagcaatagaggcaacaatcaggtctcagatttacctcctggccaaaaggaacaaagcgctctcaagtatttttcccaaagactgatctcctactcttcctttgttttgtttaaagttattacctttcttcccagatgtgctcgtagaaagggaaagacaaatgcatcatgaattataatggaattaatcttggaattattacccttatgatctggaataaacataccagatcataagagcaatcttacctgatgcatactccttgagtatagggaccgtttcttatatatcatatttattccagcatgggatagactgagcactcaataaatcattttagaatgaaactaagtccccttctattgttacatataagaggttatagtcacttagaaataatatttaggtctgctgataaccaggcttgtggcctttatatatgcagaaataaacacaaagagatgacagatctccacaccattactgaacctgtctcaaccttcaagctagaaacttcaattgcaatttcagaactgttatttgcccatactgaatcaaagataataaaaccaaagacagggtcttactctgtcgcccaggctggagtacagtgacacaatcatgtctcactgccacctcaacctcttgggctcaagcaatcctcctgcctcagccttcctagtaactgggactacaagcatgtgtcaccacattcagctaattttaacttttgtagagatcgggtctcactacgttgcccaggccagtccaaactcctggcctcaagcaaatcctctcaccttagcttccaaaagtgctgggattacaggtgtaagccactatgcctggccaagtcagcctttattaaagggcacactgtattcttgatactgcactaggtatgagaaatacaaaactgaataaaatatgttctctgcccttgaaaagatcacagaccagtggttgaaacaaatgtcgaacaaaattatttccataatgcaataaatgctatactcatggtgctctgggaacagaaggtacaatatctacctctcttgggaacttcaaagcatctgctgtctgacctgagtctttctttctaagcaggagggcatatgcacaaagacattaaatgtaaaagaaatggcctgtgctgagcaacagagaaagctgtatcagagataaaaccaaacaggtaagaaagggcttgatcttgaaaaaccacatatgtaatgccatgggcaatgggagggcataaaaggactaagcatgtgtagtaaagagagtaatcctacccttgcccaccaaaagatctgcacatcttaaactcagaacatatgaatatattacctcatgtagcaaaggagaaattcagattgcagatggaattaaggttgctaatcagatgattttaagataggaaaattaccctagtttatccaggtggttccaatctaatcatgtaattcttaatttcccagcttggttagagagatgagatgaaagaaagagagtcaaagcataaaaagggatgggcaccctggctcacgcctgtaatcccaacactttgggaggctgaggtgggtggatcacttgaggccaggagtttgagatcagcctggccaacacggagaaaccccgtttctactaaaaatacaaaaatagccgggtgtggtggtgagtgcctgtaatcccagctacttgggaggctgaggcaggagaatcccttgaacccaggaggcagagaatgcagtgagccaagatggtgcctgggctccatcttgcccagacaacaagtgcaagatggttgcccactgcactccagcctgggcaacagagcaaggctctgtctcaaaaaaaaaaaaaaaaaagagcataaaagggactcatcttgcctttactggttttgaaaatgaaggaggccaaagaagagccaaaaaatgtaggtggactgaaaaacctgggaatggccgtcaactgaacagctagaaaagaagtaagaatcttaatcccacaaccacaagaaattgggttctgccaataacccaaatggacaagcaaattgagttgagtctcttattcataaacactagatgtctccatttatttggatcttctttaactcctttcatcgttattttgtagttttcagcataaaagtcctatgggtaattcattagaattacaattattttttgagcaattatgaatggtattgtgtttttaatttcattttctacaagtacattgctagtacatagaaatacaattttatatttttatcttgaatgctgcaaccttgctgaactcagtgataagttctaggagtttttgatagatttcttgagattctctatgtaaacaatcatgtcatctgcaaatagggacagttttatttctacctttctgacctgcatgcctttatttccttttcttgcttcagtgttctacctagaacttccctatggtgtaaaacaagcgtcctgaaagcaggcatccttgccttgttctcaatctatcttagagggaaagcatttagtctttcatcagtaaatagaatattaactataggatttttgtagatctctttaccaagttaagaaagttcccctctgtattagtttcctggggctgcaggaaactgaggagtttaaaaccacaaatatattatcttgtagttctggaagcaaggtgttcaaaatcaaagtgtcagcagggctgctgcctgggactctgggtagaatccttcactgcctgttcctagcttctgatggaagctgccaatccttccagtcatcagatgggactcttcctgtatctctgcctttttcttttaaggacacaagtcatactggatcaagactttaccctactcctttatgacctcatcttaattaattacactgcaatgactctgtttccaaaaagggccacattctgcagagtgttaagaatgtaaatacatctttctagggacacaactgaattcaccctctattcctacttttctgagagttttcattatgaacaagtgttgaattttgtcaaatgctatttctgcattgattcaaatgatcaagtgacttttcctcttttgcttgtcaatataatgcactatataaggatttttgtatctatactcatgatgaacattggtttgtaagtttgagggttttggttttgttttgttctatcttggtactgtattggtctggttttgctatcaggtaattcaagcctcattttaaaaaaaaattaattgctgtctgctctgctattttctggaacagactatggaaaattggcattaattcttctttaagtttgtggtaaaattctccagtgaaatcacctgcacctgaagatcttttggtggggagaaggaacttaattatcttaatagtcagagggccatccaaattatctatttcatattgggtgtgttgtagtttttcaaagaactgatctagttcatctaagttgttgagttgtatatttaaagttgttcaaagtattcccttattatcctgttgatgtcttggtaatatatcttgtttagttcatgaaattcgcaatttgggcactgctttcaagatgtttttatctatctttggttttcagaacttttttttttttttgagacacagtcttaccctgtctcccaaactggagggcagtggtgcaatctcagctcactgcaacctctgcctcctggattcaagcaattatcctgccttagcctcctgagtagctgggactacaggcacgcaccaccatgcctggctaatttttgtatttttagtagagacagggtttcaccattttggccaggctagtctcgaagtcctgacctcaagacacccaaccgcctcagcctcccaaagtgctgggattacaggcgtgagccaccgtgcccagcctagttctcaggaatttgactatgatatgtctgtgtgtgaatttctttgagtttatcctgtttgtgattcagtttaggtaggtttatgtcttttgccaaatttggggactattcagcctttttttttttttttttttttttgagacagagtctcgctctgtcgcccaggctggagtgcaatggcacaatctcagctcattgcaacctccgcctcccgggttcacaccattctcctgcctcagcctcccaagtagctgggactacaggcacgtgccaccacgcccagctaattttgtatttttagtagagatggggtttcaccatgttggccaggctggtctcaaactcctgacttcaggtggtccagccgcctcagcctcccaaagtgctgggattacaggcatgagccaccgtgcccaccctattcagccattatttcttcatgtacttttttatcctgtcctctttctcctctcaagtctccaatgacaagaatgttagatctttggttatagacccataattccctgagactctgtatgtattttttcccaatctattttttcctggtggtccagactatatactttctatcattctatagtccagttcactaattctctcctttcagcctcatgtttcgcttttgaggccctccagtaagctttttacttcagttattgtatttttcacttctaagatttacatttggttctttaaaagaagaaatagtttcctgtatttctttgctgagactttctattttttttcttttgtcagcacattcctatttgcctattgtaacacttttatgatgactgctttttaaaagattcttgtcagataattctaccatctctgtcatatcagtgtgtcatctattgtcttttttcattcagtttgtgattttcctgcttcttggtatgaccatattttttatactgaaggctgaaaatttgggatatcgtgttataagattctaaatcttatataaacctcttatttcagtaagcttcctatgacacagctccagtggaagaagagaaagcaccacctcattactgcaaggtggaaacagaagtccaagagagattctttgttaccacttgacatggatgggaatctaggtactccctgatggagagaaggaggactgcctcattatgctcaccatgtaacctacaatagcaccatggaagggggatgtggacgtctgttatcactgggtggttgtgaaagccctgactctattggcttctttggacataatgccagtggggagggggaagaatgcctcattaatgccatctgtgggtagaaatccaggctacccactttgctttttgatagtgtggtgggggatggggccacatatttttttctgcgatatttagcagaaatacaaagcagttattgccaacattttctgtcttgtttgctgccatttttgtggtcctttggtttcagagagaaggcttttgttgggacttctttgttctgtgcccactgtcacttctgggttactgacttcttcacctccaaatctgacaaaaaggcagaaagacaacccagcaaactcaccgccatattgtttcttaaatctcaaggttcctagcctgtcttcttatatttgtttcacatataatgtccagtatttctagttgtgcttagcaaaaaaaaaaaaaaaaaggaaatagtagatttagtctatctttcaaacacaagtctgaaacatccactgttagagtgtgagaacaggcagaagctcccaccaagaaaatgagaaaaaggcagtgacagtggtaagaggagaaccaagtaaacctgacataacaaatccaaaggaaagaagaagtttcaaaaagagaagagtcaagagtcaagtgctaaaatgaggtcaaagaaaataagggctaaaaagaactataaagaaatgaattcaacaacaatttataaataattctgtagaagtgaaatcctgattgcaaaagaattaaaacagaaaaggggtagtaagaacaaagaaaaaaacataatttgggattaaagagttgatggaagaaatttgtaggaggactgagatgaggacaatttaaaaaaaaactgtgtgccataaacactattacaaaaataaacagagaatattagaggagcaatgaagatggctaccacacttagctagggcctaggaacaaaaccaaacttaaagaaaaaactatgcctacaatcttgaagtggaatgatgctcatatatcttaagtttaaaaagcagaaatggtatataaggcattttctattattattcttaaatgtttttgttcacatataagaaatgtatgtacatatgtgtagctatacaaacattcttaatcatcctccacctagtcagctaattcaaggcttgagttctactctcttatacatccccacacactgctcccaccagaaccagttgggtttctttccaaatccattcctgacagttgtacctactattgtatttatataattaatattatataaacagataacacataattggggaaaggggtactttttctatgaaaactaagcgtaatgatttggaaagctaaaaatagattactttttaaattgctgtagaagtaaatgtgggcacaactatatattaaagggaaatcgtagtaccaaaaaaaatttttttagcagaagaatacttctgcattcagattgctctgccagagcctttatgatcctgttcttctttaaagcaccaatatcaggaagacaacgcattatgagtatgctttatgcaatcagcctttgcccactccaagaaaaggtctgggctccatatgaaatgtctacagaaaaaaatgtttatgctttagattgaaaaaaaaaatgtttggggtatatttgaatcatttatttgattattacatgctttaagcaacttttttaaccaaccaaccaacggtattagacaggaagacttcctctgtagacaaagtgtctctctctctctctcctccaagaagttagtgtctatttaagtagataatattatacatttttcttgattttgcttttgcatattttcttattgtcctataatgatcttatcttttttgtaataagaaaaatatttttaattacccaaaagaataatcttacatgaatgcctagggaaacacaaatctagatggtttaaaatcaatacacaaagcttcttaaaaggagaaaaaatacattactgctcacatgtgacaaactaacaaattttgtaccttaaacttggaaggtcagctttaatactgtataatatctagatccaatttacattcttctgtcagagtaatatatcaccaatgctgaatataattatagcttattttaagctttcattttcacctacctttaccaaggtgactaaatacttaaaatgaacagttctaggagggagtacaaagcacttagcatgccctgtggggcaagacaaacatacacctacatgccattcaatggcccatccacccaaattacactaaattacagagcaaggctgggaattcaggaactattataaataatgttcagattgtaaaatctactaaccttcaaaatacaaccactaatatgtatattttcttgaaatatacttcttaaagaaactgtatatttaaaaacaatcatttattcccacttttcatatcagataagataacacagtaataaatgtagtattctcctagtttctttttggctataacatactgaaaggcataaaatatctagagaaagcattccaaataaaatgaaaataaaaccaggttaacaggaatgataaaaaaacaaagcacaagaaacaagagttcttgacctttagatgaaaaaacagtaaaacaagtatggattttaaaacatagatactggtatgtgctctaatcaaaacttaagtccactattaaaaggaacatattataaaaaaggaaatatcttatttggaatgtgttaaatattagtacactaatatttaactaaagggcactaccagtaccagtaagtagtttcttagtatcaaattaaacatcattagttcaagaaagcactaaattattcattttaaatatagactaatttgccaacaatatatgtggaaaagacgttatggtcacatttcaggcttttcaccgcttgtccccaccctaaatacttgtcactactacccaatgctggtcagagcagtcctaattattaaaacccatgatcttcccttgattctataaatttcattgctacttttgtgtggcaatgcactcataatgctcccctccacagaactgcctttgtaacaactgaaacaatttcagctttcaaggccaattcacatttccttcttctttgaactctcgctgatttgatttctccatgtgttcaccaagttccattcacttgacctcagatacccctcaagttagttcccatttctctcctttcttttatagcaaaaggtctcaaaaaatttcatcacaagcatggtcagcacttcttgccatccattcactcaatctcatttcagtctggcttctaccaccaagactccaaaaaaatctattttctaaaaggacgccaacaaccttcctcttgccagttccaataatatcatcttgccccacctcatagcagcacgctatgcagtttgtcactcccttattttgaaacactcttcctttaggtccagaaaccagcatttggggttctcctccccactggctactcctcagtctgtgtttctgcctcctcttccctttctggatcacctatttctggacactttctgaacccggagtccttcagaacttgttctgaccgctcacctgtatctttagcttccttctccatacaacctgcccacactgggattgcatccattctcaggacttaaatatctccactccacatatgtaagctccagactcacacatctaggggtttgcttgatgtctcaaattgtgatactcttttaaacatgtcaaacttaacatgttaaaaagggatatttttggccgggcacggtgcctcacacctgtaattccagcactttgggaggccgaggtgggcggatcacaaggtcaggagatcgagaccatcctggccaacatggtgaaaccccatctctactaaaaatacaaaaattagccaggtgtggtggcatgcgcctgtagtcccagctactcaggagcctgaggcagaagaatcacttgaacccaggaggcggaggttgcagtgagctgagatcgtgccactgcactccagtctggtgacagagcaagactccgtctcaaaaaaaaaaggggggattttttttcttctccaaaattcacggaacaagtaacaacctcctccaccccaattaacagcactactatctgcctatttgctcaagtaaaaaaaaaaactgttattctcgattcctccttttcattcacatcctacatccaatccaccaacaggtcctacagtttccacctccaatttatctgcaacattcacccaccccttggcccaccactgctacaatccttatacaagccaccctcctaattcatgtgactactgccagagcctcctatctcacaccttcttgtccactctctcctcccttcaatcaattctccctaatatgatttgggtctctgtcaccacccaaatctcacctcaaattataatccccataatccccacatgtcaagggcagtaccaggtggaggtaatgggatcatgggtgtggtttcccctatgctagtctcttgaaagtgagtgagttctcacaagatctgatggctttataaggggaatttggcatttgccctgcttccactcactccatcctgccaccctgtgaagaaggtgcctgcttctcctttgccttctgccatgattgtaagtttcctgaggcctccccagtaaagcagaactgtgggtcaattaaacctctttcctttataaattacccggtctcaggcagttctttatagcagcctgagaacacactaatacacttcctgtggcagttaaagtgatccttttagaaagttaagccagaatagctcatctcctgcttgaaactcttcaacagactccacttccacagaatgaaaatccaataaccctaccacgagctttatggccatgaccttccgcatggcctggccactgcccaccttctctgacagccttttggattccaccatcctctcctctctccatccctctgccacacggtttttccacctcatgttcagtactactgcccactcttctctaaactagttccttgtcctttggtgtcaaactccaccacctcagaaagactttctataatcagctaaatcaaaaaacctctccattaattactctcagtcctcattttttcttcactgaactgattatacctttttgttttatttatttgtgttctaggtttctctctcctatatgcttctcttttactgtggtacctagcatagcccttggaatacttgttgcatatatagattacaaaatcctgtgctatattttagtggcatgttatccatgtcacatacttaggaacttaagagctttattctttcacatgttagatgtttctctctaaaaggaatcgcaacaatttaagaaaagaaatccttgcacctcatctagtattccaaacagagaatacataaaaacacttgaaatacctgctctcctgtcttgcaaatgagcagtacaggctcatgtattttactttatttcaagcattaatctccttattctgtttttactattcaaatccatttaacatgtactctgatcttctctcctgagtcccatattaaggcttcacaatgatacaataccgggtcccctcctcagaaattcatagcacagtggagagagcagccacacatatagactcaagagtacaaaggctcaaaacaagtgcacaagaaatgtttttctgatctctaaagatgtgttgtccaatagggtagcctctagacacatgtggctatttaaattctgaatttaaatcctaatcacactagcaatatttcaagtgctcaacagccacatgtggtaagtagcttctgtaatgaacaagacagacatagaccatttttgtcattgtagaaagttctatcaggcttctgttcaaatgcgctaaacttctacttagccctgcagagggactgcaggtgatatcagtggctctaacattcttttgggtgtttctttcatattattgtattaggccattcttgcattgctataaagaaatgcctgaggcttgatgatttataaagaaaagaggttaattggctcgcagttctgcaggttgtacaggaggtatggcgccagcatctcctctgcttctgggaaggccttaagaagcttctaatcatggcagaaggtgaaggggtagcaggcatgtcacatggccagagccagagtgtgtgtgttggctggagagggggtggggaggcaaacttgtaaatgatgagatcttacaagaactcactcactatcacaaagacagcaccaagccatgagggatctgacccatgatccaaacacctcccccaggccccacctccagcactagagattacaattcaccatgagatttgggtggggacaaatatccaatctgtatcagtctgccccaagcccctcccaaatatcatatccttttcaaattgcaaaatgtgatcatgccttcctaatagtcccccaaagtcttaattcattccagcattaactctaaagtccaaagtgcaaagtctcatctgagacaaggtgagtcccttttacttacaagcctgtaaaatcaaaaacaagtcatttacttccaagatacaacgggggtacagatattaggtaaacattcccattccaaatgggagaaatcagccaaaacaaaggggctacaggccctaagcaagtttgaaacccagtagggcagtcattaaatcttttttttttttttttttttttttttttgagatggggtctttcgctttgtcaccaggctggagtgcagtggcacgatcttggctcactgcaacctccgtctcccaggttcaagcaattctcctgcctcagcctcctgagtagctgggactataggcacaggccaccatgcccagctaatttttgtatttttagtagaggcggggtttcaccacgttggccaagatggtctcaatctcttgacctcatgatccaccgccttggccttccaggcgtgagtcaccgcacctggcctgcagtcattaaatgttaaagctccaaaataatcttcttgactctgtgtcccacatccaggccacattggtacaaggggtgggctcccaaggccttaggtagctctgcccctgtggctttgcagcgtgcaccacccacagctgctctcagatgccagcattgagtgtctatagcttttccaggtgtagggtgcaagctgctggtcaatctaccattcttgggtctgaagagcactgaccctcttctcacagctcaactaggtagtgccccactggggactctgtaagtggtccaaccccacatttccccttggtactaccttagcagaggttctatgtgaggattctgccagcccctacagcagtgttctacctggacacccaggctttctccatatatcctctaaaatctaggcggaggctaccaaacctcaactcttgcattctgtgcacccacaggcttaacaccacatggaagtcaccaagacttacagcttgcactctctggagctgtggcccaagctgtaccagggccactttgagctaaagctggagccggagtggcagggaagcagggagcagtgtctcaaggttgcacagagcagcagggtcccaggcctggccctcaaaactattcttccccaggaggcctctgggccagtgatgggaggggctgccaaaggtctctgaaatgtcttcaaggtttttccctcatcgtcttagacattaactcttggctcctttttagttatgcaaatttgtctagcaagtagttgctccacagccttcttgagttcctctctgaaaaaacctttttctttgccacatgggcaggctgcaaattttccaaacctttatgctcttcttcctgttcaaatataaatttctttgctccaacattggaacataggcaattacaagaaaccaggccacatcttgaatgctttggtgcttagaaatttcttccaccagataccctaaatcactctgaagttcaaccttccacaaatcccaagggcagaagcaaaatgcagccaaattctttgctaaggcataccatgcatgacctttgctctggttcccaataagttcctcatttgcatctgagacctcttcagcatggatttcactgtccatattactatcagcattttggtcacaatcatttaatgagtcgcaaggaagtttcaaactttcccttatttcccatattcttctgagctctccaaattcttccaacctctgcccatcacccagtaccaaagttccttccacattttcagatatttttacagcaaatgccccactcttttttttaccaattttctgcattaagcaattcttgcatttctataaaaaaaaatctgcatctgggtaatttctaaggaaaagaggtttaattggctcatggttctgcaggctgcacaggaagcatgacaccagcatctgcttgccttctgggtcggccttaggaagcttggtggaaggtgaagggggaacaggcacatcacatggtgagaccaggagcaagaaagagagtgtgggcagaggtgacatacacttttaaatgaccagatctcatgaaaattcactcactattgcaaagacagcaccaagctcattgggatctactcccgtgagcctaacgcctcccaccaggccccaccttcagcactggggattacaattcaacaggagatctgagcaagaataaatatccaaactatatcaattattatttatgaaatttaatatacaagaagctgaaataaactgtacctgttcctttcagacatatactgcccctctaataaaagaactattaatccatcatcaatctaattgacggagttttactcttaaaaagttttctgaatgataaaaattaaaacttcttctattgtcaatgtgatgccttcctttgtattaaggcctttcttcatgtatagatatgtaagggaataccaagataaacatcatcattttaaaaatcttttacttaaccgacttggcaatactctaagacataataacaagcccagaaaattaatctaaggaataaactatactgattctttgtatgtagagtactaataactagaggctttagtatctgcagtttaataatttctctcattgaaaatatttatctttcaacagaaaccaaagaaaccaaaatattcagttaataacttcatactgatagctgtaaagccataaacacataaggtttacattctcagaaaacaggcattaacaattaaaaagaaagaaagtttattatattctacctttatatccataagaaactgtaaagtttaatgagtttttttttccaaattgttttggtttaacactctaccttctgttgttgtcttttaaacagtaaactgatagtttcaaataattaggtttgttttgttttgttttgctttgctttaagaggcagggactcactgtgttgcccatgctagagtacagtggctattcacaagcacaatcccactactgttcagcatgggagtttaatctactctgtttctgacctgggccagttcacctctccttgggcaatttggtgatctgccgtgctcaggaggtcaccatattgatgctgaacttagtgtggacacctgattggcacagtgtaccacagcccagaattcctggactcaagagatcctcctgcctcagcctcccaagtaaccgggactacaggcatgtgccaccatgcccagctcaaataattaggttttagttacattttctccccgttatacttaagtatcagtaatatagggtacaaaatctattttttaatagagtagttgaatttaactaatctagacatacatgagctctcgtagttatatgaaactgcgttaaaaatgaagattttggattctgtgtcacattgtgactcactttacatgttaacagaattttttttaaaaagtcaatcttggccatttaaacagctatattttaaataaactgggagatatatatggcagatatatataccatatatatgtatatacgccatgtatatatgtacagcatatatagatatagatataactttaaaaaatagatttggagcactttacaattccaggccctctcaggtcaactataaattgagctgagtagctcttatttaccatctatagaatacacgtgtctgttaaaagcaattaataaattttccatgtgctctttgtttactgttaaccctgtattcaaagccaaagcttttaagatacagatacactttgaaaccaaatatttatacaacattttgctacatctataaaccaaaaaaaagctatagaatgaatgacggtatacaaaagaagcagcctcctacccctagggaacattcagtcttctagaggtctcttagagaaatggtgctaggtttggaaggactgtgaaagcatgagaaagtaatggcttgtcctttgaaaatgtaaagttagtacttatttgaaaacattaatagttactttcttccacgacattttttcattaatatttcatcaatttgacatgcttttagaaaggacagccacatgacttaaaattagaaggtattttcaacaaatatttatttaataagcaatgctacttgtcataaacattacaaactctgaatggcaattaagaaataatagaaggcatatttgaagatagatggcagtgtcaaaacaataaagaacaatattaataacctacctaatactttttgacttcttattggaaagtaatcttgaaaaaatgcctttaagaggtacaagtaggcacatctctctaatgaaaactctgtttaaaaaatgcatcccgctaatatttttaatttaccagagatgtttctacaacttctatgatgtactatattgctgattccctcattccagctacaggctgttacaccgatgactgccagggaccataactatagcacttcctgtcagacatacttcacctctccttttctattccttaatacctggtataaagcccactccctcccttagcctcatcctgctaagccagcactctctgctgaagggaaacctccttagatcactcttctattcccttgggactctcttgagattaatgtccaatcatccttgcagattttaaaaaacaatcttcaatctgtcagtgtttattttctttataatagtctcaccatctggaatataacattgagaatgtaataataatgtagttaatatatcaaagaagtggatatgcagaaccaaggccccttaggcagcactgtctaatagaattgcttacaatgacagaaatggcctatatatatatattgtccaaaatggtagccactaactacatgtggctctcaagcaattaatatgttgttgtgtttttttttcattcatttttagttaactaaatttaaatagccacaggcagctagtggctaccatattgaataacaggaaagaaaacagagctgcctgcattacttacctccgtggtatcaatatcaaagagaaaggaagaaaagagagaaagaaaaacaaaggaaaggaaaaagagaaaagaaatacacccaataaaacctttactccacctgcccctttcagaaattatcactactagtatcaaaatgaatctgaatatatcgttaattatcaaacactttttaacctaaggtgaatttttaataagtttttataacttgttaatctaaaattctaaaacatgccatgcaaatctaaaaaacatatccagaatggagtagagagagacaaataaatgcaaagtattaatgatagaataggaaataataaagtatagagcaagatggtctaacatatacaaaattagaggggaaaaggcaatacttgacaaaacaatggcaaaattttcacagaaagatacccatcatattcaaaaagccaaagaaaattccctatcagaataaaaaagaaagaaatctcacccagacacgtaaaagaaactctacaacaccttaagcatagatatctaaaaccctcaattgcatctcaattgcatgccctaggaaggctatccttccaaagcaaaggcaaatagatattttgagacgttaagtataataacaaaaaaaaaattgtgggtcaacctgattaaatatcatttttaaaaaagatattttcaaacagaattttgccatcacactctcactaaggaatcttaataatatacttaaagcaaaagtaaaataatctggggggcggggacaaaaatcaaaaagaatgatgtgtgtagaaacatatatacatatacacacagttataatatgactcaataatagtaaaatctaacttattaaaagaaaacagatacactgaaatttcactcaaaactagcatacaagtgaaaaaagattttaaagtattctttggttcaagagaagagatattgcttacttttgtacctttgaagtacatgcaagttaaatttctttttaaagtgtgttcatgttaaatttcttttctaagattagaattagattagtaaatgaggaaaaataaaataagaaattaaatatcaatccaaaagaagttaaggagaataaagaggaaggatgaatatagaaaaggaagaagcagaaagaagaaatgaggaggagcaggagcagtttggatgatgaacctggaaaaagtagcataaattaaaaattcaaaatgaaacatcagatataaattccaacatattttcacaattgatacaaaaagttaaaactaccagataaagacaaagattatcagacgggataaaaaaattattcatatgctatttataatagatattcctaaaatacaaggtatgaaaatgattagttgggaaaaatgtaaacagctgcacacatcaagatggataaatctatgaaacaatattgagaggaaatacaactctcagaagaatgcatggaagatgactggttaacatacagttcaaaaacatataaaaccaaacagtaggttaattaggaatatgtatatactaaaactataatagaaaggaatgataaacccaaaactcaggatagtggttaccacagaatagtagggggaaggggtgtttaggaatgaatgagggtataggattaaaaagggatgaaaggaagcttcaaagctataggcaatattatatgtctcagcctcattagtaggcaaggagatgcatgttatattgttatgacaaattgtcttttggaaatgtttaatatctaatttaaaaatttaaagtaagtcaaagtattagcaacttcaaatttctgatcttgaaagacttcctcagatcatgttgataaaaatgagtacactgatctcactgcttgtcacaagtttttctgtctttacacatgtgacttatggtatgaactagatcaactccgaaatcaagatgttccacctgctttgtgtttttaatcccagaaatgaagaaaaaatggattccaaaaacgacacttattaaatggaataatgacattcaaaggctgtttacttgttttcacgtaaacacatacatttctgcaaaattttccaaaatgattttctcaaaattatagttatcaacttaagaatctctttagaaatctaacaaaaagataactttatgagaaaattattcttgttaatttgaaaatgaaaattttaactatgattaatggaaaataatgcctaaaatttcaaaacacaaaaacctgataagcctagattttgagacaaaaaatcttacccttgacaggcacgtcaaattaagaaaataaagataccttctatcactaatttgctatatgcatagatgagtatgatctataaatgctgatatcaatcaaaatgatgttgctgtctacctttttatgtttctacccaaatgtattccataattcaaacataattattgactatgtcaagatccactaaaaataatatttgataatttgaagaaattggtcttttccctggtgttcagaactagctcaaaactgtcaccgagaatactagataatcaataaataacaaatagaagatgtttgtgatctctacatcaaatcttcataaagcaaggcaaataatctagtatttagcatactgattttcacataattcatagagagtaaaaggctgacatggctcacaattgctaggcagtttcagaagttgaagagtggctctaaaaatattacatatccagagccaagaggggagagctaattgggagtacagaggagtctactttttccttgatttctttctctttttttttttgagatagagtctcactctattgtccaggctggagtgcagtggcatgatctcaggtcactgcaacctctgcctcccaggttcaagggattctcgtgcttcagcttcccaagtggcagggagtacaggcatgcatcaccatgcccagataatttttgtatttttagtagagacggggtttcaccatgttggccagactggtctcaaactcctggcctcaagtgatccgctcgtctcagcctcccaaagtgccaggactacaggtatgagccaccgtactcagccttccttcattttttatttaaataaatcctgaacctacaccagcattggaaaaccatcaatcagttcaattttcttttttgttctattcagacattttaaaaactttaactctaatttacttaatgatattacaggtctaacaatgatctcaaacttaagaaaaattagaaattctttttagtcacatactgtataaaaattaaaaactgattcaaagagcaggcatatcataactaacaggaaagtccaaaaatttgatcacaggcataacttccaagttttacatgtccagctaagtcatttctctaattggaacactggacaaagaaatattcaaaagtatcttcttgagcctggcacagtggcttacacctggaatcccagcactttgggaggccaaggcacgtggatcattagaggtcaggaattcaagaccagcctggccaatatggtgaggcctgtctctactaaaaatacaaaaattagccaggtgcgcacctgtaatcccagctactcgggaggctgaggcaggagaatcgcttgaactcgggagatggaggctgcagtgatctgagattgcaccactgccctccagcctgggcaaaagagtgagactccatctcaaaaaaaaaaaaaaaaaaaaaaaaaggatcttctcaattttctctctaaataaagtggcatgatttcagaaaaaattctccaatgatattttctattcttttcaattaaaaaaaactacttcatggataacatcatggattcctaataacatattctagaattgtccatccttagagaaagaattccaccagtttctagtttttcttctttaaataaggttcaaatgaacaagacacagcataatttcccagtgtttttaggtaaaatcacaataataacccattgtaagatgcatgaattcatatataaaaaccttctattttgttttcttttgttagcacagacatctacttttgagtagatgaagaggagaataatagtagtagtaaataaagggtctactcctcattatattgaaaaactatgaatatttccagtgcccactagctgacagataaactgagaaatgagtgtgaattgtctccccagtcaacacccccaataccctttctatgtttaaactccatagaaatacgatgtgaatctgctttgtttattcaagccccacacccaacatactactggaaaacagcaggtgctcaataattttttttttcgctctcgcactcaagctggaatgcagtggcacgatgccagctcactgcaatctccacctcctaggttcaagcgattctcctgcctcagcctcctgaatagctgggattacaggcgtctgccaccatgcctggctaatttttgtaattttagtagagacggggtttcgccatgttagccaggctggtctggaatgcccgacctcaagtgatccacctgccccgacctcccaaagtgctgggattacaggcttgagcctgtaatatatatttttaaatgaacctggacaaatatatttttaaatgaacatattctacaggcaaagattaagctggacaccaaagctcttcatttatgaatatatctgtcaaataaattccccaatccattctcagtttctaacactagccaaggtaagactaaagaaggctaaaattaaaacctcattgtttcaatcaacaaatctttatggagcatttcctacatgctaaacagcgtgtctggtaacgcgaggtaaattacacatatgaagccctagtctcatgccaaccattagtctgcagtctagaggacagactggaaatggcaaaatatggaaaaataaagttgaaatatactaaagtttctttgttgactcatcatactccttagataaatctcactcagtctcacatctcagcaggtaaggttgttttcttttaaatacatgtacggtcaaagatttctgcatactatatcctagccacagaaatgtccaaaaaagtaataatcagagcaaattcttctccatatcatgaacctccaattatagtatgcaattctagccttcagaacacacacacacacgtatagatacatgactacatatacatatattcttatgcagaaataatcattcatttcttacacaataaaaacccaaaactgatctacaatccttgtagctctgaaattctctgtttctgactgtttaggtatttcataacaacttctgcttgaattttttcaagaatactcttgtttagccacctacctaattcagagttagcaaatggcctctgaatagactgaaatctctctttttaagcaccacaattaacatacatgatatatttcaggtacatcttcctgatttttgtttttttaacaagtctgtctcctaccatgcaataatctgacaagtttaaatatgtccagtttatcaaaatatatttacactgattgttcaattttgttcacaactatttcttagaggcaccaaaaattagccccattccaaaactgacttatggaaacacctatggtattgttttcagataaaatacaggatacaaacttaaatttggacgtcagataaacagtgtgtgtgtgtctagaattgaatatttctggtcattctgtacttttatttggtaaatatagcaatactaacctataggcccctacaacgacatcatttccaacaacagaaaaaattaattagtggtatttcttactgtgtcaaataagatcagcaagtaaatatacaatgacaaaattcagggtgaaactcagtcatattaaattaatagtttctcacatgacaattgtcttttagaaaacaccttaagtttctaaaaattctatgtgggcaaaaggcttttttacagtccctgagcaatgtaccactcagtaataaatgcaaaaggtactattgagactatatttcttcctgcatataaatattaggtattcagtttgtactttgagaaactgttgaggtttaccaggcaaaatgaaaaaaagtattaaactaaaagaacacattaatgacatctgccctgttggtgttcaaatagatgaattacctcacaggattgctggtcaaagacactcggagagactccaggcatgtgacaagtctctcatctgcagaccccattttcagctcatgaatgaattcctgaggtgagatctgtcggcttctcttaagacttccctataaaataagtcaaaaaatgttttgattaatactgcatggagattacccattaaaaaataacaagttaatctccctaacagcagcacataactactataattaacactatttgggcaagggtggtaaataatttccttacttctgcccaaaaatctatgaattcataatgtgtggtatccacaaaagatagtaatataacatcagaaggtgtgcaaattgaaataactgccttctcaaatgtaaaatgacatggagaacaattgtatactatagaaaatatcttaaaatacagtaatatttttaggcacacacaaaataaaattcaaaactcaatacaagaactaccctattaaaattagtattctgagcagtgtagaaaaggctattaggtattaattcattcaactatcactataagcctagttctaggcactgtagacacatggattaacaaaaagcgaagtctggaagaaatgcaagcaagaaaataataattttctttacagtctagttcctgtaacacagcaccaagagactcaaagaaagaacatctaacttggcagaacagatcagggaagcttgcaaaacagggctacatcttcctggtttttcttttgtaagtaagcattagggaggcaaagaatgagaaaggaattaacttccagaccaaaacataacacacacgtacacatgcagagaaaaacaaaaacatatgcaactgaagacagaggccagatcatggagtgatagagcactactatgcaattagctctcctggggagttttggaaggatcactccagtgtgaaatatgaattagaagagttagagttcactcattattcaacaaacattaagtacctactaaatactgggcactgttttaagtactgagaatagagcagagatgaaagaagaataagagattgaacttcctacctacatgtagctttactacatatggggagaaacaggcaatacataaaataacgaaaatgcattgcactgtaaataataaatgctgtagagaagaataaaagcaggaaagagaataagtagcttcatatgagacatgcaattttaaacaggatggtcaaagaaagcctcacagagaagacttcaaaggcctcaaacttgagtgtttaaataaaaagtctgaaggagataagacagctaaccatgcatatacaggaaaaaaaaatgctgtgatggagggaactgtaggttttacagtccactgaaagaacttggacttttactctgagatcagaagcagagagatctgttgagaaggtatctatatagcctagataggaaatgatgaggatggtgaactaacaataaagttctgaattatattatttgaattacagattcaccatccaacggcaggaaatgaattgtgtaagttcaaaagaagatcaggtgaagtggtacgaaattcggtgtttttcatgttttttgtttttattaatttactataatgttattcaaaacaacattcccaataaagcaaaacaaattagcactgtaaagacgggttatttttattcatgtcattatcaaagtagtaatttaataaagaagaattcaatggtacaatctccgaaaataaaaggggaaatggtgaaagctatgaaaatgaacatccgattatttttaccgcagtcactgatatcattcaaagaacatattcaacttgtaccaacagagcacttattgatgtctctttttgctctgaattaccaaaggactgattgttcaacagagaaaatttagaaaacacagaaaagcaacaggaacaaaggtgcctcaaaataactactgttaatatatttctacataaagcatttttctcatatatagagagaatattaatatatttgcatatatttatattttaaaacatatatgatatggtttggctgtgtccccacccaaatccatcttgaatagtagtttctataatcctatgttttgggagggatccagtaggaggtaactgaatcatgaggacggttacctccatgctgtcctcatgatagtcagtgagttctcacgagatctgatggttttaaaaggggcttttcccccaccttcgcttggcacttcttgcctgctgccatgtaagatgtgactttgctcttcctttgccttctgccatgattgtgaggcctccccagccatgtgaaactgtgagtacattaaacctttttatttataaattacccagtcttagctgggtgcagtggctcatgcctgtaatcccagcactttgggaggctgaggcgggcggatcacctgagggcgggagttcgagaccagcgtgaccaacatggagaaacccatctctactaaaagtacaaaattagctgagcatggtggcacatgcctataatcccagctattcaggaggctgaggcaggagaatcgcttgaacccgggaggtgaaggttgaggtgagcagagatcatgccattttactccagcctgggcaacaagattgaaactccgtctcaaaaaaaaaataaaaataaaaataaataaattacccagtctcaggtacatcttattagcagcgcgagaaaaaactaatacaatacactttacttatttaaaacatcgtttgatacctattgttctataggctattatctttaagcaatatttcatgaacatattccaattcaaaacataagccataaagaatatgacctcttcctgcctacagactattgcattacttacttaattagtccctggctcttgggcaagtaggttgtttacaatttcttgatatcataaatttttcaagtttcctgtgtgtgctgtcaggccaatatttttatccaaaaatacagcagtggaggttaactagatgatctcttgcagcccattctaaatttattaccgaaaaacttgcaatttgggtaggatcaaaataaaccacaactgaataaatagatttttttcttcaacaataagtaagctccatgtagcaaatactttttaagtatgagaataaccagtaagtgcatgtggataagaacaaaagtgatattaaaagataaaaaacaaaaaccacctatcctacatcttagccctgtctcacaaagacaataattcttaattcctttaacagtttcttctgatagttgcttaatatgtctaatgtacctgatatttttagatttctaaatattcattattacctttgatttgtattatgaaaaataaggatttaattatcttcaaacattggaacctcttctcttccaactcctgaatagcaataggtaaactcaattgaaccaaaagatgccattccatgaaatgagagctaactgaatccacattttataaagtccttacagctacatccctaaagagatgagttcaggcatccaaaaatcttaatgctttagttcattttattatcactgaataggatattatatgtcccaatcataaaatgctcaattactgtaaggatataaacagacacttttcaacggaagacatttatgtggccaaaagacatattaaaaaaagctcatcatcactggtcattagagaaatgcaaatcaaaaccaaaatgagataccatctcacgccagttacaatggcgatcattaaaaagtcaggaaacaacagatgctggagaggatgtgtagaaataggaacacttttacactgttggtgagagtgtaaatagttcaaccattgtggaagacagtatggtgattcctcagggatctagaactagaaataccatttgaccgagcaatcccattactaggtatacacccaaaggattataaatcatgctgctataaagacacatgcacacgtatgtttattgcagcactgttcacaatagcaaagacttggaaccaacccaaatgcccatcaatgatagactggataaagaaaatgtggcacatatacaccatggaatactatgcagccataaaaaaagaatgagttcatgtcctttgcagggacacagatgaagctggaaaccatcattctcagcaaactaacaacaagaacagaaaaccaaacaccacatgttctcactcataagttggagttgaacaacgagaacacatggacatagggaggggaacttcacataccggggcttttcggggggttggggggctaagagagggatagcattaggacaaatacctaatgtaaatgatgggttgataggtgcagcaaatcaccatggcacgtgtatacctatgtaacaaacttgcacgttctgcacttgtatcccagaaattaaagtattattttaaaaaaagaaaaaggaaatacctatagataaaactacaacacatttgtggaaactgaggacaacctacaaaaataaacgttataccatactcacagaacagaagaattaattttattaagaaatccattaagtacattttctgaaaaaaaaaatccatagatgcaatcaatgattaccgtcaaaatcccatcaagtgttttgtagaaattgaaaactacattctaaaatttatatgaaaataaaggagacctaaaataggaaaaacaattgtgataaagaacaaagttggggagcttacactatctgatttcaagattaactataaatctatagtaatcaaattagagtgatacaggcatcagtggaatagagagtccagaaatataacttatatcatcaatgattttcacgaaagttgtcaatatgattcaatggggggaagaagaatctcttcaacaaatggtgctagaacaattggactttcatatgaaagaaagtgaacctggatcctagacctaaaagtaaaagctaaaactataaaacatctagaagaaaacaggtaaaaatcctccttgccttggagaaggcaaagatttcttaaataggacacaaagagtactagctataaaactaaaatattgtacctcattaaattcaaaagtctcttattaaattagtttcagtaaggaaatgaaaggtaagcacaaaccaggagaaaatatttgcaatacagttaagaactgtatagtgtctgagatttcaactgtatagagtctgagatttcaacttacaagctaagttagcctgttactatttcacagatgctggcagaaaacacaagactcctggattagagccaaaggacttcattatgcatgtgttgggtccctaacccacccagtcgcacggggacaatgcagggcccatggtgaatgcctgcacatgcagtggattgcatcataagagaagaacacaaagcttgggggattcaccatttttatagtgagcagtaataggcatgctcattgtgcagagagaggcaaaacctcgcctctccaggctactcactgcaaatgcaactcagaaaaatgggatgggtaaagagcaatcaaaccttgcattcttggcatagccagcaagtagatgtagggaaactcaggacccatggaagactgcctctcccaatgatacatttcataaaggactagtattcagaataaagaactcctataactcaatagtaataagacaaattaataaacagattaaaaacttcataacagaagatatgtgaatggccaataatcacatgaggacatgttcaagatcacctgtcagcagaggaattcaaattggaacaacaaatgagggagtgctacacagtccctatagtagtctcctagagtagtgagaatttgatactcctggaactcttctacactactggtggcatataaaatgatactatcaccctggaagatgtttgtttcttttaagttaaatatacattgcccatattactcagcaattgcagttactagagtagtgagaatttgatactcctggaactcttctacactactggtggacatataaaatgatactatcaccctggaagatgtttgtttcttttaagttaaatatacattgcccatattactcagcaattgcagttactagagtagtgagaatttgatactcctggaactcttctacactactggtggacatataaaatgatactatcaccctggaagatgtttgtttcttttaagttaaatatacattgcccatattactcagcaattgcagttaagtgttaagcaggaggaaaaaaatgaaaaaaatctacgatgtatggaatacctttattcttaatagttaaaatctgagaacaacccaagtattcatcaacaaattatagtataaccacacaatgaaatactatgcagcaataaaaagaattcactactgataaatgcaacaagacaaaggaatcaaaaaattatgctaggttgaagtagcccaaacaaaaagtacacagtggatggttctatttatatgaaaaaccaaaactaacctgtcaatcttttctctaggaccattacaattcaggcacagaagcagagctattaaatttggtgtgtttggctggaggataggattaaaaggaggcaacattttaaatagggcagcaagtagatttaaccaataaacactgggaaagacagactaaatccactagctaacgataattacttcagccatattgaactgtccaacttgaacaatttgttgcctcaaggattctgcattcccacctgagaatcctgcctctgacaccctccgcccttatccaaaccctcaccaccactactacaacccttacccaggcctactcctaaacattggttagacctgggctgagagtggcttcccacaaaaggcctctcgtgagccacgcaatgggtcccttcccccagtctatggattcatttttcataactcttactctgtattaaaataactttcattactacttattatttaaaggatatattgaacacctattgtgtgccaagtactgtttacatgatgcagacacaggagtgacgtaaaagtcaaagatgagtcctaggacttcagtctatgccaaaacatggtaccatctacttagatgggggagatagaataaagagagtgagtgataggggaaatagctatttaagagcctctagagaaaataatatcttttgttctaagaaaataacgcttgtgcggctaagcatggtagctcatgcctgtaattccggcaacttgggaggctggggcaggaagattgctagaggccaggagtttgaaaacatactgggcaacacagtgagaccccatctctacaaaaaacatttttcttaattaacccagcatggtggtgcatgccagtagatctagatactcaggagactgaggttggaagatcacttgagcccaggagtttgaggttgccatgagccatgatcgtgccactgcactccagcctaggcaacagagcaaaactgtgtctcaaaaaaagaaaagacagaaggaaagaaaatatcacttgtgcagagaccagaatgaagaggagaggacatgggaaagctgagaaaaagaacttctagcaaacagaagagaaaatacaaagccttgtggcaggaatgaacttggcatatttagaggacagtaagaagactcagtgaacacgacaagagttacagatgacaaggacagacagaaaaggcagggctccgatcctctaggcaggcagctgaaaaactacagcctgagtgtcaaatgtttttgtatgatcttggggctgagaataattttcacattttcaaatgcttgttaaaaagaagaggaagagaatgaagaggaggaggaggaggaagaagtgaagaaatcagaagcagcagcagcagcagatgcaactgagaccatatgtgacaaagtctaaaatatttactgtgtggacatttaagaaaaagtatgccatcccctgataggatcttataaaccatggtaaggactttaggttttattctgagtgggatggataagtattggagagttctgagcatagaaagtataagatgaaataaacattttttaaggatttttctatctactgtgtggcaacagacagaaacaacgtgaaacaaggaggtcagttagaagactactgcattgtctggtcaagagttgttggtagcctggcataagatgcagtgatggaaaacattagatgtcctcaatatgaaaataaattttcaatgtacagcagacaggaggctggtagtttagatataagaatgaaaaaagtaaactgtgaagatgatgtccaggtttttgttctcagcaagtaaatgaatactgtctactgatcactgtgaccttgaaaagacccgttttagtggtggattagggataagcctgatcacaaattcaagaagaaaagcaagaagaatggacaactcttaggagattttctgtaaaggggaaaaaagaactggggcagtggctagagggaatcctggggtataatttggggggagtgggaaaaaaatatatatatatggtaatgtttgcatgctgatgagaatgaccaagaaaaggaaacaaaactgatgacgcagggaggtaggtacaggctcagaaaaacaaacaagcagccaaacaaggtggctcacgcctgtaatcccaacactttgggaggctaagacgggtggatcatctgaggtcaggagttcgagaccagcctggccaacatgtcaaaaccctgtctctattaaaaatacaaaaattagccaggcgtggtggcacatgcctgtaatccaagctacttgggaggctgaggcaggacaattgcttgaacctgggaagcagaggttgcagtaagctaagatcacaccattgcactccagcctgggcaacaagaaactccgtctcaaaaaaaaacaagaaaacaaaaaccacttgagtagatgacagaggatgtgccctactatacaaggggagagactgaccttatacagctgcaaggaaagtttatcactgtaaaaagagcaaaagcagagtttaagggaacagattctggtaccttgtcagatctgatgattagaaagtgaggtatggcagttctattctgattacatcaacattctcagtgaaaaaagcagccatataatcaactaaaagtgagaacaccgagctgaaggtaggaaattgttttcaggaagtaaagaattgcaataaaaatggtcatgtggtaggatatcggagcactgttaagggcttgcttattaactgtggtcattcaaaaaacactagtcagtgtagcagctacctgcttcctcccagatgcatgctgtgctgaggtgcagatgcagaggagggggcaatttagtttaaccaagggcagggtttatatgaacgatgaggcaaacaaactgatggtatgtgtgagagtgaagatctgagggtgttaagtatataaggagagaagtaagggcatggcaggaacagggaggtgaggaacatgaaacatgtaaagtcaatgggtcagaattgccaatgggattgcaaaattcttaaagtgagggcactaagtaaataggaaagatagacagtgcacaggaaaggaagtctgtaaatcatatttagaagtggtattttactgtcccaggtgactgagattgggtgaaaaaacaaagttcactaggagtgataaagtcaagtaaatgagaaagtgggatgttggacagatcacatatgtgaataatgaaatcattagggatgatggaggtggtagtagcataaggaaaagcaatcaactaggtagcccagtcttcaaggtataagaagtctgtcatacatgccagcatctctgtgtgatgccatcttctccactagaatacaccctacagggcagtgtctgcatctgcctaattcatcactgtaacaccaattctttgcaaagtgaatggctttcagtgaatgaatgaagttataataaaatggaaggtatacatagactaaggttaaaataagaaaagagcaaaggcgggcggatcacctgaggtcaggagttcaagaccagcctggccaacatagtgaaaccccgtctctactaaaaatacaaaaattagccaggtttggtaggatccatctgtagtcccagctacttgggaggctgaggcaggagaatcacttgaacccgggaggcagagattgtagtgagctgagatcgcgccactgcactccagcctggtgacagagccagactccctcttaaaaaaaaaaaaaaaaaaaaagaaataataataagaaagaagaaaagtcacacacacctcttaaattaaagaaataggaaatagaccagagagactatttttcaacacaattaactaccttttattatattactatccaaacacaggtatagaaaaaaaggaaattgagggggaaaatattatattacaagaataatcagaaatactccttttaagaacagctcttgtatttcattttacataacttcaaaggaagagggaagtacggggaggaaggaaaggatactcacggctgcatatctttaagtccattagccatgaagatgaaaatacttagaaagccttatcccctgtggtatcaaaacatattagtgagataaggatgtctgcctgacatcacaaaaattagaaggatatttatccaacataatttttaaatctttttaaatcctttagcaaattttattctaaaataccaaatgcagcatagaaagaaaagtacatagattcctcttatcatattctttattaaatgtattctaaggtacaaaaagtaatataccctttcccataccatttctgttcgtctaaaactaaatgctctttcttttgctaggtaactattacaggtaatagtaaccctcccctttgacctgtcttgaaaagattactttgcccctacctaaatgactacatttcatctcagttcaggtgtaacacttattcagtgtatgttcactcactattctatctcattgtttgctttattcaatgtataagaatacattgaatttctagttaccagttgatttttgaaataactgaatggtttttatacaaccataaagaatctaccatttattaatgaccagatttttaaaataataaatgtaaaaaaaaactaaatctgatatatctacacactctgaaagaagatgatacagcataatgccaatatcaatcaggacaatgaccttctttatctgcctaatgaagtatctaacatatggtagttgcttaaagcaaaagtttgcctagaatacctgtgatatcaaaggagtcagaaattatattcttaaacactactccaatcactgtagactgttttccaactcactaaatgataccttatttctcccagatagtagcctataccaaaattccccatgcaacatcttcaactgctggtgatagcttaatctttaaatcacacttaaacctgtagagaaaaccagtattttttttaacatgaaggcccataatatatagcctctagagattaaaatattaagatatcagagaactgtaagaatagtttgaactttaatttttaagtgaagttagttactagattctagatccttctccataacatttactttgtaattttaagcaagtaaattacagaaaacagaaaactgttatctacataaagcctaaatagtgaaaaagcttacgttctcatagtgataagagagttaaatgcactcttgcctgggtatatgtatctatctctatgcctgtaggtttctatttaagtcaataaccattaattaactgcctcagtttttctttgattttgcaattgctgaattcccagtacctactcaggtgatgagacttgtgaagaagaatgagatgatatgaaatgtcaagactatttaaagaaatagtttgcactggtagggacaatattttaagagcagagcagagtcagtgcagtacaaaacaagggtaagcacagttgctgccaagagggtaattataatctaaattactatcatgcatattactattaaaatgcattgcgactatttccttgcatttttcaaatgatttcaagcatctctaatgtcaatgatcaacagaaacactaagctgtcactgctgtatgaataactcattttcagaacatatacaaacagatctccagtgccaataaaatctgttattcacagataattttatgcaaacacatagtagaaactatgaaagctgaagaatattgcagaaaggtgcattcaccaacaaaataaagtttagcaagggattcccttaaagagttacttggctttttaaaaaaacatttaatgagtatcattacgtgccaaaaactctgcctataatttggaagctggttttagagtacattaaaaagcttaaaattaccaactatattttacccaaaaaaaagataaagtacagaaaatatgctacttccccccttttcacttctaaaatatctctataaagaacaattatagtgatctaatactaattttagacaattagaaattaacttgacatagcagaagaaatttgacacacaacattctcttattatccatcaatatttaaccagcacgacctccaatctaatggaaaagctgtcctgcattggcccagtgccttcaataagagagttgattatttagactattttacatatttaagaagtgttgcttcaactgctgaatgcaatactccagtgttataacacttctacctgcttaccatgaccagaactgaagtattcttttagctcttaagcctcaaaaaggatatactatacagataacagtctaatgtttctcccatagccagagaatactaaacaaaccatgatggaccacataatggagtagcatgcaattataagaaaaaaagacaatatctctatgagctgataaaatcatatcctagaaagcatgtgtaactagaaaacatgccaaagaatatctacagtatattaccttatgtttatgaaagaaagaaatgaaaaaatacacatatctcttcatttgtgcaaaaagacacaggaaggaataaggaactaatacaatcgcataccttcggggtggatgggaatatggtagaaaagatgaggagagaaaatttccagagaagaaagggggatgagagactaagtgacaattttttgcatagttattttttgtaaagttctgacttttttagtatagtcctccttgtatagttctgacttttggaaatatgttaatgtttcatacacttgaaatgagaaatattaatatcagaaagagtggaaggaaatcctaaaaatccaaacacaagaaacctaattgtatttcaaatgaacaataatgtcagagaaataagagtatgaaaatatggaaggctagaatgaaccctgtaatgttagactctaactaaagattatcaacatgaacttgaggtttttgaatatatataaaatacatatattatctattatctattttatatgttatatataatctgctataatatattatctagctatatatatagaaaagagagagaggagagagaacgagcaatagagacagagaaaggagagttggagggatacagatacatagacatagatagatgaaaagaagaataaagatgggtatgtgtatacaaatatgtgttttctatacatggatctacatgtatttcatatacacacatactcatgtacatatacacatatcacatacatgtaaatatacacccatatgtacttgtgtatttttattttattttatttttcctagctctgtctataagggcctagaagatataccattaaaagacctagcatccagatcttgaattctaaataacattctccactaaaaggaactacaaggaacttggggtccttggagaaatgtctgactccaaggctgggtgtagaatagtaccagatgatcctggaagacagtgtacaagacaataggaagtattcaaagaatgatagggacaaaaaaggacaaaggaactagcttgaagagacttctattggccaaatctatctgggggagtgggaagagatagggagttactacttaaaccatatgaagtttccttttgggttgacaacaatgtgctggaactagatggtagtgctagttgcataacactgtaaagatattaaatgccactgaattgtgcaatttaaaatgataaattttatattatataaattttgcccaattaaaacaagtttttcattcctcctaagaacttgaacaaggcaaggatgctcactttcaccacttccattcaacaccgtactggaagtcctagccagagcaatcaggcaagagaaagaaataaagggcattaagaggaagtcaaactatctccgtttgttgatgatgtgatcttatagctagaaaaccctaaagacttctccaaaagactcctagatctaatcaatgaattcagtaaagcctcaggttacaaaatcaatgtacacaaatcagtagtactgctaaatgccaacaacaaccaagctgagaatcaaatcaagaactcaatcccttttaaaacagctacaaaaaaataaaataccaaggaatatacttaaccaaggagatgaaagatctctacagggagaacaagaaaacactgcttaaagaaatcacagatgacacaaatggaaataacatctcatgttccagaattggaagaatcaatatcatgaaaatgaccatactacctaaagcaatctacagattcaatgcaattcctatcgagataacaatcccattcttcacagaattagaaaaagcattcctaaaatttatatggaaccaaaaaagagcctgaatacccaaagcaatactgagcaaaaacaacaaatctgcaggcatcacgttatctgacttccaattatacgacagggatatagtaaccaaaacagcatggtattggtataaaaggagatacacagaccaagggaacagcatagagaacgcaggaataaagccaaatacttacaaccactgatcatcaacaaagcatacaaaaacataaattggagaaaggacaccttattcaataaatagtgctgagaaaatttgatagccacatgtagaagaataaaactggatccctatcactcacaatatataaaaattaacttaaaatagactaaagaattaatctaagacctgaaatcattaaaattctaaatgaaaacctaggaaaaactcttctggacattggccctggcaaataatttatgagtgagaccccaaaagcaaatgcaacaaaaaacaaaaaataaatggaacctaattaaacttaaaagcttctgcataacaaaagaaatcatcagtgtaaacagacaacctacaaaatgggagaaaatatatgcaaattatgcatctgacaaagaattaatatccagaatctaaaagtaactcaaatcagcaaaaaaaaaaaccagataattcctttaaaaagtgggcaaatgacatgaatagacatttctgacacttctcaaaagaagatataaatggacaaaaaaaatgaaaaattgctcatcaccaatcatcatggaaatgcaaattaaaaccataatgagatactgcattactcagctagaatgatcgttattaaaaagccaaaaaataacagatgttggcatggatgtggtgaaaagggaacatttatacactgctggtggggatttaaattagtacaaccttcatggaaaacagtagggagatttctcaaagaactaaaagcagatgtaccattcgatccagcagttccacaaatcactttatcagaaagacacctggacacgtatgtttatcacagcacaatctgcaattgcaaagacatggaatcaacctaactgcccaccaactggtgagtggataaagaaaatgtggtgtgttggtgtgtacacatgtgtatgtatatatatacacacatacacatacactgtaatactacttggctataaaaaaagaacaaaatcatatcttgcagcaacttggatggatctggaggccatgattctatgtaagtaactcaggaattgaaaatcaaatattgcatgttctcatttataagttggagctatgctatgtgtacacaaggcatacagcgtggtataataaatactggaggatgaaaaattaccttttgggtacaatgtacactacccaagtgacaagtgcatcaaatcccagacttcaccactatccaattcatacatgtaaccaaaaaccacttgtacccctaaagctgttgaaataaaattaaaattaaaaatattaattagattaaaaactgttaatatgtataaaaagtatgacttacatgttctatatatgtattagatgtccagtaaaaattttttaatggttaaaaaactaaaaaatacaatgttttaaaaaaatttataaaatagaaaaaaaaaactaatttgtagtgttagaagccaggagagaagcagtcttgaagaggagaaagggtagtgactgaaacatttgagtttatgggcattattctatttccacagctagatactgattacatgggtgtgtctactcattgataatttatcaagtggtatccttaagatttatggattttactgtatgaacgtaatcttaaaagtactaaacaactatttttaaatttacaaatgtttcatgctttatgctatttataaggtacattcaaatcaaattcttctgaaatccttaattcaggtttttaaacataccacttaaaatactttacatagattatcattatatgcttcctttctgaacaataaaattaaataaaaaggtcatatggtgtcacacaggaccacttgtttttattttggatcttcagtatacctctagtattggaaaatgtttactctcacctaaaaaacaaattgtgatttaaagatttaaaggcagctcaaagttggggggtgggggagctgattaaacaaacatggatgttctaatttgccagcctctatttgatggttcattgaaggatgaagatgtgttcagcacatctgaacggatagaaaaaatccactgatattcttagtcattggttcattatcgtctttactgtgttgattatgtttatgtaaaaagaaaagccacaacaaaacttcattgggcatttaccaacaaaaggggaggagggacaagaaaacaccagctgttccagtctttaaaattaggcaatttgttttccaatccctccaggtaatcgcacaattatttgcctccacagttcagagtactactttcaagtgtcactgttacatttacactttaagtctgtcttccttttttttcttttcttgatttttggaagaacaccaccttgcctcttcatatgtacaagctagcctataaatgtaatctgtttatattagtaaaaagctcaaaaacataaacagaacaaaatctaattcactttctagattattcttcatattaataatagtaccagctaaatacaggcaaaaaataaatagtagagaggataaaacaaaatctttggatcattggatcacaccccactacaatccattatgggagtttggtctccgatttcctcagtataaaatgctcacagtggttatggagtggaagaagctgcaaaattgaaatatactgggaaaatgcctgcattgttgtcacaataagcaaatattctcttttatgattaacagtttttaaagctgtgcagtttatagagtaaagcaaaagaagaaagtactcacccatagtttgcagggtagggtaagggaacaacttgatcaaatgaatagatcaaaatgagaagcaactaaagtccaaccaaaagagttgtgttgttcatttgcttatacttcatcctctttgtaactaactggatagattgtctcatacgccttttatatttcccagaatcctgggcactattatgttctaaacagaaaatgtataaatacttcttaaataaaagagagggtaaaaaggataatagacctaaatttactcaactaccatgctcctaagaaaattcacaaacatgaaaatttaaaattttaataatatacaaaattatatctagtgattttataaattcataatttctaggatgttctgtaaaaacccagctatccacctaaaagatacattcaaataaccatgtaagtatctattatatactgttataataaccactgaaactcagaaataagaaaattctgcccatgaggtgctcatcattagctgagtaagaacatctaaacagttaaaaagtaagggatcctgtatatgaacctagtctctgggagcagaagggaagatgtcccaattgttgcctagaaggtcaggaaagcttcccagcagagatcctacaagaaccaggtcttaaaagaccaggattggaaagcagaataacaaaagcactatgggccacggcagagtcaggtggaagagctggtgtgttttaggagctagatgtccacatttacaggttttataggaagggagagaatagaagcacaaaacacacagaaacaagaaagtgaaatgtgcctacctcatactaaggaaaggagaccttaacccatggacaataggatggaactgcaaaactgattggaaatgaagttacaaaaagctgtatgttagaaatacattcaagcaacagtgaggaagactgagacatgagcctctccagaggcttagaaggttacagagacaaagaggcacgttcaggtggacatgaataaatacatcttctcagttctaccataacatttaaaaaaaaaaaaatcaagaaagaaacagctggaaaaaattgctacatttgatcacaaaacatgcccctccccccacacacacctcccacccccacatgtaagaaggaaactaaacacatctgacttcaaggaacttaaaagacaaaatacagggagaattgtttttcctcttaatagacgctaagcaaaggagcgtctctcaaacaatctaactcttctcaaaaatattcaattttctactatctaaaaaaagtaaaaattttccaaaacctacctttccaacctcatatcccactattctctttcgtaagagccttaactccggggggtgagggggagaacaactttccaatccagctatgcacaccatggttttccctatacaaacatctttactgcctacagcctcctacacaaccccacctccaaatgttcaaatcctatctgctccttcccaacaaaacctcttctaaccccctcggcaggagatagtgctgaccctcaaattcccaccttaggtttatttcccctattttatcttaattacttctaccttgtttcagtgacatatttagacattttatgactacaagattaaagactccttgagagaaagataaatgttgggtttatctttacctgcatctcagaaaacaggaactcaaaaaacattttaaaaaatttttgtaatccttgattaaaaccatattggggctactggttaaaacaagatacttacatccatttatccattctacatttgctggacatctattatatacaagcagtgttttacatgttaaaaatacaaaaatgaacaaaacctgcaaaattcctgttgagctctggaaatacatgcttgggaattttaccaatttactgggtaattctttccagagtagtttttttacgattactacttaaaccagtgtttctgtatactatttccttccaattacctttaaacctttacattctgacatctaccaagcacaacccctcatgaacatcatgaatgaataaggatatctgtgccagtagaaaaggtgaacatgtcagattcttaagttctgtggtactgtgaaggaacttgaacaaaaatacaggcatacctcagagatattgcaggatcagttacagaccatgataataaagcagatagatattacaaaaagtgagtcacgtgaactttttggtttcccagtacacagaaaagttatgtttacactatattgcagtctatcaagtgagcaacagcattaggtcttaaaacaacatacataattttaaaatattttgctgcctaaaaatggtaacgatcatctgagccttcagcaagtcctatttttgctggtgaagggtcttgccctcaatgttgatggcagctgagtgatcagcgtggttgttgctgatgattaaggtagctgtggcaatttcttaaaatcagacaacaatgaagtctactgcatcaattgactcttcctttcatgaaagatttttctgtagcatgcaatgctacttgatagcattttactttcaaacttctttcaaaattggagtcaatcatcacaaatgctactttatcaactaagcttatggaagattctgaatcatttattgtcatttgaacaatgtttataacatcttcaccagaagtagtttccgtttcaataaaccattttctttgcccatccataagaagtaactcctcatttgttgagctttatcataacattgcagaaattgtcacatcttcaggctccacctctaattctagatctcttgctgtttacaccacatctgcagttattcctccactaaagtgttgaacccctcaaagtcatcaatgagggttgaagtcaacttcttcaaaactcatgttaatgttcatagatagacctccccccatgaatcacaaatgttcttgatggcatctagaatggtgaatcctatccagaaggttttccatgagaggagtcactatctatggcagctccagccttgagaaatgtatttctttcttaagacttgaaagttgaaatgactccttgatccatgggatgcagaatggatgttgtgttcacatgcataaaaacattactctcctggccaggcacagtggctaacgcctgtaatcacagcactttgggaggccgagacaagtggatcacctgaggtcaggagttcgagaccagcctggccaacaaggtgaaaccctgtctctactaaaaaatacacaaaattagccaggcatggtggcacgcacctgtgatcccagctactcgagaggctgaggcaggataatcacttgaacccaggaggcggaggttgcagtgagccaagatcgcaccattgcactccagcctgagcaataagagcaaacccccaactcaaaaaaaaaagacattactctccttatacctcttcatcagaactcttggatgactaaatgcactgtcaatgaacagaaatatttttttaaagaatattttttctgaatagtaggtctcaacaagcgggcttaaaatgttcagtaaaccatgctataaacagatgcactgccatccagcatttgttgttccatttctggagtgcaggcagagaagatttagcatcattcctaagggccctaggatttttggaatggtaattgagcattggtttcaactttaagttatcagctgcattagccccaacaaaggagtcagcctgtcttttgaagcattaaagaaagacattgacttatctgtagctgtgaaactcctagatggcatctttttcaaatataaggctttttcatctatattgaaaatctgttgtttagtgtagccaccctcatcaatgatcttagttacaccttctggataacttgctgcagctgctacatcagcatttgctgcttgtgtcaccttgcacttttatactatgaaggtagtttctttccttaaatctcatgaaccaacctctgctaggttccaacttttcttctgcagcttcctcacctctctcagccttcataaaactgaagagagttagggccttgctctggaataggctctggattaagagaatgttgtagctagtttgatcttccatctgaaccactcaaaactttctctatgtcaacaataagattgttttgctttcttatcattcacatgttcactggagtagcacttttaattccctttagaatttttcctttgcattcacaacttggctgtttggcataagaggcttttggcctatctcagcgagttgacacaccttcctcactaagcttaatcatttttagcttttgatttaaaatgagagacttgggattcttcctttcactgaacacttagaagtcattgtagggttattaacttccttaattttaacattgctgtgcttcagggaatagggaggcccaaggagaggaagagaaacagaaaagagctggtcaatggagcagtcacaacacttattaacttcactttctaacatgggtgtggtttgtggcaccttaaaacaattacaaaagtaacatcaaagatcactgatcacagatcagcataacagatatacaaacaaataatggaaaagtttgaaatattgcaagaactaccaaataccaaaatgtgacacagaaatatgaagtaaacacatgctgttggaaaaatggcatcaataggtttgctcaatgcagggtttccacagtcctttaatttattaaaaaaaaaaaaaaaaaaaaaagcagcatctgcaaagaccaataaagcaaggcataataaaacaaggtacacctatattaataatagtaaaactacaactattataatacaactattataatttcttctgttcccaaatctgatcttatgttgcacttactgattgtttgactcccctaataaaatgtaagctacattagggtagggacatgatcaactttgctcatcatagtattcctactgcctagtaacagtgcctgaaacacagcaatatttgtcaaaagaaaaatgaatgaacaagggagagagagatgaaacaattccactaatttaagagatacactgctgttacagtatctcaaactaaagttcatgacttggagacatgacccatgtcaactcatcaacaaatttccatttctggagttgatctttaaaaaattttcccaagttcccagaatagtttataaatatgctatcttccaggccaactactaaaataactactaacaggagagaaaagcacaccaatcacagctttgagcaacaaaaaactggtgggggtgggtaggtaattaagtatgtttctaattttgaatggaaaatcaaggagaaaatacagtggccctgaaaagccattatttaatcattgttttggatgatatatttcagaatgattaatattcatgatgatctgcagaaacctacacatttcctacaaatcatatatatcaaaataaaatgtcatttttaataaatcatttcttcagaaacaagacaagaaaattcaagaaaatagtataactttcatagaagtataatttttaagtgtcatttgcactcaataacatgaatcataagcaataagccattcattaaacatgaaagtaaattggtttatccttgaaatactaccaccctcaaatctagtagtggaagtgcagtaattcacacttgcattaatggattaatttttttaataataatcaatacaacaataaaatttttaagtgagaaaaatatcctatatattataaatgttatatctaatttctgatgaaacaattacatcacaaattacagaatgtaacactcaccttcatgaattaatttgtatagtcaccatatcacaggtcatgattcatacttaaatacagtggtgttgctggtaaatgtttaacaaccatttctcagtaacgcaaaaacagtctaatattgtttgccaatctatgtgatgtaaatactcccagatggctgattacaagcaaccagtgcaatgtcactgaatgcaaaggagaaagtgaatctagaccaccactgaaggatatattgtgctagactaatttgtgtttgagatatactgtagttataaatcacttttattcatcaataacttattgttcatatgctacattccaggctgagattaaaaattacataatccctgccctcaatgaaattagaattcttgtgaaaatcagaaatggcacatgccatatgaattttaaactgcttaaaaatctaaaacagatatttattttttccatcttaaattggcaacagcttacattcattttagattgctcaatcatcaatctgatttcatacatatctcaatatcatcaagttaaccaaaatgtatcaaagtgacactgaattacagatctttcctaaaaggaactatatgtttatggaagtatataattggtattcgaaattatatttttcaaaaattattttcttgcctgggtgaggtggctcacgcctataatcccagcactttgggaggctgagaccagaggattgcttgactccaggagttcaagaccagcctgggcaacaaaatgagacccccatctctacaaaaaataaaaatgaaacattaggcaggcatggtggcatatgcctgtagtcccagctactctggaggctaaggtgaaaggattgcttgagcatgaggaattgaggctgcagtaagccatgatcacgccactgcactccagcctgagcgacagtgtgagaccctatatcaaaaaaaaaaaagaaagaaaattattttctcactgaaagtcactctatttacatcttccaatgcatttactcaaccaacatttattaagtcaaatatatacaggcctggtatatatacatattggataaataggcataaacatatctctttatccaaccaacatctattaaatgccagatacagccatggatatatacagatagccgaccccttgctaggatgaggagatacaattagacttagatatgccattacctcaagctaatttccttcacagtaagtctatctgccatcttcaaactatgcctggagatttattttaatgtttctccacttctttagtttgaaaagtggactgtaaatatggcattctgaaatcctttagtcataattcctgagagtaaccaaatctatattacccttttaatatggttttctaaacaattttttaactcttctttaatttgattgtgtatatttatctgatttttttcataaatccatagcaacacacttttttgcctagcttttctatctccttcccgtaataaagtaatccatgtaaaaagcctggtatatatacgcttctgtattttaatccctacagataaaatcctatataggtgtgtgcatgcacccacacacatatacacatagagaataattccattatttcttaatagaatcatcttatatgattttctgcagatttgcttttctcattgttcacctcatggaaattcctcaagttatctggtattattcaaattcattctttttaatatgggcatattgcttcataacatgaatagtcttaattcacttcaccatctccttttgtttccaattgtttaacagcagtgaataaaactgtagaaaacacatctttgtgcatatgtgctcatctattggtgctttcatttctacaccatagagttccaggagtggattcttgggtcaatgagaatgcatattttcttttttcatagacatttcagataacttaaccaaaaatgctatattacatcacagttccaccagccatgtatgaaggtattttttctccactagaaaagtaaagatactggtaggtataaagttactttaatttggatatccatactgtcagtctttacagatgtacttacttatttgaatttgttcttccattgacttttcagatccttagcccatttttctttgtctttttttttattccaacatttattttaggttcaagggatacatgtgcaggtttgttacttggataaactgcatatcatggggtttgatgtacagattattttgccacccaggcaatgagcatactacctgatagtctttcaatcctcaccctcctcccaccctccaccctcaagtaggctccagtgtctattgttcccttcttcatgtccatgtgtattcaatgtttagcttctgcttataaatgcagtatttagttttctgttcctgcatcactttgcttaggataatggcctctggttccatccacgttgctgcaaagatcatgatttcattcttttttatgcctgtgtagtattccatggtgtatacgtaccacatttgctttatgcagttcactgtggatgggtatttaggttaattccatgtctttgatattgtgaaaagtgctgcaatgaacatgtgcgtgcatgtgtctttatgggagatttatattcctttgggtatatactcagtaatgggattgctggactgaatggtggttgtttttaggtctttaaggaaacaccatactgttttcaacaatggttgaactaattcacactctaaccaacagtgtataagcattcatttttcttcacaacctcgccagcaccagttattttttgactttttaataacagccattccgactggtgtgagatggtatctcattgtggtttagctttgtatttctctaatgattagtgatattgagcacttttcatatgcttgttgattatttgtatgccttcttttgaaaagggtctgctcgtgtcctttgcccattttttaatggggttgttttttgcttgttgattcaagttccttatagattctggatatcagacctttgttggatgcatagtttgcaaatattttctctcattctgtaggttgtctgtttactctcttgatggtttcttttgctgtgagggtgctctttagtttaagtaggtcccaaatgtcaatttttggttttgttgcaattgcttttggagtctccatcgtaaaatatttgccaggtcctatgtccaaaatagtgtttcctaggttttcttctaagggtttttgtagttttaggttttacatttaagtctttaaccatcttgagttgatttttgtatatggtgtaaggaaggggtcagtttcaatcttctgcatatggctagccagtcatcccagcaccattaattaaatagggagtcctttccctacggctcgttattgtcaactttgtcaaagatcagatggttacaggtgtatggctttatttctcatttctctaacttgttccattggtctatatgtctgtttttgtacaaataccatgctgttttggttactgtagccttgtagtatagtttgaagtcgggtagtgaaatgcctctggctttgttctttttgcttaggattgtcttggctattcaagctcttttttggctcacagaatttatagaatacatttttttttctaattctgtgaaaaatattcttggtagcttgataggaatagcactgaatcttcaaattgctttgggcagtatggccattttaacaatattgattcttcctattcacgagcatgggatatgtttccatttgtttgtgttgtctctaatttatctcagcaatgttttgtaattttctttgtagagtttgttcatgtctcagttagctgcattcctaagtattttattccttttgtggctactgtaaatgggattgcattcttgatttggcttttctgttggattttttttttttttttgctctttttttctagccaagtcctaaaagcccactgcagggtattgctagcagctctttgtaaaaatcattagaaatatttcttaccagatctattatttgtcttttgcctgtgcttaatttgacataaaaacagttttagggtttaaaaaaaaaagttgatcatgtctatgttttattttagtttcaagttttcagtttttggagaaaactgttctgcagtctgcaaaaaggacatcaacatccagaaagaggccaagggaagaagggagaaaatgccctggcatcggacttcattctggtgtcattccaaccttaccccttcccttccagatattcaagccaataaaatttccctttttgctcaaattatctcaagttaggcttctgtcactgacaacaaaaagaaatctgactaacactgccatatacttacccaactgaattgttgagtttgatacactgcggctttatgtcagtactagaaaattggtattatataaattattttccattttcactacccatgtcagtattcctaagtctccacatgtttatacaaagaacatatcattacatggtttattttgagagaaatggaattgaattatttcttcatgtacaatagctaaagcttttgaaattgatgtataattgacattattatttaaattattcctaagaaccacagtaataatacatttagaatttccatttgacaaatgtttctttttcttaaacatgcaaaatttttattctcacttccactcacccaaaagttatggatacaatggctaatacttaatttcagaaaatacttcccattttacgtgtttattctctagccttaaccttaacctcagagtcattattgtgttatttacagattgagattgttctgacctatttgtagccaaggagaagttgaccccaaagtttccatttctcttttatcatcttccttttctgattgctgtactcctctcccatcaggacagacaatagcagtctgcattgcattcctcagagttctaggattcagaactgactgtaagagagttgaccgtggcttctaagtcccactatcctttttcaaacagaatagcttcatatttatccttcagatatagtggggagggaggactgtgtaagactccatttttacagaaaggtttcctgcactaaacagaatttaagaaccattattctgcattattatttgtttatattttccaatctcaaatgggccctcaaggtagctttcagatatttttatcatatcccatttccttcaatgcttcttccaaacctatgagcccttctcaaaactatcctgaaatctgctccactctgaacacataactttgccccttacttcactgagaatagtgaagctacatagtatgaactggttcaaacttcttctttgtcaaggaaacaagttttcttctatctatacttgatccctctgcccagagaaatatgtgtgattccttatttttaaaacttttaaccctaaatctaatctaatcaatctaatctaatcaatctaatcccaatacctatttgcctcttttatcttcaatctctttctccctagtgactccttttctacaaacctttcaaccactcaccctctcacccaaacctcccccaattctgcttcccatcaggctactaattcatccctcactgctaatcaccaaacatctgagcagtgtggggcacattcgccaacccccttcctcactagacactcaattcagaaggctccatagatttggttaccttccacatgggccctctcccacggtagctcttacaaatgaccatcaggaacctcataatctacaagtctcttctcgatgcgcatctgccaatctcctgaagcaagatactttgtgttttcctacctgaactgccctcttcctagactatctcatctaattcttctctacctctctccactgtacctatagatgtagatatgcttgtagcagctggtcgttgtcctttcatgagtttctcctcctctacccacttaacagacattttcactatcactccatcttttctctcttcttgctaagttaacttcattgataagctttcatacatgcctttacacacatgcacaagaaaaccaatctatagcaggccataactaattttattaatttcaggggaaaatgtgtattccttgctcttctctatcagacttaaactttcatatatatgaacattaaaattttccttgaaatggaaaattggatagtaccaagaaacactagattacaaatgtatctttatcaaaatatacctcatactgcttactataagttatagttactaaaggtctctaacaaatctcagaataaaaagttgaaacacaatccagacattattgaaaaaaaggagaaataatatcagaaataaggctgacacttaaaagataactaaagaatgcacctatgtttagtactgctagatgctttaacaaatatatctgccagcctacacacataaagtaatattcatttattcttcacaacaaccatttgaggttggtgtcttcaatctcattttcaaggactaaaaataaagtaaccaaaaatattaacaatagttacctctgggggagaaattatggatggcttgcattttgttttgtgtattttctacaatgataatatattacttttgaaaagttgtgttatgatgaaaatataggccgggcacagtggctcacacctgtaatcccaacgctttgggagggtgaggcaggcagatcacctgaagtcaggagttcaagaccaggctggtagacatggcaaaaccccatctctactataaatacaaaaattagccgggcgtggtggcaggtgcctgtaatctcagctactcaggaggccgaggcagaagaatcacttgaacccagcaggtggaggttgcagtgagccgaggcggcgccactgcactccagcctgggcaacagagcgggatgttgtctcaaaaaaaaaaaaaagatgaaaataccaagttttcaactgaatccttttggaagcaagaattataactgggtggcatttcctagtaaatgaaggaatgaaagaactttgcaaaatggaaagtaacttagatgttatcaaatctagtcctctaattttttagattaaaagcaatccgtttatgtaacattaaataaactctcagatggacaatacataaattcttcaaatataaaatcatacttttcatatattttaatgtagtaacatacctcctttatgaggtaaatatcccagctgcctctatttttcatttatggtgatatttatggcatccagcattgtaacacataggtaaatgcttaataaacactatttgacaatgatcacaaactgaacacttaaattattcacagatttacccagatgtttccaagactttaagttctgtaaataaaagttactaaatgagtgccaatttactacaagaatataaaatgaatttttgtgctattccaagtcacatttaaaagctttgcaaacagcatgctattagctctgctgatttgtttttatttttcctaattgaaatgtggtccatgttatcaggccatctgcactgtggcaaaatgacctggtaaacaagacaaaaatggtgttctctgttaggaacaatatcagattctgtttctgctaagaaaacattattctaaagggatattttctggtactaatgctgaaaactttgataaaggaggccacagtaggagatgcttgttgcagtgcttaggttgcctgctaagatgctgacgacaatccagggtctctcccattaactccaataagtcagagtactgcattttcaacactgtcctggcaataattcagcactttagcacatacttagggcccatatatcacattgtactcctcttacctgcttatacattttgtctctactaaactgtgagctctctgaagtgctatagaccttatcttattcacattaactaccccaagtttcttgcatttaacagaagaaagactggattattttaggctaaaatcaaggagcagtcatttatgcaatggtttacatctcaccactccagaagattgacgtgatccgagggatggctgcccttcctattcctctagctctttataccacattatcctttgtgtgtgtgtgtcaaaaaatactatcctgagatatgcaaaaataccacaataaaaagtcacccataatctcactactcttttttaagtacacaaggaaatgaaagttcttgccccagtttctccagccctagtgcaagataatcactgcaaatgcttttacaagtttggttagaatccatcaagggttttcctttacatgggcagatatgcacagacacccactcattcacagtataaactcacaatgtctttaaacaaaaattggttcatactatacatatgcttttttttttaaatattgggtaactttctaagtcagatctaagtcattggttttaacagctgtattatccatcaactgcatgactgtactataaattacttaatcatgtctctattgataaatattttggttttaaatttcctgacatttcacacagtgctgcaagaacatgctggtacacagatctttatatgttcaagctattcttataaaataggttcaaaatagtggaaccattacatcagtagggtatacaagtttttattttgatagatactgacaaattatactagcaatagtttgcattgatatatatttctatactctcaccaaacatttactgtcaaaaatctttagtttttctattatgacagacaaaaaatgctctccatacctattttaatttacatattgaaattgaacgtcttttcatgtggatgtatgacattcattatttttcttgggcaaattgcctattgacatgaaataaacttcttcctattgggttgttcatctttttcttaatgatttgtaggtgttctttacacattattgatacatagcaaacgttttcttccagctttttatttcttctaactttgcttgctccctctctctctctccttcgctacccatacaaaagtttttagttgtattagcaaatgtagccatcttttttcccttatgacttctggattttaacctgctcaatagcactctctcacttgaagattaattttggtaatatcatctcaggatgatagtgtaattttcagataacttatctagcctcataaagtaagtttttctttctcaagagacagaaaatattaaaacctcagtcttaattatgttaaagtttctcccctttctcagtgtgaacctcactcaaagaaatctatagtgatgaacggggctgcagatcttcaccattttcccaccttgtacttccattccaccatgccaacttttcaggtttcctccattaccttcagggctggagacagtggggaggaaagagaaacagatgcagaaaactgctataatcaagcatcactgttatactctggtgccacggtcctccagatgtagctgatatccaagtgttgaccgtatcttccatggaatgcatatgtgcattactcagacagtaaagaaatactactaaagaaatagcagtccaccctgcataaactgtccctattgggggtcactgcacatgcagggggtccccttgggacaaaattcctcctaagacaagtcacagtcaatgccttctgaaagatccacatctgaccaatgttttggcacaagtccagcttgttccaaccataagtctaatcctttttctttgctctgccaccaaagcagctcgaatagcctcttgcctttagaacctagcagagtgaacacagtaagtttccaatctgggtctccaaactggaagggatacacatcaacctctgagtgcttctctcaaatgcccactcatttggctccagtccctcacaaggggtcagaaataatatcacagcattccgacacctctctctccgaagaaaccccctctgtcgatcttccatttcttaaattactgtgaaccttatcttgtatagtttcaaagtagatgacaggctaatggtagcacaataggctctgcagtctcttttcatggctgtgttgtttcagcacctgatatcctcagcccctgggcttctgtcaaaacgttgacataacaggaaagtcatatttaatttttctgttatagaaatcttagttttactgttattaaattcctatataggctgttcaaaaatcaaaacaaccttaatattagagataaatgcctcatctttggtaggatttttatttctttcctcataatgtcttatactttctaaattttctgcaacaatgaatcacttctgaaagaagaaaaaaagactgttaaaactgttgtattttaaatacctttatttggcacattacccactggtcacaatcttaacttggattttgccactaatcttaaataagcattatacaaaagtaattatttaaagacattttattcactcatttatcttgttacttatttattgggcattaaaatgatatctgaattctgatcatatatcagaagtattacttctatagcactgttaatgtgagaagtatatataaatcatacacctttttcacataagtagacaaaacaaagcaataaaatagtaacaaattatttcacactaaagactgcttcattaagagatactctattcttttaagttgtatctttgattttaataattttaaatttgagtatatgaataaatgaatgatacttggaatgttacttgattactaaacaagttatcttagaatttctaatcattttattttgattactgaaacaacctttgtgtcctaaaaaaaaaatcctcaaaaatgacagggggaaatgcgtaaagatcacgagctataaaatctaaatagtgcaaaaataaaatgagaacactagttctcatctaacttctctaaaacataaccagacaagaagtatactttaggagagatacattttgccaactataagatattcccaaatcttaaattataattaacttcagattaaattaaggaaaatcaaaatatgagataatatgagcctcccagtaaaatgacccaggagattacacgcacacacagttgcaccaatatcagaataaaattaatttatgacctcaaaataaaacaaatttattttagttgccataagaaagtatgactttatcaatttcagagtactctaagagaagtgaatatgtgttacaggaggaggcagtctgcatggtacctgcaaacatgtccagagacctaaagtgctgcaaaataccactgcaactccccaggaaagggagtattcagacacataaacacaattatctagtttttgctgcagcaagatttctctgccttcgtggagcttctagtttatcacattaaagaaagcacatgatgctgggtgcacgcacagtggcaggatcttagtctaaatatacgccccattatctccacagtggatcatccaacaaaccaagtaagcaactctctatcatttggcttcctgtgtagactagcctataaggagagaagagactacaagagtcttcttaagaataatatttctgattgtaaattactaaagtgacatttggatttttaaacatcagtctccattaaaacagattgtatacctgctcatgaaatgaaaactgagtctttgtatgttgaccaatcaagtttgtgagcctccaagatccccatcaatgtgaataatgaagaattcacaaaagtaatactcttttaaggatttattttgcctaaatgacacattacctcagtacatgtcttttcctccaagtgcaacacaaaaagggagaaccaaagcatattatatctcactcagtgccctcaactactaactcaataggcaaaaagggtggcaatgctgaagtcaaaacagcaaattcaaactgaatagttaaatgtgactaaagagagaacaggagctggtttgtggtataagaagggcggaactagtacaggcaaggcaagaacaaaaaaagacttgaagtgggcaaggtggaggtcagaatgaactttggagaagtataatggttactgcatgtttgcacatgatcccagaacatccctgagggaatatggttaagttcagttatacaggaaagaatagaatgggtcattcaaagttaaaattcaggagtagaaatggagataatttttagaagaaaactaataaaaggaattatgtcatgaatctaacatacctaaaatatgataaaaattaaagagagaccaaactgatttaagaggcaaaattttcagatgaaatattaatacattattttatttatattttcaattcatatatatttgaaataaaatctatattacatataaaataacaaatatgaggtatagacaaatacatatatattagcttagtaacatataatcaactttttaaaaatcaatggggtgagagacctaaaatttttggatactactagacctaaaatacaggtgttaaactgggaggttctactaaccttctagatatagaaagaacttacatgaatgaagccaggattagaaaagcagggctaagagatacagaaagaaccgatccttaggtcatttgagaacccagatctatgcgtgctggaagccaataccaggcttctcagatgcacgagccaatatgctctgtttttgattcagtttgaattcagtaggtcatttctgacagaaaaaagggcagaaaagttaactgagggaaaaataaaacaagttatagaaaaatatatttctatgaccccattggggaaagggcagaaaacaaagttcaccagaaaaaataaagcatgatttatttaagattccagagatagatgttcaatattaggctttccattattttataatacatagtaagcaatagatgctcaaagcatactgaaggctacacatctacttccataaattgaattctgtgaataccaagagttgactttttgtacccctgtttatgaactgttctgtgttcattaatgtaatcatatatgagaattaaaagaaagaatattattagggcttaagaaagacaaggttagggtaagttgcttaaaaaaacttatcttaaaaattaggtataggtttaagataacaaaaaaatcacattataaataccatatacatctcctataagtctaaacttagattgctttacgagtataaattattggtctactcaaaacatacacaaaaatggttatcacagatgatgtcttatgggcatgtcttatgtgggaaaaaaaaagtaagagccactcctactcaaagaaaagggtttggctcaatatctaaagacaggttgtgaatacatacttgtatatttcatgtgcgggaaaaatattatatgtgttattttttcttatacccagttttattaactttttattcaactttttattacaaatatgaatcagatttaagaagccttcaactgtaacatttattttctcaggctcattttacactttacttgaacttggattagaagacttgaactgttaagactttaaacctagcccctattccaaactttcccacacaaaaacccctaaattttataatttagttaaccgagtcctagagaaaaataatgaattttctgaaaccacaaagttagaagcaacaaagctagattcttaactccaggaaacaaagtatagttttaagggctaaataagttattataaaatattgaagaacacagctttaatttttaccatctagaaaaaatatattgtattttgttcctatttaaaaatcattaatgttgttacccttcaaacaatatttcagtgattttcttagtatttaaaaacagtagcaaaatacaattactcaccatttttctactttattttactactctatatataataaagccctaatgtccgtaacattctacaatgtgttatagaaattgatgagtttaattacttaatgtgcacagatcaattagaaataaattgaaaatgaacatactgtacactctacttaatctcgttatagtttggtttcagaattcactttctaatttgaaacccagtatgttacattttaaaataataattagaaaacttttacatttcagctaaaataaagcaaaagaaattaaggtaggtaaagtttgattagtcaagaaatctgaactcaagggtaaaaaagatcctatgctcctataatctaagccaatacgtttgacttgtcatactcattttttttcttaaaaatggaatgaaataacattacattttctgtctataggataatttttaaatgaattataggcacaaaaggtagacaaactaatcagcagacaaatgaattaacaaaggaaataatcattcagtgtcaactctatatacttaagacaaataatacacatttatccaaagtaatacaagtatctgcacaaggggtcacacatcacttttcacattactgagccattttaaaacagaaggtgataaaaactcttagatgcctatgaactcaatttacatggagtacatcactatgcttttttaaaatgcgctcatattcaaatctgagaaacatgattctgagctcatcaggcctgcttaattgcactaacatctgcaatcaatttaaattctttaagatagtctttcacagtgcttgaagtgatttcctgctgtgatagatttaacacactcactaatttatagacatatacaagcagatgagacctatttttccaggggtggggtatagtactgaagggcagtctgaatttcccaactatcaatgggattcagaaagggatgcatcctgcataactttgaaactacataaggaaatgataacactgcataagcatagcatagaaattaaacttaaaactatttgtaggtcatggaccattaagaggtttaatgaaagtttatggatgaaataacagcaaaaccaagagctaacagctaaaagttacatagaaaaatgtcattattttctaccctaatagttagggcagcgggggtgctaataaccctgaattgttttttaaccaaagacataaattggcatagaataaagaaaagaatatgagattcaaaatcagagactagaggagctaggcagatggcagcagcaatacagttttgaaaactccctgatctcccacaaaaaaagacaaaataactaagtagcaaaatcaaacacccaacaatattgagtgacaaagtaccttctcaacaatcctcaaactacaggaggttgaagacaaaccaccaacagccacaaatccgcacagtagcaatacgtgtatgggaagaaccaaaggaaggcaacagagtagctaatgaacatgaaaacaagataactccaaaatggcccagagatatccattggacatctcagtagaccaatttgaaagcagcagttggaactggaaggagtatgagtgactacaagaggcccagaaaagatctgaaggggctggagcactcaatgtcccatgagttgccagagctccttccagaacaggatcctacattgaagagaaagtgctgaaagtgaaatcaaaattgagcagaaaattcctgtaaaagatgaaagacacctcaaagacaaacctataaatcaaattgtaacttacaatttcaaagtgagctaacagacattaagagaatatataagacatgaaaaaaatatttaaagtggactaagacacactcaaaaatgcagtgagggaattcaagaaaaaaatagaaataaaaaaatcatttcagaaataaaaactaacaaggaacacaagaataaacataatgtcataagagaatgcagacatgaaaaaaataaaatgtttaaaacctaaatagaaataaagaataagataaaaagcatttgggagaagacggcatattaaagatagacaaaaatccaacatacagataacagaatccatgaaaaagaaaaccaaagcaaaaaattagaacacatcagtgaaaaaaaaagaaatttaagaaaaaaagaaaaagagcatactgcatacttgataatcctaactcagatatcccagagaaagaaagacattaatttataactaaaagttagttatcagctgaccttttgacaacaatgccattaagctttttgctagaaaaaaaaatagtattattcaagatcctatagtattattcaagatcctaagcaaaaaaacgtgtgagccaagcattttatatccaacaaagctgactaaacaataaagggcatatactattaccaacatgcaaaactcaggaaatactgtttccatgagtccttcagaggaatctactaaagaagaaacttcagacaaacaaaaagtctgcagaaataacataaggaccatggtgagcattcaaatatagttactaaatgaggttaaaactaaatgagaactaaaaggaagagtgtgaaatgtaatggctatatgcttagtcaatgtcgacatagtaggacaaaaatagcagttggagacagaacatatgcaaaataaaaactttttacatacacatccacacacgcttttttagttttctatttctccactaaaaacagtaattaaacaaaaagaacagtaagtatccttggccctcagcttgtaaactttgaaatatcgttccccaccctaaaggaaagagtcaactgataccaggtctagcgggctaaatattctagaggaggagcttgatcatcagatcaaaatgactaggagccaactagacaagtcccaatggccaaagatgggacaatttgatcttcactaaaaataattgtaacacatcaatttttaatgatattaaaaatgattgatcatcttcagagaatgatagagaatgaaatcaatatattgaaagctggcaaataaaggaaaagaatcaagcatttatcctaaatttcctatatcactggctaaccaaacagtatttgagagatgtctctttgtaaaagtatcccaataaatgaaaatgaaattatagaattctaactgcaaactagatattaatgaaagaatataatacttcttatgatcttggtaaagagatgaaacctgagtctgatcatgcctctagatctagctgtctctgtgcaggaaatacagaggataggaaaacacgttaactttaccacaaatacacacatcagcaaaattcagaatgtcctggataaaataactgaagattaaacaagacatagagataatccaaattttaaaatataagcaacagtagtgcatttgtggcccccatggatctatcacttgcttcaacagtgattggacagaatagaccaagggactccctctcaaaaaaaaattttaaataaagaccaagcacggtggtgcatgcctataatcccagcactctggaaagctgaggttggaggatcacttgagcccaggagttcagtattacagtaagctatcatcactactgcactccagcctgggtgacagagcaagaccctatggatggacagatggatggatggatggatggatggatggatggatggatggatggatggatgaataaactatagtctgaggatgcacttttgagtgatagatagatagacagatagatagatagatagatagatagatagatagatagatagatagatagatagaaagaataaactatagtccgcagaggcacttttgagtgataaaactagaaagaaactcgaggaaatgattcccataaaagtcaagatggtgattacttttaggctaaaatatacacaaaactgaagaaaggtttagcatgggacggggcagatggagggctttccaggatgactggcaaggttctatttacttatctgtgtggtattctccttatgataattcattaagctacacatctttttttgatgttttctgtaactatttttattcgacaaacggtttttttcttttctaaaaccctagtttctagtcctagctatggcattaatgtgggaaagtcacacattcccttggaccattccctcatgtgcaaaatttaaagatgctgtaagatatcttccagacctaaataaaaataaaaaaaagaactactactaaatatatctactaaatacgagagtataacaaagtcatccttaacaaaaatgcagaaaaaaggttttaaactcaccaaagtagcacaaagcagtttcccaaggaaaaaaaaaatccacaaataaaatctaccataacagtaatatacaaggaatagtcaaaacctaagattaaagttactgttggactatttggtttccacatctcaacaaatcctaaggacagatccttaatttacttaatctactctggaaggccttctggtaataaaagcatttgaaaaatttttgcagcatattgatagtaagaggctataccaaccatatttattgtcttgagggttgtgggggaaaccactacactgagccggttaggaaatggtaataagtcaggaaaccattaaattgggaacaaatgccttttgggcatcaaggtgattgattagcctattaaggatttttttttaagtatgtatagaatttatgccctttaggaataactaagaaatcaaaggatatctcttaagtacaaaagagcttaggagtttaagtttaatgccaccaactaggaaggtgagtaaattcacggaagctttaaaaccaggcatactcttctccttactaatatctgttctattgggcatctttttccaaaagaaagcaggttcttctctgttacaatagttaaccttctcctttgattatttctactagtgaccaaatgtcatagagaatttcttagcagctactagtatgtatggtacttgaacactcattttgatgttatgcatatggcaaactatccttgaagccaccatgactagataatagttttaatagtaaatggtccatgcttagcctttaaattctgtcaattcctggtctcttgttaaattaatgttatactaagagacatctggtgataaggctcatcttctgcagcccagtaattctcattctcggctgtatcctagaatcaccaggagggctttactcaatattgatacctgggtcccatccacaggaactgttttatggaagtgttaagtggtaaggcctggacattaaaatacttaaagttcccagatcattctactggatatcaagatcaagagttattgctcctggatactttttcctcatttcatcaattacttagcccctttgttcactgaaagacacctgcacatacatagcatttattttcttaaattttcactttttccttcagaagtgttccttcttttaaaagcttctttatatttgtatatacagatgtcacatgcctcttgtggcactttcaaacttatcactacattcatggttatctgacatggtaagtttttaattatattcacaaaaatctaaaaagtaagtacgagcatagcaaaatgtcttaggccaagaaacaactcagtgacaagatgaaaacaactcagtgacagggtgaaaatgaccttggatgacctctaatgccaacaagcggtataaacatcattaaccaactcaggatctaataaaattcaactagtaaatagcagtttttccatatctgatgaagccttttttaaaaaacgctataataaaagaaaagctgtcttaactacctatacgatttttaaaagaccaaaagtatacaattctaatgtgagcctaatataatttactcctataaaaaaagaaaagatgatcagtttcttcattatcatctcctacctaaacaaaaacacaatgcagtaatactagagaacatgaaacaccactggtgctgcccagaaataactcataaggaatctggatgaattttagctgttggaagatcattttaattgtgcatacataaaacctaccctatataggaataaatgaaaactgaagtgccagctagattattagaaaatactcttaacaagaaatcggttcattgtgctgaggctctgaaattttctgctagtcagcaagtaagacctggaaacaagcaggcaaagcatcataagcaagggcattgtgtttattagatacatctaatgtcaatcacaaattttttactaagcttttgtgttataggggcatttttatcaaatccctaatcggaaatagaagcaaaaaaaaaaaaattcacgttaatgttaacaagaatgtgtgaaactttggttcttctaagtttctagtggttaaaatataagcctcctttaagtaagaacaaccaaaaagtgagagaaaataaaaagaacttaatttacttgtaactgacaatgttttccaaaattaacattggaaactgtaactgaaagcaagaaaaactgacactgaaatgtattaaaactccctactaatattacaatattaacaaatcaatgctaaaactaacaaatcaattccagattttccatgtagagaaaatacagtcaccccttggtatccatgggagattggttccaggacttcccacagacaccagaatccagagatgctccagtctctgataaaaaatggcatagtatttgcatataacattcacatcctcccatatactttaaatcatctctagatgacttatgatacccaatacaacgtaaatgctatgtaaatagtcattatattgtttagggaataacaagaaaagaaagctgtgcatgttcagtgtagacacaattgtttttccaaatattttcaacctacggttagttgaattcatggatgcaaaaccaacccatggatacagaggttcgactgtatacataaatctaaatatatgactgatttttctcaaaacatagttcttttctgatcaagatacgcctagaagagtaatactgcagaatacaatgtcttccatccttgagaacataatggcctattgagctagagcagtactatgacaagacctttcaaaatacttttaaacactatattatacatatatccatacacacaaatatatacatacacacaagaaactataattctacacttatgaactcaatttagactcagttgtttcattgtgttgcttaaaaaacttttgttagtctttatgcctcgtaaagttatgatcattaatacttgatatttaactttcacatttaaaaagtctgaggaagaactactacagtaatacttaaggaagcgttcaaagaataaaaactttatccaaaacttttctaataaattcctcagaatagcccttacattcagttggaaaccagcttgacagggaaaaagaaggagctagcaaactttcaggagcatttataaaagaggaattctgcttcttgatccaaaatatcaaaaaaaaaaaacataaatagaaaataaagaatggatgttctaattaagaatcttagaaatgtgggatgggctatccttcgatatcagctcacctaaactgggcatgttaatgcagctgtaatacagatgccaatgatacgtggataagggaggtgaggagtctatcacaacttctgactccaagctagtgcattcagaagggcttttaattagaagtacaaagttcaaagagaaatgtttaaagcattttatctaaacctaatggtacagccaaaaagtaaggggtggggcacgggggagtgcaacatgctaagaggtagcagtccagttgtaatctgtaggtagttaaactgtctggacagtttaatcatcttgacctacgaaaattaattggggaaaaagacaactcgcaaagcactgataagcaaatgttcatctctactaagtattcttggagacacaataaacacactgcactacataacataaaccaaaattcccccgaaaatctctttaaatatctctccaaatctctcccagaaaccccacctccccacaaaggaccagacatctttttggttctcctttcctatctatctctcaaacttgtcctccttccctctatccttactccctctctgcccctctgcttccttcaagaatctgctgctcctttcaagggtctgctttcacttgtctggaatataggttttggcctctcaggacttccctagtttcatattgccgcagattacccggacaaacctgaaagtagaacggcaaatagaagactccttcctctcaacagataggaaaggtataatgtatgtttatttttgaggggcggggagggggacagggtctcactctgtcacccagactgtactgcagtggcatgatctcagctcaccgcaacctccacctcctgggttcaagcgattctcctgcctcagcctcctgaatagctgggattacaggcctgtgccactacacccagctaatttttgtatttttaggagagacagggtttcaccatgttagccaggctggtctggaactcctgacctcaaatgatccacccgcctcggcctcccaaagtgccaggattacaggagtaagccaccaagcgcagccatatattttatttttactaaccctctgtaattgatagagaaaaaatatataaatcttgttcagaatagatttagatcaataagaatcctttttaacacatactttaattgtatataaattaatccatagtctcccatgacccccatcatgagatttttctcacattatccagaaataatacatccagaaacagctcacctttaacacaactcaagcacctacaagaaaataagcattaataaacacttctatcacagacataggtatgatgcaccatcccaaagagaaaagaggaaaaagaaaactaagtgaaggcagcaactctattaggatatatcttccatgcttggtttgtccactcaaacataagaagcttgactacagaaatcatcttttaacagtatctgatggagtactttaagcattctaagggaagataagattaaaaataatcaaaccctaataaagaatgagaactatactcaaggttaagcattactattaaatacatctatatttatataatagatttgtatattaatttctaattcttttttatttttaaaaataatgaaaatcctcaggcagttgtggtttacaagagcattctctgttctggtccagaattttcttgttcttacatttattggaaaccatggatcctcttccatttggcctatcacatcacatcctgctatcaaggcctttaccactaactgcatcacagtcttaccttccagctacgtgatctaacaagtcaagtctatattcttcttaaaagacattttctccaataaacttgctgttaaacatctgagttgagtcatttaccatagaatgggcacagcgccttgtagtacctctctcatctatgctatgagtgagcccacactaagtgaggggagcgtcttaaggatgctcctttgaatggaaacagtaatttccagattgaattagaattaaagatccagcacaggcaaaaatgcatgtggatggtatatcaggactctttaacagcggcaaagaaaaaacccggagtagcttccatgagaacctgcatcacttcacataatgaagagtctaggggcaggaatgcattaagccagagaagcagctctgtgacatcaagcaccgtacaacctctcacaatcacatccaatggcggaacaaagtggctctccaactctggatcctttcatgagggagggaaacctttctcaaaaaccccaaagtggaactgcccaccagagtgtaccggacaaacctggatcacgttcccatgccctgaaagttagaaaaatgtaaatctggtattttctgcttctaaatacgacacttccttaataaaattgtaatcattcttcctaactgcacaaattcagttttattcttgtgccacctaaattcaaacttaataacgtcttagaaataacctagtttgattggtggcttttttttttaattctaaaaaccaaccttatctacgttaggcctactttgagggttaatactttgagggttaagtattttcaaaccatgcactgttagacatcagtactattttcaaaaaaataatattaatgcttacccaaaaaggagaatctcaaagcaattctaagcctaaaaccataacaaaagtatatcttttttatcctgtgtccttttcatatcctgtgtagaacaatgtatccataaactttgattctgttcttttcagagtagctttttcaatagtcattaatgtaaataaagtggcatgacaaagtctgtaccctagagttaataaaatgtgtttctacttccagagcaaaaacaaatgactggtcagcttgaactttctagaatgttaaccatctgccaaattattcagaaccttcctaggaagagccatgatcctccacacactaattaaatgagtcaatgctgtaatcacactttagataactaatctatttcaatcctgataatttaattacctaattctggtaaacaaatttcaaccttagtccaaaatgattagaggattaaagttgaaaatcagtgaatgcaaactgaaatagatccacataacaaagttcaaaacagtttgtttcttaaaattatgtttattatctcaaattcaagaattaatatgaactatcatgccaaggttttctaaaccagttctaactgatgtcgtatctcttataataaatgaattcctacttgttagatttacaattccctaacagggtagtcttcactgactacacaaaacataaacactatctacactcaccagtctgttattttttttccacatcacatttcacctcctattacatatatgtttatgtgtttctgttatgtacatccagtgctgcttcacaggacacagtgatagactatcgtcacacaccatctctagtgcctaaaatgctgcctgacctgcagtggcacgatctcggctcactgcaacctctgccttatgggctcaagcaatcctcccacctcagcctcctgagtagctgggactacaggcatatgccaccacacccagctaatttttatatcttttgtcaagacagggtcttactatgttgcccaggctggtctcgaactcctgggctcaagagatctgcctcccaaggtgctggaattacatgcgtgagccaccacacctggccttatagacacttaaaaaacaacaactaaaaaaaagccttagaaatgtgaacttacaaatagtaaatctgtatttttactgatgtacttttctctatattttaaattatggtataatgattacaataacaagaacaaaaaacaaattacaaagaaaaacaaactattgctaccaccactgctaccacaagaggcagtcaccagtcataaaatatgttgtgttctaatcatgaaataaacaatttaattttgtttttattattattattattttagagacagggtctcactctgtcacccaggctggagtacagtgatgtgatcgaagttcactgcagcctcgaactcctgggttcaagcaatcctcccacctcagccacccaagtagccaggactatagtctctcatcaccacatccagctaatttctttttctggttgagacaaagtctcactatgttctccaggctgctctcaaactcctggcctcaagaggtcctcccaccttgacttctcaaaccaccatacctgcccatttaactctgataatgagtccactatgtaggtattcccattttatagtaaggaaattgagaatcaaagaggtaaaataagatttccaaggtcaagcagagacacataagcagatccaaaacaccagagctctgattcttaaacccccaataccaatttgtgatatataagtatcattaaaggacaaaggcaattagtatcagtatcatagtagcaggatacagagcccatctatatagagagctaaaaaaaggccgggcgcagtggctcacgcctgtaatcccagcactttgggaggccaaggcgggcggatcacgaggtcaggagatcgagaccatcctggctaacacggtgaaaccccgtctctaataaaaatacaaaaaatttccaggcgtggtggcaggcgcctgtagtcccagctactccggaggctgagacaggagaatggcgtgaacccgggaggcggagcttgcagtgagccgagatggcgccactgcaccccagcctgggcgacagagtgagactccgtctcaaaagaaaaaaaaaaagtgccgctaaaaaaagcacagtactcacagtgatttctatacctgaagagcaagctgccaaaacatgagacacgtttaaaaattaaacatcacttgtgtctttcttccaaaagaaaggcctcagagtcaatgactggtctagcagttaagtggagttaaagtataaataacttatgttcttgtaacctgaacttaggttaaaatacccaaggaaaactagtgtgttaagctactttttcctaatccaattctgttgtaaattgagccaaaatcattttccactgtctttctactgattgcttcttcattggcttccattttatattttcatccaatccatttattcacaatttgtatgtgactagtcaagctcatttgttttccatgaaataaatgcaattgattctgtgtgccagtcatggtttcttagacatttagtcattacttccacccacatatttcatgtttctctagaaaattggcagccatgtagaggcctaatgctcctttcaataccaacatttataatttgttacaagataattttattcatagggagactcacattaaagacatttctaagccactattatgtaccttgatgtagacagagtaaaatcggtctcacttttctataatgcagatatcactgtgatttataagtgacattaaaaatcaatgactatattaattcactaacaaggaaaggtgacagagtagaccccctcccagtgtttcttagcaatgtaactagctaaaaaacagaagcagcttaaaagttttaagatgagaaatatttttaatttaaacaaatgtataatatacttgtgcccttaattatacattcagaagccctctgattacagttgcccacaaacttaagtacttcattagataaatgtgctgttttccatgttaaaacatgttcggcagtatttttcaacttgacagttttacttactgtcttagaagcagtattaatgtactgcatcaccatttcttttttgatactgaagtccttttcccgcaatggtgcctttttatcttcatttaaattcatatcttcctggaaaacacaattaaaatgcctcattttagaatctaagtagagcagcaattctacatgcactacaaatggaaaaatcaataatttgtgactaaagcagcattaattgttttggaatgatttacgtgtagttctgcctgaaggaaggagagagaaaagaggtggagagggagagaagaaagtattctagatcattttaacaggtaaaacacttactaaaagaacttttaaaattcacagcaggcaaataaaattatattcacataactatagataattagacagttgcagatttctgccattcataaggtcacacaatttcaatatatttatttatttttacaacagctgcacctgaagctatcttccactgctttgaaagagctgctctgtgtgtcataaaaattaaaaggtaaataaaccaaccaattttcagattctgatagccacatcaaatatccagtactggttccagcaaaagacaaagcactttatagttttgtcttttccctactcttatcaaaaatgttaactaatttattgaatgttctaaattacataaaagttgtacttataaaaacagctaccacctaaaatcgaacatttctcaacagcaccaaccaaaataagggtttaagtaactaagatcttgctacaagcttaattttgactaaaaattcaagtcaggtatatatccacataaatatatgaattgctcttaattaagctcctgaagtaagaggctattctggcaaaggaaagggcgcctgaggtaagacagaaatggctaaaggagaagggcagctcaaatgaatttcctcgtgaacttagccctgagtcatttgtgatatgcaatgtaaaatatctgaatgtatataaacttcgtatctactcagaatggatccataaaattcaggactttggatcacctatggagcctagcaagttaaatttcttacagattttataagggtgctacattcatcaaacgctgtagtttatgcctttagctgactcaattcttggctaccaaacccttcgagcacttaaaagtcaaaattcccttcattttaccttgatagaaatatttaagatcttagaagctgttccatttgacactacgataaaaggtagtaattggcaatgtcacttttgctgctctagttagaaacacaaacatcctgttacgtgaataagtgtttgttttgtttcgtttttttctctaagctagtgagagaaggctcaataggccttaatatgacataggaagcattttggaaattttggaaacttctggaggcatgttagttgtcacaataattgaggtgatgctaccagcatttacagggggtagcatcacagtttgacctgtacagtaaaaactaccttgtgccccacagagagattcacacacctaaaaaagagagagagaaagaatcatccttaactaagcctagactcgaattcaatggaactgttgcaggacaggtgagccccaaatttggggctcatggcttcatcatagaaagaattcaaaggcaagatggtcgtgttacacagcaaccttttatcgaatggtgctgctccttgcagagcagggctaactcataggcagtgtgctcagagtcagcaatgtatgggctcttggcaattgtaattatactcacttaaactcacttagctatatgcaaattagggggtgggtcaatgtaaattaaggggtgggttatttagaattttctaggaaaggggtggtaacttctgggccattgccatggcatttgtaaattgtcatggcgctagtgagagtgtcttatgctaattaatgagggcagctagggattgcttttgtcccatttgccagttattgctgttttttgtgttttttttttttaatattttagtctgtctggaccagtttctgttttgatcagcagggttgtgactagaaaacatgttctgccagtctcctattccagaaatagatgtaaaatgtaaaattattacatattaaatactttgtattgcatagttttactttactgaattttccaagaatcaaactattctgtaaattatagttacactctgctttttttaagctttaccaacagttgtgcttcatttctgaaatgtaggtatcccagggaaatactgtctgtggtatctgaatccccaaaatagcacaactatatcaatctaccaatctacaatgccactgctgtactcacagaggtatgaagcagagattcaagagtatgaatttactataccttcttgagtagtcatggccaattgtttaaattgaaatacatattttattatatagtagagtaagacatattgattttcttaatttatgaacataggtaacattatccacaaagaatttcactggaagaaagtaatgagatagttaggggataattgttataaaacgtggggcaatctgagagcactggaaaattctgttttaaattattcactttatttttattttcaggctaatggccaaacattacccagtctctttagtaaattaaaatacttaatatacacagaataccaaaaaacagaaagccctttagttgtggctgaaattgaaataaaatttcaaggtgagtagtagaaagaattttttaaaaaggcctctgctttctttttggaaagacatcttcatgataacaccagttcatacaaaaaagtggttgtgattgttatttttgggggttggttaattttaggtgtgatggttaattttaggttagacttctggcttaaagtatacccacatagctggtaaagcattatctctaggtacgtctttcagaagagattggcacttgaatcattggactgtaagtcagtaaggacgatccgccctcagtatgggcaggcaccatctaatcagctgaaagcctggatagaacaaaaaggcagaagaaaggctaagtctccctctctcttctggagctgagacaaacttcttctgcccttggacatcagaactccaggttcttcaagctttgggccctgggacttcccccagtgacactctccctggagttctcaggccttaaagccacctcagcctccaactgagtttcaccaacaacttccctggttttgaaaacttggggccttaactgagccacgctgctgacttccctggttctccagcttgcagatagcatactgtaggacttcttgccctttataatcatgtgagccagttctcctaataaatcccctctcatatagacaggcaggcatcctattggttctgtttctctggagaactctgactagtagtgatacatctggaattaagggagaaacccaaaattctcccagctgcttcctctggtttatcccacctcttttgcctaaatatggcactcgccttcctgacaaaagtatgatgacagtcctagtataaaaaaccaaaaggaaacaaataatacttgctctaatttggatgttatcccatgcaaatctcatatttaaatttgatccccaatgttggaagtagggcctagtgggacgtgtctgggtcatgggtgcagctccctcatgaatagattaatgaccttcctggggtgggggcgattgagttcttgccctattaattcccatgagagcaggctgtttataagagtttggaacctccccaccaccttctcccttgcctcctctctcaccatgtgatctctgcacacaccagctttttcttgtctttcatcatgagtggaagctccctgaggccctcaccaaaagcagatgctggtcccatgcttcttgtacagcttgcagaactgacagccaaataaacctcttttttaaattattcagcctcaggtattcctttatggcaacataaaaatggactaagacaacaatacaaaagtttggaatcaactacataacaccctaaacttttgtgggatacccactaggcatgtaacttcatctaacaggtcatcctccatatttccaggaggaaatggcatttgaaagcgtaagaaaagctctgccctttaaaaaagaaaaaaaaaaagagagagagagagagaaataagggggcagtagagagaaaatatgcatgaaagcatgaggggtatggtattattagaatatattttgaatttctatttatggaaaacaaggctgaaagaagaaaactccatgaggcagtggcacttaacttctgggggtcacgaagtccttagaaaatttattgggagctttttttcctaaaaaatgcatatccatattttatgttgcaattccagaagggtgaagcatctcccaaggctatctaagaaactggacttggtgaaggtcagtgggggagaagtgagcaagttatcattttttatgtttcttagtttatatttcctcaaaattatcatgttgtatctccattatctaaggtcagtttcccttaaaagcagagcctgaaacagggattcaggtgcaggtggggctgctctcaggataagaaagtaaaggaggtaagacaaaagaggaaaaaagacatactaaaggtggcctctggtggattctcacttcaccctgagatgcaccacagtcaggatagcctggtagcagaaaccagcctcaacaacctcaagttagtcatcagctgcagaatcctagttctgatgagggcaaatctctggagaaaggggcatctataagctattagaagccaacactcatcacctggggcatgggtgcaccagcctggtaaaaaggagctgggagggggtactaaaagtacctactataccatctgaaaataatttacttgatattaaaataagacttctttcaaattgaaagaataaatatagaaacaaattgaacagaataaattgaacagaataaatatagaaacacatatagctgaccttaaaaaaaaaggcaatataaactattgtgtattaactcctccttccattcaaacacaggtcagtaaaacatgctgctttactgtgctaccacactacataggtacaaaatgacactgcagacacagattgtaaaacggctctaaaatggctgtttacctcaatatatcagtatgctgatatatgtacgtatctcattaaatatctattataggtaaaatactgaacaggaaatacaaagtaaacataaatacataaggctcagtgagtaatctgaatgaggttaaaatttccatggatatatgaaataaatctctaccctttaaatggaaaaatcttatcaactggctattgggctgaatatatcacactcaaaaacatcatttgccaagtcacctattcaaaattttaatctctctgaagagcatattattgtttttgatgttaaagttctattaaaaagttctattaatatgttagtaatatacattatgaattatctcattcatagtactccttaatatacagatgctcaacttacaatggggttatgtcccaaaaaagccattaaaaattgaaatgcagaaatgcatttaatacacctaacctactgcatgtcacagctcagcctagcctcccttaaacatcctcagaacacttacattggcctacagttggacaaaataatctaacacaaatgctattttataataacattttgaatacacagatgcacattttgtagacatggtgggatgcgaaaacacaaagcacaatatccaaaaaatgctggggacacagtacagtcagttgttcagcctaatgattgcatggctgacaggggagctgcagctctcagttgctgccccacgtcacaagagagtgtcaaactgcatatagctagcccaggaaaaagatcaaaattcaaagtacagtctctaccgaatgcatgttgctttcaccactgtaaagtcgaaaaatcgttaaatcgaaccactatatgttggggaccactctcggcttgccaggggaaaccgagttgcaacagcaaaaaaaatagtttccctttggccaattactttctaattaaaatctatatctaaacagaatcactgtgctgatctgactagcactaggaacagatttcagaagtacaatacttggaaagctttttttttcattcaatacgtgggaacacagctatgtcatccaaaaagactagaattaaaaagaccaaattaatgtggtaccagaaagtaagagaaggaaggaaggaaggaaggaaggaaggaaggaaggaaggaaggaaggaaggaaggaaggaaggaaagtcaaaaggacatgagccaaactgaaagagctgttaagtggccaaaactagaacaatttgaaaaataaaatgatagtattagattataacctaaaaagcaaaataaattgaggagatactttaagactgtgcagatatcctttttctccttaattatagaggggaaatactaactttacaagggaagaagctggcagatgccaccttaacaaagttgtccaggctaacaccacaaataataggacatattgatatttcaaacctccagctatgatataatgagaaggctgatcacctctgtggtatttatcccaaaatagatctcaatctaatcacaaggaaaaaaaaagtcaggcaaacccaaattgagagcaccctacaaaataactaaccataacttttcaaaagtatcaagctcataaaagataaggaactgtcattgactggaagagacatgacaaataaatgcaagatgtgatcctggattagatcctggaagaaaaaaaagacatgggtgggaaagctggcaaaatctgaagcaagtctgtagtttagttagcaatatcgtctcagtattcaattcttagttttaataattgtactaatgttatataagatgtaaacattagaggtagtttggtgaaaggtatacaagaattctctatactatttttgcaattcttctataagtctaaaattatttcaaaataaagagttattttaaaagactaaattgaaatattttaatagaactttttataaataacttggggtaaaaaaagaaaaacagaacatcattattaaaaaaaaaaagaagtttttttatatcccctaaataaaaagaagaggtttgtagaatattcggctatagtaaatacacactgaattgagggaggaaaggagactaaggaaaccacaatcaagacaaatccaagggtcctgagaggaagggttaagtaggtcagacacaggtaacagaattccattcaaaacacaaacttctccaactgtttacatttcctcctattttcattccaaacctgctctatgcactgaccttctcacccattctcccagaaccattttacaaagacctctagtactcctgtaatcttaaactatggtcaaattcttgagccaggcactgtgctaaacattcataagcattacttaattaatcctcagtaacttgaggtatgtcctctttattgaggagagagctgaggtttaggaaaattctgtaagttgaccatggttctttaacttagatttaaactctgttctatctcatctccctcattcttatttccatattatttatctatgttatcatctaaagtccgatttccttggggctagtaacatctgactgaacacttccactgccatcaacttgggttgattcctctgacactccacaccttgctatcacccacaatggccctaaagcaagcttgtccagattgcacccaggacggttctgaatgtggcccaacataaattcaaaccactttcttaaaccaccatgagatatttttgcgatttcttttttttttttttagctcatcagctatcaaaagtgttagtgtattttagttgcggtccaagacaagtcttcttccaatgtggcccagggaagccaaaagattgggcacccctgccctagagtgtccttggcttccttgccaatgcaagcttcacttccactgtcctcagctacagtcctaatgaccacacctggaccttttcattatctaaaacctgtccaccacaggcatcatcagaatctccataatccttatctctgacctcaatcttccatcttgccacttctcccactcccaaaccatctttttcttggccccagtaaaaacctccagtttcttgacccttccattttcttccaatgcaggccactgttgattcatcaattcttacaacatttatggcaaatcttactagtctctctcttttcacatttcatatggtacttatttcaaaccttagctattttcaggaactgtgaaactactacttctgcctatcaccctcagtaaataaatttcaattccctatatgaaaagaaagctataattccattttctgctgttttaccattttatttgcacactactatctttccctacccaaccaatgcatttatccaaagacattcctattcatttatgctcgagatcccttttcctcccacctcaagaaagggcattacacatcgattatcctcttctattttatttcactaaattctctcagttggttgagtatcaatatgtaagcaagttaatctttaatggattaaaattaaacaaaaaaacttccctcaactctggctctttatatgtaactcttttctccctcaccgataacatttaatagaaatatttctatacttgctgcctctttcaccgtgcatggaacataatggtcactttttaaatatttgctaaataaagaagatgtcagaaaagttctcaaatagaatttgctcatcctattttaggacaaacatgagatgcaggtaagcttctgggagatggaactgaagctggagatgatacagccccagactagaacactgagcaattgctgctcctaagaagattctcaagaatcttcagataacagttacgggaataagttccaactctggaggtagaaatcttcaggtcgtggcactgacacaaagatggccaagctaaaatccatcactttttcagagaacactagcagacccacactaaacctcagtgacctagaacagagtcaatataacgactgacccctgccaagtagtacctggttgaggaatgaatggggtcaaggtcccttccagactcacttcatcatctattccaaacttccaaacttgtgaccttgtgtggtgctgtgtccatccagaatgaaagcatacacctattctgtaacttgcacaaggacaccaaattagtcagcggcagcccttacctggaaaccaggtcaatcaagcaacttttaagatattcccaaagagtcttcctacaagttgcatggggccagaagttcccacacaccagcaaattgccagtttgctactgtttttagggaccctaactccctactagactgattttttaaaaatagtaccaaataaatatttttcacattttattagcaaaaccgaggtgggggggaaatatgtaacttagtacctgtgcacacacatgcaactcgttggagcactaaggcacaatcaagcagagaacagcaatgagagagtggacatttttccaactgaattacacacgttagactcaatattttcattcatggctgtggattttgcaagacagcatgctcattaaatttacatacatcaagttgagcgggacagttaacaccacagagagtcagattaaatttaaaatgattgactatttgcagaattaagtgaatatatacaagcagcaagttgctgaagatggtcaggtggaaggatattcaaccaaaaaggaaaaacactacagacaggcagagcatgactagcattacaaaatggatatgggaaatacagtattataatggaccaataagcataatattggaaaataaaaattagaagcactgcaatagcaaaaccaaacatttattcctattaagtcaacagcaatcatctaatttcaataacattatgttttgttttaggggttaaagccaacataattattcttggtagcagtctctgttttgccagcattatattattaaagccacaaattggttaagcatcttaagaggtccacaaagatcccctaattccctctcttgtgacagagctcaacatcatataagcacaattttatccagagttctgctaaaagtgtaattctgttcttaactacatttgaattcatctttgacatcacacaatatcaaacggtcaagcttttcattacactaaggtttttactaccatgaatggcttagtgccaaataaaaaaaaacagaagatttcatgacctcattcaaggtcattatacactgttgaacagggcagactaaatgaatcttatctagttctgcaatttaataaattttattgggtttagacataattagaaaactaaaagataaatactaccaagaacctggaacttagaattaactttattactacttttctatattcaagatgtctataaatacattgaagctataaaatagcttaaaacagctataaaatattttgcctatcagctttactatgtccttatataaacctttaaataatcatttttaacagaaatatgattatttaaaagttatattttttggttttaccaatagtggggttgaatttccactgtactatccagtagacactggattactcaattcccattaaaattaaaagaaagtcagatggctagctcattaatagaacagcagccaaagaatgacatttacccagagactgataatgaactcataaacactattttttggccaaatattctaactggagaatatgggaagagtgtaaactatcttaattgaaaaacaaatttcagtttatcctaatgcagtatcaaggcacacacacacacacacacacacacacacgatgagaaaaaaagaaatttaaatatcacttttctttcatatactgtaaattttagcagaacagacaagaagagagctgaatattcagaaagctgcacaactctaatttattctggaatgtaaccttgccagaattgttcaagtgtatgcataagcacctacaatcacaaacaactgctgtgtaatcctgcagataagaacactgccagtgattggccaggcgcggtggctcacgccagtaatcccagcactttgggaggccgaggcaggcggttcgttcacgaggtcaggagatcgagaccatcctggctaacacggtgaaaccccgtctctgctaaaaatacaaaaaaattagctgggagtggtggcgggcacctgtagtcccagctactcgggaggctgaggcaggagaacggcgtgaacccaggaggcagagcttgcagtgagctgagattgcgccactatactccatccagcctgggcgacaaagtgagacacgatctcaaaaaaaaaaaaaaaaaaaaaaaaaactgccagtgatgaaaaaggattttcattcatatatttgtttttcaacttttctaagtaaatgacaatttcttcatacatttacataaaggataaaatggtcatttgacttaagatacaacttttttcttaaggccaccttttctacagaagaaaatatgactgagaaaaggccttcacaggtatacacaaataattgcctgcacagctcctaactggcaaaacagcatgctgaaatattaccataacatttacccctttaaaattcctccctctaaccattttattggtgctacaaaatcccaccaggcaaaatccagtacacctaaatcatttattttctcatttatctggatctagaagaaacaactaaacactgacattatccccctgacaaacacaacccatgaatcaacttgataattgccttgaactactatactctctccctcttcctcttcattatttggattgcttttaaaccacctttccctgaatttttcaatttctacccaatggagagggaaaagagtgacaagtaataaatcagaacaaagcattcccacagaacctctctcattttatctagtcaagccttaatacacttttttagattgtaagaaatagaaaatgttcacgatataggaaagtagatttgtaaagaatactaatacttgaaataagctgctggtaggaatctatagcagtcaataaacacttaagagaattaacacaaaggggtctttgttggtttttcttttcattcagactcttggttgacccttaagatattccttgcacactcaacacaaaattcatttatttgaccaaagtaatagctatgcataaatctttaacaccaagaattaaagagaataaagaaagaaaaattgtcattagtatgtaccctaagagtggcaatatggaataagcttagcaagatgaaccctccccacctctataccaaaaatatcaaaagaacatggtcacatctgatttttatcggttcacctgagcccttcttttctcctctggaaaaacagctcttagatattaaggtttattatacagttgtggtgactaagacaacagacgtaaatgcagaactagacaaacgaactgatggacaaaaatcaaacctcagaaacaaacccacatgtgcacaaacttgatctataacattagagatattacaaatcataaaaaagaatgaactattcaaataaatgctgctggaaaaactatgtggaaaaaaattggatccacatctcacatcaggcatagagatatatatttctaataattttaaatgaaaatataggagaatagatttatgatgtcaggatagatttcttcaataatatacaaaaaggacaaaccataaaaagtttgataaatctgaccacaattttacatttttgtacttcagctcccctttcccgctaacaaaagtaaaaagacaagactcggtctaggacaagatatttgcaacacatataaactgaacacatgagtattattctggctatatgggaaattctacaaatcaatatgaaaaagacggaaatctcaaacaacaaaatgggcaaaaatataaacagaaaattcacagaagagtaaagcaaagggccaataagcatgtgaaaagatgttcggacacatttataatcagaaaaatataaatcctttagtatgagatatgctgtttacatttgtttacttgcaaaacttaaaaagtctaatactaatgcaaacagggatgttctacaaattaaccagcctgcaatcttcaaaactttcaaattcataaaatacaaggaaacatacgaactattccagactgaagaagattttaaaaacataactgaatgcaacatatgattctgaactagattcttttgctataaagaggatattggtactattggtaaaactttaatagtgtgtgaggtagaaattgatcagtgttaactttctgattttggtggctatattgtggtcatatagaaggaagtccttacttgtggaaaacatacactgaagtattacaggattatggggcattgaatcagcaatttaccatcaaatatctcagaagaaaaaaggttttgttccgtataactgtattcttatacagacagaaaaaaaaaaggaaagtttcttcagtgtatgggagcaaaactattggattcagggtactgttaacctcagggaaaaaaagaagataaaagcgggaattagaagaattacacaagggatttcacttatatccgtggtggtattttttatattatgttctatactttttgtatgcctgaaatactgtataatttaaaaaaaacactgcaggacaaaattagattccactctatgttatacacagaaaattgtttcaaagtcaaatattaatgcctttggtattatctaaaccaggtttcccacactgaaaagccaatgtatgtattaaatagtaggtcatctaagttcttactaccaggacatacttcaaacatacgcttaagagatgacgatggcattttataaatgtgctttctcctacattacaaaaaagcctgataaacatcttcccagtaaaagaatagaacatcactattcatacttaagtacttcgtgcaattttatcaggtcattttttctacacttacaacaattctagacaggaagtccagaatttaaataatttttgtcagaatgattttggtatcattggaactcatttaatgcctgttaatgatagcattctgatagatgagctttcttgcatagctttcattctctcaaccgatagtgaaaataagaaaaggtatgaatgcatgaaaaaagctatcttccattcattattttaatgtttttgtgttattgggctgactagcaattaaagctaatctccatctaagtatagtgtctaaggtgaagagaaatatagtatcctagaaatcttaagttaggaagctgcacttaacagacatttgtttggaatgataaaccaatggatgatactgcatggatataatctaatgggaagacagatatctaaaaagtgaaaagtaaaaaaaaagaatgaatttcacaatagactcataagcagttttgagaggcaggtttaaggaatccttaactcagcacatgtgaagataattaaagaaaactaatgtttaaactaagatttaaagtatgtataaggccaggcacggtggctcacatctgtaatcccagcactttgggaggctgaagcgggtggatcacttgaggtcaggaattcgagaccagcctggccaacatggtgaaaccacatctctaccaaaaatacaaaaattagctggcatggtggtatgtgcctgtagtccctgctactcaggaggctgaagcagggattgcttgaacccgggagacagaagttgcaataagccaagatcatgccactgcactccagcctgggtgacacagcaagactccgtctcgaaaaaaaaataaaaattaaaaaatgaagtataagaagtctctaacagaggcatggagggagataaatggcagagaacactgcagtatcctagataagaggtcatgaaagcttgaactaaagcaggggggaaataaacttaagagctaatgaagatagagaagtaaatggatgtgactgatgccttaatgagatcaactatgactcccaagtatgacttcagtggggacttctgagataagaaattaagagtgaagcagaaattttggtgagtgggtgtgtgtgttggggggaggtgtgtgtgtatttaggaaatatgatgagttcactttctgatgtgttgaggttcagcatcttttagagagctggattataactgctcttctgtagaagacataccaaggtgtcacaatataaaagatattctccatgaaagggctcaagtctcccaaaaggagtacgcagaaaactcaagtgtataaagataagactgacaggcagaggcaacactgagaggaagtaaaagaacacatagaaggatatggagagtaaactggaaaaaactggccagagagaaggaaaattaggaaaagtgaagtgtgtgtcacagagacacacacttctttcacacggtgtgtgactgccacagaaccagtcaagccgaccaggatttctcacttacagaactataataaatgtgtgttgctttaaatcacaaagtccgtggtaatttgttacggcagcaataggaaactaatacaacactctaggaaaccaatagataccttaggccagcaagtgctcattccttccctcccccgaccccaatctagtcttggaagagacaaattcagtccagagaatagggaagaatggaaaagcaagatggaggaaaagaggccaaccacatccccaacaactgcccctactggagactagaaatggaacaagcttgaacaagggaaaaggagcagctttctttgggtgaaaattaatttatattaagctagggtttgtattatctgaaaccaacaggaaatctctggaacctacctgggacttttaaccaggatcagaagaaaaataagctcagagggctgatttaaaggtgcaacagctggaataaactagccacttccaactta

SEQ ID NO: 153 - DNA, 35761 bp, Homo sapiens
tacattcttggttttgctctttaaacaacttactggccattagcgttatcttctgcactaggagcatggggtcagcaagctactacctgagatcaaattaaacccctgcctgcactttactgggacacagccacactcatcagtttacatctcctctctggttgctttagtgctgcaacaggagaagtgattagttgtgacagagccttatggcctacagaacctaaagaatttatctggccctttacagaaaaaaagttcgctgcctcttgcactagaacattgaaagggaaaaagtagagattgttttacattttacctgttaaggcttgtctggtaaaaggctgatatacaaccacaaacaacagccagtaacattaagtgtgtttttattatttattatttaagacagagtctcgctctgtcgcccaggctgcagtgcagtggcaagatctcagccactgcaagctccgcctcccgggttcacaccattctcctgcctcagcctcttgagtagctgggactacaggagcccaccaccaagcctggctaattttttgtatttttagcagaaacagggtttcaccgtgttagccaggatggtctcgatctcctgacttcgtgatccacccgcctcagcctcccaaagtttttacaggcatgagccaccgcgcccggccatgggtttttatttttaaggggcacagtaagatattctatttgtctgaaactacctatgtatgcagacttttggggaacctaaaatttatactgtgtggatcccaaatacttgcatccagatcatgtgtggtaactatttaaaatgcagattcctgctgggcactttaggaggccgaagtgggaggatcacttgagcctagagttcaagaccagactgggcaatgtagtgagaccctgtctctaagaaaaatttaaaaattaaccagatatagtgattacggctcactgcaacctccccttcctgggctcaagccattctcccgcctcagccatctgagtagttgggactataggtctgtgccaccatgctcagctaatttttttttttttttttagaggtgggtttcgtcatgttgctcaggatggtctcaaacttctggactcatgcaatccgccagcctcagcctcccaaagtgcttgattacagcatgagtcactgtggcccataaaaccattttgttgcataccaaaagtaagatggtggtgtcttgaagaaaaagaacttgagtgactatttgaattggaagctgaactagatgctcttttttcatgcaacatcatttttatttgaaagtataagggacaaactatggctatttgtatgtaagtatttagcagaaatttatttgaaaacaaaggagacttgtcacttcaaggaagacaatttatcatttgttgccaatgataaaatttgaccttttaagaaaaaagcagaatattggaaaacttgtacctgctactctgagcttgacagcttcccaatattaaagacttttctgatgagatcggtaatttttaaaaaattgtataataaaatatattaacatttggaagatctacatagctcagtgaactgatactttcccaaatgaacaatacatgtcttaagtcacacatgggtaagagatccattcaaagtgcaagataggctgctttgcctatggagtagccattcttttattcctttactttcttaataaacttgctttcactttactcaaaacaacaaaaataaaacaaagtgcaagacagaaaaatggattttaatagtatcagaatatgtgaagtttactgatatattttcaaactgcacattgcaatccactttttttttgagacagccctccaaatttgagaacagctggtatggaggctacaacaggatttgaagatagaaaacctaaattcaagttccagttctgtcacttacctgactgattttagacaagttacttaggtgcaggctctgaagtcacactgtgtgggttcgtgattttagctccaccccttgctaaatcggcctgcctgggcctcccaaagtgctgagattaacaggcgtgagccgctgtgcccggccttgcagaagctattctaagtgtaataaatttgaagggaaggtgttaacttggggatatttgtgtgtggctgttaatttgcaaagagaataaatgtgttataaaaaattgttttctttttctgtttgtgaagaaataacaaaactgaaataggccgggcaaggtggctcacgcctgtaatcccagcactttgggaggccgaggcgggtggatcacgaggtcaagagatcgagaccatcctggccaacatggtgaaaccccgtctctagtaaaaatacaaaaattagctgggcgcggtggcgcatgcctataatcccagctattccggaggctgaggcaggagaatcgcttgaatctgggaggcggaggttgcagtgagccgagatcgtgctactgcactccagccgggtgacatagtgagactccgtctcaaaaacaaaaaacaaaaaacaaaaacacaaaaactgaaaaaaaatgccctataatctagttagaatataggaaaatatctttttaaataccaaaaggtattaaaatgaaatactaaggagagtcgggcagggcctgtactcgacctcatgactgcgggaaatttctctttttttctttttttgagatggagtctccctctgttgcccaggctggagtgcagtggctgcgatcttggctcactgcaacctccgcctcccgggttcaagtgatcctcccacctcagcctcccaagcagctggaattacaggcgcgagccaccacccccggctaatttttatatttttagtagagatgccgtttcaccatgttggccaggctggtcttgaactcctggcctcccaaagtgttgggattacaagcgtgagccactgcgtccagcccctttcaacttttcacctcagttatgtcttcctgtttggacagcagtatctcatctccaacctccctggcatcttttaaatcctgttaaggttgcctctacaaaacaaaacaaaaaaaaattattaattttattgtttgtttagagactagtgtcgcagtgttacccaggctggagtgcactggcgccatctgggctcatgcagctggcaccaatgggctggggcgctccttcagcctcagcctcctgagtagctcagacccaggcgctgacaccacgcccgacacctctacattttttagggatacctttttggtaacctctaaatcataataaatgcacggaggacgggccaaagcctttttgcctggcaaatgctagtgacacccgttctcagcacccagaagcagaggccaggagcggggcggctgtggctgcgccctccgccctactccgctaatcccggggccgcgcagtccctgcgtccggtgatcaccgcgctgctcctggcgcactagtagggtctgtagcgtatcccgaggatcattccgactttcccgccccgtacgtgaggggccgccttgaagcctcttccgccacggacactcgaaactgatcttgaagcccctgccgtcacggatactagaaactgatctcgaagccccttccgccacggacactcgaaactctcccccactgttagacctcagcagccagcagcccgccgcccggcgctgcagctccctgcccgcaggagccacgtctcgcgcgactccccccacctctcgcgacacttgccgcccgtgccctgcggccctgcacgccccacccgcggtcgcgcgccgcgctccccgccgcctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccaggtgagaccgcgtcgggcgggcggctggaccgagggaggccaggctgggtgcaggtgggcggcgcagcgctgcggggccgggatgcggggcgggggaacctcggctcccgggaagccccgagcctgggggaaccctgggcaccctgtgaaccctgtggtctgcactggctgccctgctgctgtcgcggggctgcgggcggacgacctgagcccgagctccgagggcccggagcggggcgccagggcctagggtcgcgggggccaggggcgcgccagggtggctgaggtaagtctgtgtggggaaaaggacaatggagccgaaagccggcgtctgccgtcccgccgggcccgcgcgagatgccctcctgccccccgccctacgaggcagcttagaagtgtccttctggtgcctgcggcgctgatcgttgccgagtggaaggagtgttggagaggtagaaacagctggtcagagccgcctctgcgggaggaggcttttgaggtcgcttgttagctttcatctgagattctggctatgggagtgggcgtgcgtgtgcgcaccgtggccccaggcgaggtttcgtcttttcccaatttgtaccaccacccattaagcgacttcaaggatccatcaaaaatgattggttcctaagcgaacagttttattttttgtattttaagattccattagttgtgtaatggtaggggcctggagcccaaaaccttggcgttactaggacagggcatgacccagctgacttggagtaaattttctgcctttaactacatttagattggaaattagggtaaaatgtttttgttgcaatctagtttcgagcatgtggtcctgtgattctgggtttgttttataacttatggactgagtaaaattacccagtttactgagagaattgagaactctgtgcaatggttgatctaatagaagcattttatttaaagcttccacccatccagttgctaatttatgttatttctcttttaaattatgtagattttgttgttgttgttgttgcagaaatggctccgtaaaatgattagttttgtgcgtgtgtgtgtgcgaacagttacacagttaagttcgttttcctgatagttttcttttgtctttagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggtaggtgaaaattatgacttggaatagacaaagactctcccctcttcaaactataatataatggtccttatagtgagtgctatgaaaaccaaattttagatttttccagttacataatttcttacagcattttatatagaacttctgcactaatacctagccaatcaataatattcaagaatttggtctgtattttgaaaacagtatctattattatttctgcatagttacccaataatttttttttccttagagttgggggcctaattatattgtctaggctggtcttgaactcctaggttcaagcaatctttctgactgggcctcccaaagtgctgggattacaggcgtgttacaccctgtgcccagccccccagtaatatctttaatgttctagcttatgttttactttgttttataaagaatgtgtaaggctgggcacagtggctcacacctgtaatcccagcactttgggaggccaaggcgagcagatcacttgaggtcagagtttgagattagcctggccagcaatggtgaaaccccttctctactaaaaatacaaaaattagctgggcggcggggtttgtgcctgtagtctcagctacctgggaggctgaggcaggagaattgctcaaacccgggaggcggaggttacagtgagccaagattgtgccactggactccagcctgggtgatagagtgagacttgtctcaaaaaaaaaaaaagaaaagaaaagaaaaaagtatgtatagagtggggtgcagaagaatgaactctctaacttgtcacttgtcttttcttcttttataaaacaagaatgattctatttatactgaatcatcatgatggttattaatttaccttatggttcctcaagcaaattcagaaaaatcacattatataatttttttaaggggcactgctatctttccccagaaaaagaacaaaactgggtagtatttttttcatatttcattaaaatcaggaatggttttgacggtttgtaaagtaggtagtgaaaaagatatgaattaaattccattttgtttggtgtttagtcaagtaggaacttttcattcatgtgtttcataacattatttagagtataactgagaattgtatgttgggagatttattttgaaatatgtacttcttttccccttttcaatccttgaaaggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggtattcttttgactctttttttacttattctttctttctcttatttaataatcttttctttcctttgtaatttattttgtgaaatttccagaaagactttggttctgtctgcatcacattataaaacataataaagcatttctatttacaagcaagtttcaggataaagtagtcttattttcagattttttttttttttttgagacggagtctcgctctgttgcccaggctggagtgcagtggtgcgatcttggctcactgcaacctccacctccccggttcaagtgattctcatgcctcagcctcccaagtagctgggattacaggtggccgccaccacacctggctaattttttttaaggggcactgctatctttcctcagaaaaagaacaaaactgtttgggtagtattttttttcatgtttcattaaaatcaggaatggtttgacggtttgtaaagtaggtagtgaaaaagatatgaattagattccattttgtttggtgtttagccaagtaggaactgttcattcatgtgtttcataacattatttagaatataactcagaattgtatgttgggagatttattttgaaatatgtacttcttttccccttttcaatccttgaaaggaaaatattgtaatgggagagttgttcctactgatttttattagagatggggtttcaccatgttggctaggcttgtctcgaactcctgacctcaaatgatctgctggcctcggcctcccaaagtgctgggattacaggtgtgagctactgtgcttggcctttttcagattttaaaatacgatggaaatggttgtggtgttttaaggtgtaaaaaaagaaaaaaatactccgggcctggtggctcacgcctgtaatcccagcagtttggggggctgaggtgggcggatcacctgaggttgggagtttgagaccagcctgaccaacatggagaaacctcgtctctactaaaaatacaaaattagctgggcacggtggtgcacgcctgtaatcccagctacttgggaggctgaggcaagagaattgcttgaacccgggaggtggaggttgtggtgagtggagatcgcaccattgaactacagcctgggcaacgagcaaaactccatctcaaaaaaaaaaaaaaaaactggtgggcacagtggctctcacctgtaatcccagcacattgtgaggccaaggcaggaggatgacttgagcccaggaatttgagaacagcctgggcaacaaagcaagaccccaccactacaaaaaaaagtacacgcgcacacacacacacacacacacacacacaaatacaaatgcaaactgtattatgctatggtcacaggattgatcttttttagcttttatttttcttgctctgaaaactgaaatttttctttaaattggagtagagcgttagtattttttgttgttgttgaaacaagagtgtcgttctgtttcccaggctggagtgcagtggcacgatcttggctcattgcaagctctgcctcctgggttcttgccattctcctgtctcagcctcccaagtagctgggactacaggcgcccgccaccacgcccagctaattttttgtatttttagtagagacggggtttcaccgtgttagccaggatggtctcaagctcctgacctcgtgatccgcccgcctcggcctcccaaagtgctgggattacaggcgtgagccaccacgcccagcctttttcttgtttttggttttttttttttgctttttttgtttttgtttttgtttttgtttttgagacagagtctcactctgttgcccaggctggagtccagtggtgcgatctcggctcactgcaacctctgcatcctgggttcaagcacttttcctgcctcaccctcctaagtagctgggattacaagcgtgcctcaccacactggctaattttttttttttgagacggagttccactcttgtttcccaggctgtagtgtagtggcgcgatctcagctcaccgcaacctctgcctcctgggttcaagcgattctcctgcctcagcctcccgagtagctgggattacaggcatgtgccacaatgcctggctaattttgtatttgtagtagagatgggatgggatttcttcatgttggtcaggctggtctcgaactcccaacctcaggtgatccacccgccttggccttccaaagtgctgggattataggcgtgagccaccgcgcccggctcacactggctaatttttgtatttttagtaaaaatggggttttgccgtgttggccaggctggtctcgaatgccagacctcaggtgatcttcctgccttggcctcccaaagtattgtgattacaggcatgagccaccacgcctggtctagaacattaatattaatatattaaaatgtgaacactaattatctagcgtagatgatggaattaggagtatttttccccctttgtcctggtgctactatcagttgtaatttcaaaataatttaaaaataggctgggtgctgtggctcatgcttgtaatcccagcactttgggaggccgaggcaggcagatcacctgaggtcaggagtttgagaccagcctagccattatggccaaaccccgtatctactaaaactacaaaagttagccgaatgtggtggcgggtgcctgtaatcccagctacttgggagactgaggcaagagaactgcttgaacctggggggcggaggttgcagtgagccgagattgtgccactgcaacccagcctgggcgacagagtaagacaaacaaaacaaaacaaacaacaacaacaacaaaaagatttaaaaataaatttgataaattggagtaggatattcttattgaaactcattaatacatagtattcttgttaataggttcagtttaataggaaagctactagagaactctaatgaaatgtgttttcttttaaggaaacttacatgcttgctgtaactttggatgaatggaaaaagaaactggaatctcccaacagagaaattattattttacacaatccaaaggtaaaacaaagcatttctcttgtcgggataaaaagttaattgcgctattagggagaactcaattggtttcttttgctaagcactctgtgtaggataacctttgtcaaattttatattgaattcacagttatgaaacttaaaaacttgtagccactactgttatttacccaactcagcttatacaaaataattttcttatggaaaattatgccactgtagaataagaaaatcactgacatattatgtgagcatgtcttccatgtagaaagggactattgacagatctgttagcctaatatattttcacggttctcatttcaagccatacgagttgtatatcaaaactccagttcagattttactgtgtggtttgaaagacatgattctacacttaaaactgcattgtatagagatgattgtattgcagaatatttttattgctctgatctgttctgtttaagcttatggtgcattaccagccagttgcagggtctgatgattggggttcaacacccacggagcagggtcgaccaagaactgtgaagagaggagttgagaacatctctgttgacattcattgtggtaatgttaatcgtttattttttcttacctttggatgtatttgtttactccttaaattgtgacctttttctgtggatttagattacctcaaggcttaaaaatcatctttaatcatatgggtttattccaagttgagattagcatcacttcgtctactaagaatcttaatagatgtaaaaatatcttttaaaacatatggtaggatgggtaaaatttggcaatactatccaggaagtcactaagtacagatgaactgatttagtcctaattccaagaagtgtgattccacctacttgactagaaatttatacctggtaataactccttgtccttgaagattttcaactaaggaaaactgtttttcagcaggacctgattatgcactgctatctaggtagggtcacttatggttttataatatatttaattggattataatattccttttttcttgtctcttggacaaaatcctagctttactgtaatttaaaaagatgagtttaaaatttcaggctttaaaaacataccaaacattgataaaaatgaaatactagataaaagtattttatcaatgttcagttgcctggattcaataactgtattatggttatgtaagataatatacttaggaaatacacattatggtattaaagggttaaagaggtatggtgcatgcaacctgatgatgtatgtagtctgctttctaatgattcagaaaaataaatgtgtgtgtgtgtgtgtgtacacacacagagaatcataaagcaaatgtaattgttaaaaagttgaatctctgtaaaaagtatgtgggagtgtctgtactatgctttctagttttctgtacatttctagttatttagaaataaaaagttttaaaaacctggctgcacgtggtagctcatgcctgtaatcccagcacttggggaggccaaggtggaaggatcacttgagcccaggagttcgagaccagcctgggcaatatggcgaaaccctgtctgtacaaaaaatacaaaaattaactgggcatggtagcacacatctgtagtctcagctattttggaggctgaggcaggaggatcactcgagcccagaaggttgaggctggaatgagtgtttatcatgccactgcactccagcctaggcgacagagtgagactctgtctcaaaaaaaaaaaaaaaaaagtttttaaaacctgaaaaaaggccaagtgtgttggctcacggctgtaatcccagcactttgggaggctgaggcgggcgggtcaggaggtcgagaccattctggctaacacggtgaaacaccctgtctctactaaaactacaaaaaattagccaggtgtggtggcgtgtgcgtgtagtcccaactactcgggaggctgaggcaggagaatcgcttaaacccgggaggcagaggttgcagtgagccaagatcgtgccactgcactccagcctgggtgacagagcaagactctgtcacaaacaaaaaaaaaaccataatttaaaaaaaaaaaaaaaagagtttttttttttggagacagagtcttgctctgtcacccaggctggagtgcagtggtgtgatctcggctcactgcaacctctgccacctccagggttcaagtgattcttctgcctcagcctcgcgagtagctgggattacaggcatgtgccaccacacccggctaattttgtatttttagtagagatgaagtttcaccgtgttggtcaggctggtctcgaactcctgacctcatgatctacctgccttggcctcccaaagtgctgggattacagccgtgagccaccgcgcccagccgagttttctttttcagagatcagaaaaaaaagaaaaaagtcctgaaaaaaattttacagacttatttcaagataaattagaaaccaagtaaaatcagtgtatttttgctaggtacttaaaggactattttgtatcttttaaattatctgttcatcttttaacttgctcatatttataaccttttcatgatgaatgatattagaatacatgactaattatacagaataattttctttttaatttcatttataggagaacctttacaaatagatcacttggtttttgtagtccatgggattggaccagcttgtgatctccgctttcgaagcattgtacagtgtggtaggtttgcaaagcatgtgagagaatattaatcagtgctcttgtgagctgagataaagccttgtctttggtctattgtcttagctgcataagaagatttggagagttaaagacaggtggcaaggtagtaaagcttctcagcttagacctgaagtgctaggaaattcctgagtctaatagtttatactcttaactattgtaatagtctcaaatgaacaagcagttaatccctataaaattgtgttttatgatgtggtggtcctatttctaactatttcaaatttacagggaaccataaagatgatagagtttaatgaataacagaagcatcaatcatttttgtaattcatactgtgataaacctttgatattgtaattggaggatttaagtcattagtataactagattttgaaaggtgtcctctaggctgggtgcggtggctcacgcctgtaatcccagcactttgggaggccaaggcaggtggatcatgaggtcacgagttcaagaccagcctggccaagattgtgaaacgctgtctctactaaaaatacaaaaattagccgggcgcagtggcaggcgcctgtaatcccagctactcgggaggctgaggcaagagaatcacttaaactcggagggcagaggttgcagtgagccgagatcgggccactgcactccagcctaggcaacagagtgagacctcaaaaaaaaaaaaaaaaaaaggtgtcctctaaaacctgatagtattcaaagtttaattgttccaattagggtgtcttattctaactggctaatggttctaaacataaactagaattgtattgtggaaggttgagactgatgtgatatgaatttcaaacaacagtgtatttttttttctttaaagtattgggtggtgcttgtttataagaaccagaaagttagggtaggaattcaactgcaagactgttgttatattgtcatgtgattaaaaaaaaaatgaaacagttctcatgatgccgacgttttgaagtttagctttctttttttttccttttcctttttttttgtttttaaatatattattttctttcctgagacaagagctttgctctgttgcccaggctggagtgtagtggtgtaaactcagctcactgcaacttctgcctcccgggttcaagtgattatcctgcctcagcctcctgagtagctgggattacaggcgcacaccaccatgcctggctaatttttgtatttttagtagatggggtttcgccatgttggccaggctggtcttgaactcctggcctcataaaatccacctgccttggccccccaaagtgctgggattacaggcatgagccactgctcctggcctgaagttagccttcttttgatgaaatattttgtatggtaaaagcaagttgttaggccaggcacggtggctcacacctgtaatcccagcactttggggggccaaggcaggcagatcacctaaagtcaggagttcaggaccagcctggccaacaggacaaaaccccatctgtactaaaaatacaaaaattagctgggcatggtggtatgtgcctgtaatcccagatcctcaagaggctgaggcaggagaattgcttaaaccagtgaggtggaggctgcagtgaggtgagatctcgccactgcaccccagcttgggttacagagcagtactccatctcaaaaaaaaaaagttattaaagaaacatcttttcctatatgcattcataatttttcctgaataccactttatttttgacggaagtcagtatgtgttctgtgcaaatgtagttagagtataattacatgatttgttgcatccagattctacagatttgttacttcattgttgatgcataagttaattttcttttccagttaatgattttcgcagtgtttccttgaacttgctacagacacattttaagaaagcccaagaaaatcagcagattgggagggtagaatttcttccagtcaactggcacagtcctttgcattctactggtgtggatgtgtgagtaatacttaataccttcgagttgttagctgtgattatattttctgatcattgctatgcttggggacgtttttatgctatagctgactgaatatttaaaatttcttagagatatgctattaaatgctgatcagtcccttggtttaattagccctggttaggagtggagagctgtgtgtatcttcagtatgttttactggctcactagtatttactgttacagcttcattgtatctttagcattaaagccaaatattgctatcttcccatagtgtataaccatttccatcttcagatgtcaaaagctagccataccccaagatgtacaaagtattttgttgttccttttgttattatatttaaataatatttgtccaaatttagaaaaaaggggggatttctcaaacattaaactactagcatttaaaacttgaggtataattggtacagtgacttttaagtgatggctttcttaaggtacaagaccattagttttgtttgtaaattttatggtaatgacagagaatgttgcttaaattgaggatatctagctatggggctctccagcaagtagtgtgtttctaatgtagttctagaatagaaccaggagatgcaggaagtagtcagcattgtttccatgctggtctcagaaatggcttttctgattctgtgtctcagttctcagtaccctgtgatttgggtatattctgtttgccaaacactgtggtggggtccggattcttcaatatttgagcagatgctaagaggttactaagggcacgtagcccttataaattgcagaagtggttgaatatttgaggaatctttctgggaattttaagaaacctttaactggatgttagattttgtcagcgtggtcttcctctcccagatatgaattctgtttgcttttggcacctggcactcacacctttttctgcttttagaaattgtgcattgagagagggagctgatctctttatcgtttgacctgtaattaaaaaaccttactgctgagaattccaggaaaagccttttacattttttgttttgtctttttagaaaacttttttttattagagataattttgttcacagaagtagtatatatgatgaatccttgtatactgattacccagccctaacaagcctcaacacatggctggttctgcctcaaccgtatcttcataccttatctaatgccccttcatcaccatatgatttttatcttagacatcctgtaatttcatctgtaaatgtttcagtttgtatcttttttttttggttggagtgcagtggtgtgatcacagctcactgcagcctggacctccctgggctcagatgatcctcctgccccagcctcccaagtactgctgggactacaggcatgtggcaccacttgcagctgattttttttatcttttttttttttttttgagatggagttttgctcttgtccaggctggagtgcagtggcgtgatctcagctcaccgcaacctccgactcccgggttcaagcagttcccagtcttggcctcccgagtagctgggattacaggcatgcgccaccatgcctggctaattttgtatttttggtagagacagggtttctccacgttggtcaggctggtctcgaactcttgacctcaggtgatccgcccgtcttggcctccccaagtgctgggattacaggcgtgagccaccatgcctggcccaatccagctgatttttctattttttgtagagatgggcttttaccatgttggccaagctggttttgaactcctgggctcaagcaatctgtctgctttggcctcttaaagtgctgggattacaggtgtgagccacagtgcctggcctgaacagtatattttattttttattttatttttgagatggagtgtcgctctgtcacccaggctggagtgcagtggcacggtctcggctcactgcaacctctgcctcctgggttccagcaattctcctgcctcagcctcccaggtggctgggactacagtcatgcgccacaatgcccagctaattttcgtatttcttagtagagacagggtttcaccatattggccaggctggactcctgacctcatgatctgcccgcctcagcctcccaaagtgctgggattacaggtgtgagccactgcgccggcctgaacagtattttttttgttgttttttttgagacagagtcttgcactgttgcctgggctggagtgcaatggcacaatttcggctcactgcaacttccgcctcctgggttcatgtgattctcctgcctcagcctcccaagtagctggggtaaaggtgcacatcaccacacccggctaattttttgtatttttagtagagacggggtttcactctgttggacagactggtctcgaactttggacctcgtgatctgcccgcctcagcctcccaaagtgctggcattacaggcgtgagccaccgctcctggccctgaacagtatattttaaaggacttaaaaaatgtataaccataacactattatcacacttaaaaatttcttaatatcatcaaatacctagtctgttcaaatttccagttgtctattatatttttatacatattttatacatatttttatatacattaattatataattatatacattaatttttgtatacatatttatataattacaaacatgttttaaactgggatccaaataaagcccataccttgcaattagttgatatgtcttttattataagtctctcttgggctgggcatggtggctcatgcttgtaatcccagcactttgggaggccgaggcaggtagatcatctgaggtcaggagtttgagaccagcctggctaacatgacaaaaccctgtcactactaaaaatacaaaaattagctgggcatggtggcacatgcctgcaattccagctatttgggaggctggggcaggagaatcgcttgaacctgggaggcagaggttacagtgagctgagatcgtgccactgccctccagcctgggcaatagagcgagagtctgtctcaaaaaaaaaaaaaaagaaaagtctctttaatttattttcttgattaccacttacctctctgtctacatctgttgttttcttgcagtttatttatggaagaaatgggtttgacttgagggttttttatactctgaattttgcttatcacattcctctggcttcattacacatgttcctttgtcctctttttgttttttcctataaatcgacaattgtttgttataaaatgtttaagcttgaaggcttaaaattggaagcagctattaagtgtatttaggtttcctgcttatattatttttccttttttcagagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggtaacaaaatgagttctgtgtgaccagagaagactatcacattttaaagacacctgtttttgaagcacaatgtcttttatcagtatgaaattcagaggtctagaagtggtctgtggtcaggaaatttggaaggggttggaagggtggcggtaaattggaaagaaagactccttgctgtatagatttgcttacatatgtaattggcttatgccttttttgtataacagagagccatttagtgctaatgcttagaaattgtcccttcttctattttacttataggttcgcttatattgtttgatatcctaacaaatcagaaagattctttgggggatattgacagtgaaaaggtaatttagatgttcagctaggttttcttgtagttttccttagtaaggatttatagattttagacttattttttgtttttagctgagtttagtttcatgtcatgacattacatttacacttattttcattttaacagacttttaattatctctgtcattcttggatgatagaaggaagatagtaacatgcttctacaaataataattgttatattctaaaccatagttatcttattttcttttgtgaatatgcaccactggctgggcgcggtggctcatgcctgtaatctcagcactttgagaggctgagactggtggatcaccttaggtcaggagttcaagaccagcttggccaacatggtgaaaccccatctgtactaaaaatacaaaaattagctgggcatggtggtgtgtgcctgtaatcccagctacttgggaggctgaggcaagagaatcgcttgaacctgggaggtggaggttcagtgagctgagatcgtgccactgcactctagcctgggtgacagagtgagactccgtctcaaaaatatgcactgctgatctgttaatagagttatggaatcattgagctaaatgaagtttgcatatgaacaaatgaatgaattggctacaaattgatatgatttatagaaactctgttcgaaagtattggggacttgatgtttaaacattattttagtaaaaattcctataaccatgtatcatctgtaggattgatttggtacctatttctcctgttggaccatgagttcctccagagcagagcttttgtcttagactattttatttctatttctatttcttttttttctttctttttttttttttttttgagacagtctcttgctctgtcacccaggctggaatgcagtggcatgatctcggctcactgcaacctctgcctgcagggttcaaatgattctcctgcttcagcctccccagtagctgggacaggcgcatgccaccgtacccggctaatttttgtatctttagtagagacagggtgttggtcagactggtcttgaactcctgaccttgtgatccgcccacctcggcctcccaaagtgctgggattacagatgtgagccaccatgcccagcctagactgttttatttcttaagcactgttttcctaatttcttaagcactgagctcccttaaaattcagcaaatgtttgttaatgatgatgaatattttactaatttctttaaaaacatattttcaattgaagttgcaaaaccttggaacctcttaatttatatcttgcataaatgacaatttgttaaagttaagatacattgctgtggaaatctatgtatttctttactgcaaaatagtattaaaggaaactaaatgaatttcaagaatatgagctttataatttaatttttaggattcgctaaatattgtaatggatcaaggagatacacctacactagaggaagatttgaagaaacttcagctctctgaattctttgatatctttgagaaggagaaagtagataaggaagctctggtaaaaataatcttttaaaactttatgccaagccattttcagtatttttgtttatcgtgtttactaagagcctaccctttagacactttttagtcataaatactttatgattaatgttccttagcattatttatttgctttttatcatatcaagtgacctttgctttgtggaagttcaaaggtcagatggccatattgatattcatagagcaatggagcagactaaccagtacggctcatagaaaacatgagtgcaagaacaaacaaataaataaccattagctattccaactctaattttctgttgtactttcaagagctctactgttatttgcgagtagctgggattacaggtgcccgccaccacgcctggctaattttgatatttttagtagagatggggtttcactgtattggccaagctggtctcttggccaggctggtctggaattcctgaccccgtgatccacccaccttggcctcccaaagtgctgggattacatgtgtgagccaccgtgcccagccagctgatttgtttttttttttttttttccatttttgtcgtgcctttttctggtttgtgatacattcactcatttaacagatatttagaaaatgcttactataccaagtactggatagactggtgaataagacatatgatccctgacctcatagtgtttatagtttactggggaagacacatgttaaataatcacacacatcatggcaattacaataagtaagtaggaaaagtacaccgtgttgtaagaattaacctggtctcataaggtgcaggaaggcttccctaatcaaatgagtgatagctggctgggtgtggtggctcatgcctgtaatcccagcactttgggaggccgaggtgggcagatcacgaggtcaggagttcgagaccaatctagtcaacatggtgaaaccctgtctgtactaaaaatacaaaaattagctgggtgtggtggcacacacatgtagtcccagctacttgggaggctgaggcaggagaatcgcttgaacccaggaggtggaggttgcagtgagctgagatcacaccactgcactccagcctgggcgacagagcaagactccatctcaaaaaaaaaaaaaaaaaacgatgagtgacacttgagatcttgattgttagtctgttccatacttgtgtgtttgctgtatgttctcagtgcttgcgttcatcagcaggagtataatccttctcaggcatgtgacatctaagtcagtatagaaatcaaggaagtttttttgttttgttttgtttttttgagacggagtcttgctctgttgcccaggctggagtgcagtggcgcgatctcggctcactgcaagctctgccttccgggttcacgccattctcctgcctcagcctcctgtgtagctgggaatacaggtgactgccactgcgcctggctaattttttttgtatttttagtagagacggggtttcaccatggtctccatctcctgacctcatgatccacccgcctcggcctcccaaagtgctgggattacaggcgtgagccaccgcgcctggccagaaatcaaggaagatttttatgtcctgaagtccttagatacccaacttctctgttttttttttttttttttaacaataacaatgtctatattattgtaacattgatattataagtattgatattttctattcttttttaggctgtttcatgaataaaacaggtccttttttctggaagttattctatgatgttttactactagagagacaggcagcaacagagtgcctaggccttgttcctcttaggggacaggattgattttattttgtctagaaataagaaagacttgattttctatgcctaggctttatgtacagaccgagatcttcaggaaataggaattcctttaggaccaagaaagaagatattaaactatttcagcaccagaaaaaactcaatggtatgtgcctaatacagcttgttggactaaacaattctttgatgtccatagtgtgtccttgtgctttgtgggatgtttactctggggagccaagcagttttttggtaattgatctttggctctttttttttgagacagggtctcgctctgtcactcaggctggagtgcagtggtgtgatcccagctcattgcaacctctgcctcccgggttcaagcgattctcctgcctcagcctctcgagtagctgggactacaggcgcccaccaccatgcctggctaatttttgtatttttaatagagacggtgtttcaccatattggccaggctggtctcaaactcctgaccttgtgatctgcccgccttggcctcccaaagtgctgggattacaggtgtgagccacccgcctggccgatctttggctctctttctagaaattaaacacattttcttttttacattcttttttttttcttttcctggaaatgaaatctcgctgtgttgcccggggtggagtatagtgggtggtctcggctcactgcaacctccaccttccaggttcaagcaattctcctgcttcatcctcttgagtagctgggattccaggtgtgcaccaccatgcccagctaactttttgtatttttagtagagacggggtttcactatgttggccaggctggtcttgaactcctgacctcagatgacccatgtgcctcagcctcccaaagtgctgcaccgctcctggcccttctttttttacatccttaaaagtattattagcttcagaagtcttctctcctctggaattctcctaccatttatttatttatttattttttgcttttttcttttcatgagagttttaccaatatctacttcacatcacataccataaaattcacccttttaaagtttacaatttaatggtttttagtatattcatagagttatgtaaccattaccactatccaatttcagcacatttccattgtcccttagggaaaccccatacccatttgctgtcactccccattgctccctgcccccagcctctgtcaaccactaatctactttctgtttctacagatttgcttattttggacattccatataaatggaatgtccttttgagccatgtgtctgacttctttcacttagcataatattctgaaggtttacctgtgttaacagtacttccacattcagtttttctggtcactgaatttctaactccatatcttattagttagtttttttctttttgagtcggagtgttgctctgtcgcccaggatggagtgcagttgcacgatcttggctcaattgcaacctccgcctcctggattcaagtgattctcctgcttcagcttcctgagtagctgggattacagacacgcgacaccacacccagctaatttttgtatttttagtatggggtttcaccatgttggccaggctggtcttgagctcctgacctcaagtgatccgcccacctcagcctcccaaagtgctgggattacaggcgtgagccaccatgcctggccagtagttagttcttttccaactttttagcaggtggctcatttctttttaaagactcagttcttggcccagcccatcgacatcctacttcccttgattacagaggcacagcacttcatagaactctagcaatcctcagcattatcttcccacagtgccctgctattgttttctcttatgattgttgcctaaagtttcaacgctactgaaatggctatgtacaactttcatcattttagagcatctaagaatgtcaattaacaatttaaggcaataatttaatcttgttttctgaggaaatcttcctagaatttttggctgccatttcagaactttcccaagggtcctttcaaaccagtagaaaactatataatcctttggctatacttttactatatagtagctccccatactttttttttaaatagagactatgttgcccacgttggacttgaactcttgggcttaaacaatcctacctacctacctacctcagggtcctgagtagctgggactacaggtgcatgccgtcatgcccagcttctccacataactattttttattctttagggtattaagagaccagccccgcagcctgcttcaggggcaaacatccccaaagaatctgagttctgcagtagcagtaatactagaaatggtgactatctggatgttggcattgggcaggtaactaattctctttgatcattttacagcctgctatttgtatggtagaaacagatgtaacttttgttattaatgagagatgcttttattttcctcctttgaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcaccctgtaagcattgtacagctattgtggttttacctaaatatcagggcttattgttaaagaacataggattttctgttgtgttgatttttttttcctattccattgtctagcaatgagacaacttataatagtattgatttggaagtgatggagcagaactgtacatttttttaaatgaacttatgattattgtttaagatacatagttctggttgtacatggtgactaatgcctgtcatcccagcactttgggaggtcaaggcaggaggattgcttgagcctaggagttgaaggctacagtgagccatgattgcaccactgcactccagcctgggtgacagagcgagacctcatctcaaaaaaaaaaaaaaaaaagttatatagtttccagactgtgcttagcagaggtaaatgtagctcttgtttttcctatgtagtttgatcctgtggcctataggattgaaccaatggtggtcccaggagtggaatttgagccaatgctgatcccacatcataaaggcaggaagcggatgcacttaggtaagtccgagcatagaacttgataattctagaccttttggccagtgcaaagggcatcattcactctgttcagctatgttggaccctaagctctttgtaaatcatttaatgttctttatttatatgtttcagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtggtcagtgacactgtacacattgaccagctgccagataagagggatgccatggtgtggcgtttttcatagttaatttaatttaatttcacatttaatttcatagttaatattgcattcttttgctttagttttcaacttctaaagagctctattcctgcttgcatttagtataaacccaaggcaaatgacctagctatcaatggtataggtaatgagatgtgttgcgcaaaagcaaaaaaggggattggacaaaattactgtgacctgagaaggagcttgaaggagattgagaggaggaagatgggagagagctctctgaacagagagtagctcattctctggtaaacttggagtgtgaggagaagttaacaggataaccctgaaggccaaaaggttttagattcttattatggttcttccatatccagatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactggtaaatgttgtttatttttgtctgttttgtttgtttacctgtttcatagatatttgatagatgtagaaaaaggaggataggccaggtgcattggctcaggcttataatctcagcactttgggaggccaaggtgggaggattgcttgagttcaggagtttgagaccggcctgggaaacatagcaagacctcatctctacaaaaactaaattagctgggcgtggtggtatgcgcttatagtcccagctacttgggaggctgaggcaggagagtcacttgagcccaggagtttgagaccacagtgagccatgatcacaccactgcactctagcctgggtgacagagcaagaccctgtctcaaaaaaaaaaaaagacctgtgtacctttggaattaaaatgacttctcatttagacagcacaagcacaatcatgtcatttcaagaatctggtttaaacacactgttgttttattttgcagctgggtagaacatggttgaggctaatgatgccaacaaccataagttcaattatcttggtgttaaaaatgtgtcttttggccatttaggtgcacatgaatgaactggaacaaatattactgttgctggaagtcttatagcaaacccatttgaaagcatttatggtagctgtgacagaattaattattattattttatcattatttgagacagggtcttgctgtgtcacccaggctggagtgcagtggcatgctcatggttcactgcagccttgacctcctggactcaagtgatcctcccccctcagtctccctaataagtaggatgaccgttgtgcaccaccatgcccagctaatttttgtacagacagggtttcgccatgttgcccaggctggtctaaacttcaagcaatcaatccgcctccacctctgcctcccaaagtgctggaattacaggcatgagccaccacgcctgggcagaattattattaaatataattggttacctgatggattgtagaatggattaatgatgcttattgaaattcaggccgggtatggtggctcatgcttataatcccagcactttgggaggccgaggaaggaggattgcttgaggccaggagttgaaggctgcagtgagccatgatggtgccaccgcaccctagcctgagtgacagagcgagaccatgtctgaaaaaaaatagtataaaataatactaattaatccctgaagaagttgacataaaaataaagtaagggaaataagatgggtcagagataagtgttttaaaaatgaaagctcagaccagcatggccaacatggcgaaatcctgtctctaccaaaaatacaattagccaggtgtggtggtgcatgcctgtagtcccagctactagggaggctgagacaggagaattgcctgaacctgggaggcagaggttgcagtgagcgagatcacggccaccgcagtccagcctgggtgacagagcgagactccatctcaaaaaaaaaaaaaaaaaaagcaagctcaaaggtcctaagaataatttttcccttgaattctgatgaggaattatcatctgatgcaatcactatcgtttgtatataatatatacagtagaggccaaaagcaatcttgtaaggggctaaaataatgctaagaatgatctctggtgatctggcttgatagaaaagaaagcagagttcttttaatatttctgtgtgggcagtacattcatatggtttgaaattcaaagaaagaaaaataatgaaaagcctcttttttattttgtttcttgcaatcagtttcttccccatatacaactaatgtaaaatgtcttccagccatctattttatgcctccataataaatatatgtatgtgaatatattctttcccttattttaaaaacataaatagtaaattaaaggcaatgttctgtgccttgttttttctactagtatatcttggcattttttaacctattatatgttgtttcctcatttttttttttagctgcatagtcttccgttatgtaaatacaccataatttatttaagccgtcctctactcatggactttcaggtttccttttcttttgcacacaccttgttcatgtcatttcacctactcatgagtatatctgtaatgtaaaatacttcgaattgaaatcaatggcataaagggtatatacatttgtaaaatttgataaatattgacaaataagaggttgtacctttttatactcccagcaataatgtacgaaagtgtgtgtttctccacagcttttccaacagttttaatatttttaaatctttgccaatttgttgggtgaaaatgtacaatatactgtacatattaaaagaatacacatttgatgagttttgacatgtatacacctgtgaagccatcactacaatcaacttaacatattcatcactctcaaaagtttccttgtgccttttgtaatccctcccttcttttctcttccccactcctcctaatttccagggagccactgctctgttctgccactgtagattagtttgcttatgacttgtatttggaatcctacagtatatacttttgttgtttggcgtttagcttatttatttatttatttatttttttgagatagtcttgttctgtcatccaggctggagtgcagtgacacaatcatggctcactgttgcctagatctctgggctcaagggatcctcttaggctcaagggatcctcccatctcagcctcccaagaagctgggactgcaggcatgtgccactgggcctaattttttttaaatttattttcgtagagatggggtctcactatgttgcccctgctggtgtcaaactcccggcctcaagcagtcctcttgctttggccccccaagctgttggtattatagacatgatcaatgttgtgtatatcaatagcatatcctttttattgctgagtagtattccattatatggatatatcagtttgtccatttacctgttgatggatattttgatagtttccagtttttggctattaacaaagctgctaggaacattcatgtataagactttacatggacatattcttgggtaaataggaatggaatgggtggatactatatggaagtgtatttttaaaagaaactgccaaactgttttgccaccagcagtttacatctccatcagcagtgtttgagagtttcagttgctccacatcaacttttttttattttttatttttatttttgtgaggcagtctcactctatcacccaggctggagtgcagtggtgcgattatagctcactgcagccttgaccttggactcaagccatcctcccatctcagcctcctgagcagctgggagtagctaggaccacaggtgtgtaacactatgcccagctaatttttcaaatttttttgtggaaatggggttttgccatgttgcccaggctggtcttgaactcctgggctccagtgatcctcccacttggcttcccaaagtgctgggattacaggtgtaagccaccatatctggccaacaagttttttttttttttttttttttttttttgagaaggagtctcactctgtcacccaggctggagtgctgtggcacgatcttggctcactgcaacctctgcctcccaggttcaagcaattcttgtacctcagcttcctgagtagctgggattacaggtgtgcgctaccatgcctagctaatttttgtattgttagtagagatggggtttcaccatgttggccaggctggtctcaaacttctgacctcaggtgatccacctgcccctgcctcccaaagtgctgggattacaggcatgagccactgcgcctgctcaaaatttttatttttatgtaatcaaatgtgttgtcatttgctttttggtttctggaatttgtgtcatactcagaaagatcttccttactttccaaaaaaattcttaccacagtattttttttttttttttttttgagatggaatctcaccctgttgcccaggccagagtgcaatggtgtgatctcggctcactgcaacctctgcctgccaggttcaagtgattctcctgcctcagcctcccaagtagccagcattacaggtgtgcaccaccatacctggctaattttgtctttttagtagagacagggtttcaccatgttggtcaggctggtctcaaactcctgacctcaagtgatcccacctcagcctcccaaagtgctgggattacaggcgtgagccactgcacccagccaacacagtatattgttatatatataattttttttagaaacaggatcttgcatgcagtggcttctcacaggcatgatcttagtgcactagacccttgaattcctgggctcaagcaatcctcttgccttggcctcctgagtagttgggactgcaggtgtgcaacaccatgcctggctattctaatattttatatctaatttttacatataaatctttgattcagattcaggtccttttttccccacgtctcaacactattaatagatttgagattctaaattaaattaattaaattcttttttttttttttgagacagagtcttgctgtgttgcccaggctgaagtgcagtagtgcagtagttggctcactgcaacctacgccatctgggttcaaatgattttcctgcctcagcttcttgagtagccgggactataggcatgtgccaccatgcccagctaatttttgtatttttagtagagatggggtttcactatgttggccaggctggtctcgaacgcctgacctcaggtgatctgcctgcctcgacctcccagtgttaggattataggtgtgagccaccgtgcctggccacttaattaaattcctatacataaatgggactatttctcaacttcttacttgttgatttgcttatttatgtaccattttaatatctgatagagctaattcccacttgttgatacaggaatttcttaagctggggtctgtgtatatgagtttgtgggagatgagggaagtctgtgaatccaatgaaatacacatttataattgtggttgcaatgtgatcctttctggggaagaatccgtaatttcattagattctcaaaaggatgcatgactcaataaatgttgaaccacagatctagaagaataatagaggcttatatccttaaggcagtccctcatgagtgttaatctttttaaatcaaattttgttatgaagtgtggatataagtaattgcttgtgcatacgtagaataatatctggaaaacgcatgagaaattgataacattggttgtcagaagatgggaactggtggtggttgaggaacaaaggtgggagggagacttcgttactttcttatattgttggaatttggaaccttatgattgtattaccttttccaaaaagtgcataatattttaaaaattaaggtgaccaactggataactcttcaatagtgtctctagaatgatctctgtggaaaaggaacaattcttggttatttcttactggctttttttttttttgaaatggagtctcactctgtcgcccaggctgaagtgcagtgacactctgcaaccttcggctcactgcaacctttgcctcctcggttcaagcgattctcctgcctcagcctcctgagtagctgggactacagtcgcatgctgccacgcctggctagttttttttttttttttttagacggagtctcgcctatctgccaggctggagtgcagtggtgcaatctcggctcactgcaacctccgcttcctgggttcaagcaattcttctgcctcagtctccccagtaactgggactacaggcgcataccaccacaccctgctaatttttgtatttttagtagagatggggtttcaccatattggccaggctggtctcaaactcctgaccttgtgatccacccaccttggcctcccaaagtgctgggactacaggcgtgagccaccgtgcccagccctagtttttgtatttttagtggagatggggtttcaccatgttggccaggctggctcaaattccagacctgtagtgacttgtccacctcagcctcccagagtgttaggattacaggcatgagccaccgcacctggcctctcttcctagcttttttatattactagacttaatgccagagttctttgccaggtcaccttccaaaccactgccaattacattacttctgaatctcatttctttgcagaagtaaaaaataaacttgcaagatggttgtatggattaaatgagataatatatgtaaaacatttggcacaagtgttagttccttttctcaacataattttttctctttatagggagtctgaagatacagtattgctcgtcctcaaagagatctaccaaacccagggtatcttccttgatcagcctttacagtaaaaatgacccatctatggctgcttaatgtaagttttaaaatgtcatatatatagtgtaattcttacatattaacatgttataatgaactatggagcctcaagctctttttaaatatactagctgttgcctgtcaccaagatctaggctgctattcatttttagagggactggtagaaattcatggggaaaaaaacacagtagcccatttagaggaagattagtgtatgtctgttttgctagagattttgtccaatgacacctgtcattttttaggatctaaactcagagttttaatggttctgttatctaagagttactgtggcaacagttatgattttaattaccaaccacccatcctgagatttaaattactcagccttttagatgtgaaattacaaagtctgtgtattcgactctggcattctctgtggttgccttccagttgtgactgcagctcttctcccactttcttccctagacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccatattgactagtggcctacttttacctggactcacccgtctcaaagtcaagaaaatcagtacagtcacgattttctctgtctttatgtattactaaaacaaaaaaataggttttgggcaaagaactaatatgtaagttctttcctgttgactggtattttaattgtcataggcagaatttaagttcagaatttaaagcatggcaattataagagactttcctttggtatttataaatattagccagtactatagataacagcagttgaatcacttagggcggatggggaattcaatgttttgctttactaaagttccagccccttaatgtactttaaatatttaaaaaagcacacatttaccattttatttgaatatcaggtttactgaaggaaaaagatacattgaaaatataggaacatacacataaaagacaatgtcatatttaaagtataatcacaataaagagaaagggagctgtaggtcctatggcatccattctgatgacatcccataattgttccttatattccattgtgaagaaggggcagaaaaagattcatctgtccttcagatgacgatacctgtcatttttcttttctaccttagtcacttggcagtgttggtgcatttgagcagatcttcagtcatgaatggaaggaaagaagctcacaagtacagttatggtcaaatgaggtagaaacagtcatctgttagtagtgctgaaaccacactcctgaccattttcttctttattattgttttcacttagtaattcaacaaattgtttatgcccacggtgttcaaaatgcacagcagtaccaga

SEQ ID NO: 154 - DNA, 48350 bp, Homo sapiens
agagatttctaaaagccaaaccattacatgttccacaatactaccaagacaccagagaatgagttgctaccctctcaaatcctaggtttataaaacataaatcttaaggatagcacgttatttactcttgataatccaagggcctgctgcagaggaatgaagttccaaagtaaaaatggaaaaaaaagtctggaaagtaaatcaattttaaaaacaaacattctgttaaattaaagcaaaatgaacccaaaacttaactaaatttccctggcatacagtggctctcaataaatatttgttgaatagattttatagtttataccttgtagttgtttatttttttaacagatggcaactacatgtggaatagcaatgttattgctttttaatcccagaatctgattcccaggattgtgagcgacccaaaggtataaatccaatcacccttctaaagcttgaattcactcaccatcaccaccactaaagtgacatccaaacaatatcaaactcctttaaggaagagaaactaggctctctgaaggcaataacctgtctacaggcaggaacaacatctgcaaagttgtttccaagtggcaatgctctccctgtagctgtcattttcttattgcatgctaatccctgcaaaaacaaagaaaatcaaattcttcccaagcccattcttcaagcgtttgatggcagctaacactgtcttctgtcttgcaggttaaacgttcctgacacttctcagatgacaagacccacttactatcctactggctctccttaacacaagtttcactttttctgcacaggttctagattaaggccttcattcattcttttcaggtctttgttcagctcattatcttcttggtgatgtctcttctatttaaagctgcatctctgtcttttgtagttccctattctgttttctatttttctccacagcacttataactacgtagcacatgacatttattgtattttcttcccactagcaagtaagctccatgatggcaggcattttatatggttcaccactgtatctccagggcaatcaatatttgttgaatgaatcaatgaacctgccatatgggtaagatcttacaatcaaggaggaagacagtaattcattccagttagagaagcaatgctgttaaagcagaggaagatgccacaaacctttggagggcctacatacactcccaatgccttaccctgaacttattttcacctacattattatggaagctaaactaagtatcccaccagtatttgtgaagctggttttatggacccgaacctagaaatttacatgactcccttctgaatttcacctgtggtccacttttttagtatattgatatcagatctttagtgaatataatggaattaactattctcttccagtgtggactgcccaaaactgttcatacttttcagtttttttctattcttttatttataaattgcaaattatctaaaatctattagtttactcacaactcccttgacagttgtgatagtggtagcggatagagaaaccagtactgggagaggaaaggatttctttgcacagtcatgcagaagtcagaaacctattgtacatgtgaaatatgcctaaatgtatcttgtattaatgtagtaatagcagttactgagattttcaattacactattatactatttttattacagctgtgatgcatcattgctgaaaatgaactatctgatctaagtgaggttcttaaactcgagtacgcattagaatcagctggaggacttggtgaaccagattgctgccccctcctcaagtttctgtaaactctgcagtgagcttaagaatttgcatttctaacaagttcccaggtgatgctgaggctgctcgaagatgcttttccctggggacagaaagtgaatgcaggtggtctgatgtaaaaggcacatgttctttttgaaaagtaactatgctctgcactgttctccaccctgacagagtctcattctgccaggctggtgtgcagtggcacaatctcggctcactgcaacctccgcctcccgtgctcaagcaattctcatgcttcaggctcccgagtagctggtattacaggaatgtgtcactacgcccggctaacttttgtatttttagtagagacggggttttaccatgttggccaggctggtctcaaactcctggcctcgggtcatctgtctgcctcagcttcccacagtgctgggattacaggggtgagccaccacacctggcctaactatgctttttaagcttaaacttttaaaaaggattgatatcaattattaggataattacacaattttttaccccttttgaacttcagcagaaaggcagcctacatcaaaacccttcaaactaaatactttttacacaagggagctactagctccaatatcagtacttcctaaatggaaacatccattcctacagctcaatatttctttttactcaaatcagatataccctggccatatcttcaccctcacacaactcctttttctttcctaattatgttgagatcacgtaaggtatcattcaaccaccctccagctagcactcccaatgcctttagctgggatttttcttccactgtgcatttctttaagcccttaaagctggactcatcctaatgctttgtcctttacttaaaaactagtgtttcaagctaactgcagggtagtggttaagaccatgagctgtggaaccagaacaagttcaaatataggttctgtgtgtcacataccagctgtttaactttgggcaagttactcagtctctctgcgtctccatttcttcatctcaagaatgaggataccaataatgcctatctcatagcattactgttaaggattaaatgagattctacctattaagggaatgtagcaacaccttgtgtattatagctaagattattaccacccctccctctattcctatcacacttgccagctttactcagcctgctaagcattcttgggtgacaaaaatatcttataacatagtacatagggatactacaaattcagggagccaaaaatagtaacactgaaatttacataatagtaaaatcaccactaatataaatgtcattggtggttaaattattttgttaataaatcacaagttagtacttaacatgtatcaagccttttgttaattttttacatttatctcatttaattagtctaagtatagacctatatttccagctatgccatgaacatcacccagaatctgttctatgacatattcaaaatctgtactcttctacttcaaacttaattcacctcattgtcattttccatctcactgaatgtcattattataacatagcggcccaagccagaaagcagggagtcattcttaactcttcactcttcctctactccccctgacccatacccacctcttctgtatccatggtgtgttggtaaattggagatgaactgaagataaaggttaggatgtagagaggttttaaaatcagtgttaccctggtcatggaaaaatgaagtagaaaattcacaccagcaagtgaaatcaaagaacatattatcttgtaggcgacccacccaattcacttgccactgccttcatttatattttcactttatcactcctggatcattgcaacagccttctaagtttcatgtgttaggttcagggtcaggttccagcccatgctgaggtctggagggagtgggtggatgagtggcaaacagctgaaagaaaactcagggagacataggtagatgaaatatggctttattcagaagctctctcatcagcacctctcttagagtgtccgctctgtctcagctgtttgagctggcagctcccacacacagctgtgctgctggctctcccttgccttcagggtcagcagcttaattttctctctctgggcacgagagtccctatatagtgtcagcagggcaatgataccttttacaaacaatagtggcttagagccaaatgatgagccttcccattttatggctacatggttgtggtaacggggagttatacacctgagctctaaactcgctgagtcactcagcctgtccttgacaaaagcacagccatgttccttacactccaccccctcggccaagggagacataggccttggatacacaggttatatacataagctttggtacataggctcgatatatatacacacaggctttatacataagttttgggtacataggtttgatatataggcttggcacacaagccttacattccaccccctaggctgatggagtccttttagtgaggaccggtgcacatagggctgcaccttggacctataggccacagcaacaatataaggagcaacaacatactactaatattcctgctatgctactcatgattattagagcccaatgtaggccagagcccagagatgcccaccatctcttccaggggtcatcatcaaggcgctcaatcaccttaacctcctgggacaccccttgtaaagctgccattatgttctggtggttgtcagggatgagttttcaacattgtgtccctacaagggcacaagtgccaccttgggcagctgtggctatgtctaaggccatccggttttgtagcaccaccttcctgatctgattaaccttatcagttaacaaaaggagggcaactcagatgcaattcagggcccgagctgtgtgctctgcaagggctgtaacttgcatttcctacagtaatgacacctgctccaggaacagttattgctaagggatagaaccacaagggggcccaccccactcacaaaaactggaaacgcagcaccctctagtcatgtaggtgaccaggcaatgtggaaagcacagtggcaggcacatggggccaccctcaggtacagtccaattggctggcagatatggccatcctgtgccctcacagacccatcaactcccagggggtacaaagtccactggggcccagccttggtaaggccgcttattccacaacacccttggtgtagtgatcgtgttatgtttgcacaaacctcagcaggcaaccatcccacagtgactttaccccagtgctgctctatacatggtggtgtccgcaatgggggcaccacgtgttctcccattagacagctccatccatcatggacgctagagtcagccagggggcaggcttgccatgggttttgtgacgcctcctattcaaagcttgatgtgttgcatcccacccactgtccacgaggcctggacagtgtgcagttctgcacagaagctggatgcacacgccagggcaagccatccgcagctgctgctggaaggacagtgccgatccaacagttagagacattggtcacctcagtaaggtgtggaaccagtccacaatgctactggagcatgccaacttacagctgaaacaacaaagcaagcacggatactaaccagggtaaatcacgtccctcaggcaaaattcaagtcaatttttcatccctggataacaatgcagctgccaagggcttctgccctgggtgatgatgctacacctcatcagctttctgtggttcccttgggtcctgcacccatgccaaagttacagggaagtttatgatagtccacacagacagtacatatgttcccggaggagggttccttccctggccgttcccctacgaacggctaattgtggaggtcacacattaaatacccaaggagtaacatgtaagttatactgcagacccttccccacaggaggccacaatcgccaaccatctgcaatgaggggcttggagggtccatggctgacaccaggttttgtctccctacttttaggggtattggggcaggtaataacagattatctctcatcctcgtaactggttggagaaggtcatccttcctctcatggatccggccacatggcctggccctatgtgggttggtgactaggtaattctataactttcacataattaacaacaaggttaagcctcaataaactgcccagctacagctgcagattactgtaggtgtcaccttcttggtgatcaccatccacattgctctgagtttagctcattagctactttgcccacacttggtatcaaaccatatagtgtcagtagaatggccggactgtgacaacagtccaggcagcacaagtatctcgactagacctgtgtaccatgccccattaggaatggggggataccattccttatagtgaaggtgcagattctaggtgtacctccggccccatggccttatcttgcattaggactacaggtcccaagacttcttgtaactctgctgctaagggacttgtactcagcatactccgctgctctaagcaggtgcttcacttcactaaagtggatgtctgcaccgtccttatccggggagtcactacccatgaatgcacccatcctgctatcaggtaagtcgtccatatgacgactgtaacccattctgccacactcttatgagcctgatgggcagcatatgtagttactaactgctttcccagtccagggggtcactacccatgaatgcacccatctgctattactaactgcttctgtattaatgaacactggagctcagctcccttccacagctaggactaaaagcctgttggcacttccaaggtctccatgcactgctataggccctagccaacactatttgtggtcacatgcacattcagtttaaatgggcacccctagtcaactacccataggtcttgtgcctactgaagagcctgcttggctgtgtaagcctcaccatgcaaccccaggcaaggtgggcattgccacttctaaatctgcaagagaaccagaggttcgcataacgtcatcaacaagatcatgacatatgatgaggctatgcatatagtcctgcagtgacactatgaaagtccattgtcaccctcccatgaaggcagactgttcctggctctctggagcaatgttgattgagaggaatgcattggtcaggtccaccacacagtggcaccatcccagttctattgtcaagcagtccagcaagtccgtgacagacagcacagctgtcaagctgtgcaaaacatccacccccagaatgtctccaggcatgggagagatgtgcacagtggacaagcagacagccaagtggcgaacgccaaggtgcagacacaggttccactttcactgactggtcttcataaccattaataaacacagctctgcccggaaatttatccgggttcagagactagtggattgccaagtccgcatatggcctttggttgtctggtgccacccaagccaggcatctcggccagtctcttatcaaacagaaaaggctttacacttccacctgactgcagcaggcaatctgtgaactggaatactcgggcaggaccaggttgtacaccaacgtccttctcctgaatgacttgcactaagtctgtacatgactgccgacattacttgcttgactcccgcaacatagcgggggtgcaggcaccatataaaatgtgttccaccacggtggtggggggagggtccctaggctcacccttggtgcccaacagctactcatgctatattttctggtggatcactgggcgagcctgcaacagaggttctttctccctgcgctgcatcctgcagggactgggcatgcaattcctgcagcacagttacaaacgcccatgtgactctgccagcgaaggtatgcttttccttagtgctgtgcagttcctggtgcttcagtaccttctccacactcatgggagacctgtctactgcctcccacgtttccactggggcccacccaggcagcaccgctgccactgggtaccacagcccatgctgcggccacatagccgacccaagacccctcagaactgaagacccactcacctcatctggccaactatgccaactgtcaggttcatgagtacaccaaacgtcatgcccagggtccagcccctgctgaggtccgaggggagtgggtggatggacagatagctgaaagaacactcggggccgtaagcaggtgaaatgtagttttattcagcagctttcccatccacagctctcacgcactgttctctctgtcttggctgcttgagctggctgcacagcctgctctccattgccttcagggtcagcagcttaactctctctctctgggcacaagtgtgcctatacagtgtcagcagggcaattataccttttacagacaatagtggcttagagccaaatgataaatcttcccatgttatggccacatggctgtgataacaggtggagttatacgcctgcactctaaacttgctgagtcactctggatgtttacctcagcctgtccttgaccaaagcacagccatgttccttacactgtgtcttcaagtttcttaaccaaaattccatgtgacactcaaagctcctttataaaaatactgttaacactgttctctccattagaatgtccttcttcccacaaagtagagttccatttcaaatatcatttccttctttaagtgttccctaattatcactccagttgaaattctgcccttcatatcgccacaagcctttatcaattcctctctatgaggaatagaaatttaacactttctaccttgatattttgatttctaccaagatactttcagtaaagtgaaaataagtcaaacttaaggaaacagaaggtgaaatttgggacctgattaaaggttctttggaacagtcctctggcagtggttctcagtcttgtgtgcacactggaataccctgggcaacttcaaaaactatcaatgcctgggtcccagcccagatgtcatgaatgcatcctgaacactgagacttggaaaagctctccaggtgattccgatgtgcagccaaggttttgaagtactactctatggggactataaaagggagtaagaggctgggcgtagtggctcgtgcctataaacctagcactttgggaggctgaggtgggcagactgcctgagctcaggagttcaagaccagcctgggcaacatggcaaaaccccaactctactaaaagtaaaaataaataaataaattagctgggcgtggtggtgcacacctgtaatcagctacttgggaggctgaggaaggagaatcacttcaacttagaaggaggagtttgcagtaagccaagatcgtgccactgcactccagcctgggtgacagaggaagagctctgtctcaaaaaaataaaagagttaagagattactgaaggatttttcaacagaagcaaagatctggttgacatcagataataataaatattacaacttgagtaatagctgactgtttagaagtattaaaagcagatgtagaaatgattcagggtaggcaaatgatattgtaggaaagtgtaggaggcaaggaatttggtggcacttggtaaaactaaaatgacttacaattgcttctaggctgaagctggaaaagaagagatggactgggaagatagggacaacaattaagggaaactgcttggaatgagaaccaagaataagtctgaagaagtagtggagatgagcagtcaagcaaatgcagagggaattctgaaaaagatgctgtgagttgttaagttttcaaagatgacagaacatgatgtgtggcaacaacagtgtgttgctaaactggacatgtgtagaagagttttgaaatcagagtcaccctggtcatcaacagtgatgaaaaatatgcatggcagcatctaaaaatcatcacgggacacagtaacttggaggtctgataaagatgctgccataattgtggagagaggggttagaagctgtggtgtggctatgaaaaggggaggtaacaaattgtggtagaataacacttactggtaggaaagagaccatctgtttttctaaagtacactcccttccccccacttataaaaccaagtatgtatttaaagatatttctgtgctggtaagtgtattaatttataatctttatttttcatcattaagaactaaatattaaaaaatacagtaagtacaaagccaaaaaaccaaatttgtttttaaaatacaaaaacaggtgttcatggtaaatgatggaatgggagaatggaactggcatgagaaagactccttcacagtagcagcatgtaaaaatttctctgcttgcttcagtgccttcccaaatgctcatctttctcccagttgatacctacgtgctgcttcaaaacccgttaaatgtggtgaaggggtttaaatcccatcagaaaagtcagatccctggctcactaatcctttgaaaggctcacactagtgcaaataaatagctgactaacattctctgcaggacagttgcattataataattctatagcaagagatagggatattatcaatgtagtgtgtcctataacaagaggtactgtatagatggagtgagtcatttcacctatagcaccacccgataagagttgaaatgcgttagaatatttttcactgtagtaaaatattaaacctaatttatctgaggagtgaataaaaaagcaagcttaattcttacaaggaacataaactcccttctgtaattcacattattagtcccatgtcattatgacaagatatgtttgcatcactaggtacaagagaaaatggtatatagcccacagaataagtgaaaatctattataatgaataaatttgatatagtagtgctatttccaagttctatttagtaaacccagagtaaaaggggtttattgatctgtttacaacattctaaacactaagattaaaactgttttgttctgacataaaagaaacagctatgtaaagtgcttagtcctctacctggcacatggtagccactcagcagacagttcccattttcactgacttgaccctttccctcccactccaaatatagattctaaccaccctttaaagaacatccatagaaaattctcagatcaaacaagcacactgtgttaaatgttaaatgtccacattaacaaaggttatatcatagaagtatgcacatgccaatttcttatgcatgggagtaactcaggtcttagattgacaatgatgaacaaaggaaaaggaggagaaaaaagaaaaggaaaaatgaacaaggatgtggagggagaatgaaaaacacaattgcactgtcagtgtgaatagcaaacaaattcctgaactaccagatgtcatggaacaagtaccccacacaagagtacacagagctgcaatgaccctggaactctaggtgcagggactgccaacactacagatgcattcattgtcatagctctagtgattttcttggacaaatggtagaaatcactttagccaccccacccccatccgctgctatcctctagtggcagaaacattaacagtggccaaagaatgacaatttatcctgattaggtgggcagctaatttatccttttagggacagctgtcatggggtcctcagtgtcctctctcttcagtgtggtccctcgtccctcaggaaatgactttactctcccagggtaagctcaaaataacacttagtgttcctgctaaatcctccagtagtccagtgctatgcagttctttcaaagaagagctcttgtgattaacacaaaagtctctaaagttgtgtgtaaaaaagcctttgtgtaccaagcaaggcatggctcacacctggtcatttgcccagtttttgccgattcttcctggccttagattagtgtctctcctcctttagtcttccatgaccccatggtcatggaagcagttatagctaactactgcccttctacctgtgtctgaattgcagtattgttaacactgagcaactcacaagattcctcttcactaggtcaccctccaaggctgcgcagcaattcaaatcccagtgttagccttagagttcaaagctgctcattaaaattatgcatgctgaactgtaataataaattctgggctaaaattataatttaatattttttcaaagtaatttagagtgaaaaacttcaaaattttctgttattttgtataattgggaaaaacagtcaagtttttcaaattaacacataatagttgcattacaacaaagatatttatcattcacttattcattcattcaaaaatactcgagtgccaggaactctgctggaccctgagaatatagtgaacaaaagaaacatgaccatatcataataataataatttctatattgtatcacttatttcaagaatagtctggcatagattaaacattttatttaagaaaacaaattggggagtggggagaaacacatgggaagtaaatttgccatgactaagtatcaaagtcgttctatgtattatgaatatgtaacaattattgtaagtaacactggacactaaaatagttgctgttcacttaaagagtgctagtattttattttaaaatttcactatacagatgcatatcacaaaaaaaatgtactaactgcttgaacagaactatttatcaagaataagaataataagattttgtaaaatgttcatgccaagaatgcaaaagaaaaaaacagcacaataacctcacaactaagacatactataaatatgttatcaaaagataatttttactcttcctagcacataaaagataatttattgttttcaaacttaattgatactttctgtattagaacatattacatatcagtaattttcttaccaaaatagaacccaatatatgtacagtaaatatttaagaaaataagtttgtccttagctttaacatgaatgtgtacatataaatatacatatgtacactcacaggagtaacatacattgacaaaaaattacacttagcaaaggtccaaaattgcacaaaaaaaatcccgctaggacttttttgctatctttgaggttggacaaagaatgtataaaattactgaagtaacaaaaaaggacacaaaaaccacacttcaaacagacaaactgcttgtcagtattaggacctgatttcacatacaggtttaatacacttcctcaaaagtcatgccatcaaggtgaaggatgaacatcttccactactgaatgaggctggatgtcattattctgagaagtagggttctcctccacatggattactttatctgaggttcctgcaggagaaacttcattatttgtctcctcttcactaggtgataaggtttcaggcagttcatttgacattagaacttgcaaaggttctgttccattttcaacaaccacttgaatccccaaaactttaagaatatcacatttgcaaatggggcatgtcccatggggtaaaatccaggggtcaatgcaattcttgtggaaaaaatgtttacaagtcagaatacgaactatgtcattaggcttatagcgttcaaagcaaattacgcagctatccccatttggatttatttcttcatccccctcttttactactcgaagttggagttgtccaaatgtgttctgaagatctgttgttaatcgctgccatctccggttctgaatccttgctaaacaaagtctatgaatgtgataaaagatgaaatatgctaaggtagcagttgtgacaatcacaaaagagaccaaatagtgattcatccagatgatgtgctttctccccacctcaaccacggctgtaatgagaactcccttcttaattaaatggaaaatttccgtgccttttaagttaccaatcataaccacaacgacatcttcaaatgcctgatgaaacatggggaacacctggttgccagtacctggaacgttatagatgatcactccactggctcccttctcagttgccactttaattttctgtgtgaaggtacaacctccccgttcaataagtgcaagccaggtctctgagtactttgatcggctgaaaatggtattgggattacatgcattttggatttttccctctggtggcactataactcctgccactctcttcaaagtggagcttcttccaaagactccagtctctcccaactctgacaacacatgattcccaacatgaaatgatatgttcatataagccatccaaacaacacttgctctgcaacagttctgactaacaagccaaagaacactgaacttcataagccaggaagaggcagtgttgtttctccaagtgccaaccttgagtagatgcatctctctcttctccgagtgacttaagaaccaacctaacagttgcacatctgttgacaattaatttaaaataacgaagagaaaaaaatcttcaggatacaaacaagatccactgtcttccagcatgtttttgtaagaaattcttaaagatggcttatgagtttcagatgtcttactagagagaggtgaaaaactttagattgaaaaataaatcccctactgttaactctagatactgcttactattgtgtgatgtgattatgacatgcaagacccagcagccaattagataagagcttagagcatactgtgaatttattggcttaaatgctgttatgggtgatttctatgttgttataagatggatataatcactgagctacatataatggtagtagatagcacattaaactaaaaattaaatctaaaattcatacaatgtgtgctctttaaagcctgaaagcacatgtaagaatgttttattttcccagcaagtgaaggagatatttccaacaaaatggcaagctaaaaaaaaggataattaaaaattagtgcagtgaccggatgtgaggcaaaagtggtgagcttagtgacattatttttacatcaaaaagtaaaagtcacactgctaatttttgattcatcacataaaccattatattgcatttatttaatttaagctttctgagaagtttgtggcttttgttttatggttttgctgttttaaagtaagggatcctgctcagtttacttctgcctcactttctctgtcttacattgactgtacaaatgtagtaagactgacaggagtaaagaaaggactgatatctagggaagctaatttctctgcagactttgatgtctgttattaatcaaacaatattttgaaagaggaggagaaagggtgtcaagggaaagattaaatatagtcatattagtttggcacaattcattttttaaaaaacagctattaagaaaaacttcaaggtgcacacttaaagttaaccattagcagcaataagtagatgcttttatcaaacatttttgcagaacttaacaaatatccctattagaagattccacaggctctgtccactctgcctatgtttttgccacaatcatgtcagtggcacaatatgacatcaaagctaaaggatggcatgtggactcacaagcatagtaagttcacaagcagccacgctgctactggtacactttcttggcggtgaatctcagtgggttttttcccaccagctaggaaaccgaggccaaagattctgaccttgaacatgaatgtctctggtctacatacgtaaagtgctagaagtcacttttggttggaactcaccaggactaaaggagctgttacttcttatgaaatgtaaatctacaacatggtaatttgagacaagaaagatgaaggaacaaagggccctatgggccaacaaaaactagtataaaaagaatactgatgatataaaacatacccataaaggttgattttctctcccaaaggccattaatccgattttattttcatacatccctgcacattttaaaaggtagtatatggtgtgtatattcacaaagtgacactgaggtatcaaaagtttagcatatcatccagaaacagaaattttcatcaatacaacaatacctaaatctttctgtctctcattgttatataggtgtttattcatctactagaaaaaaggaagatgcaaaataaggcaaagaatataacatcgaaaggcaattgaacaaaattttagctctgccctatgttatcaaaatgcccccagagaaacattcattaccatttggagaggaaaagagaagcatttactaaggacacttctagaaaagaaatctgctaccatagctgagtcactatgctaggatttaaagagctctggcaaacaaaagtgaatgtttgcaatgttatcctaaatgaagcctataataatttagaacacttttccttacatatccaaagtactatcatctaaaataattatttagaacacattaccaatccagtgagtagctttggaaactagatttcctgggtattaataaaattaattaaccatggagaatcagagatataaattattagataccaaaattagtcaaaatgtggaaacaaagtacaagaattagtattaaaaaaggaaactttaaaatagcatggctaattctctatggcaatgtcacaatcctagtaacttgaagaaaaaaaaatttgtttttaacatatactaatgttcttatttggataagggcaaaaagggatacgattaagaaaatgtggcacatatacaccatggaatactatgcagccataaaaatggatgagttcatgtcctttgtagggacatggatgaagctggaaaccatcattctcagcgaactatcgcaaggacaaaaaaccaaacaccgcatgttctcactcataggtgggaattgaacaatgagaacacatggacacaggaaggggaacgtcacacaccggggcctgttgtggggtgggggaagcggggagggatagcatttggagatatacctaatgttaaatgacgagttactgggtgcagcacaccaacatggcacatgtatacatatgtaactaacctgcacgttgtgcccatgtaccctaaaacttaaagtataataaaaaataaataaataaaataaaattcacctaaaaaaacaattaaaactgattagaaagacaagaagttcaaatagctgggcatgataaggagttttatttttaaaacacaaatttcacccttgttcatacttgggtagagaagctgaaattttctctctacataaagtacaataagacaatttatctaatctttgtatttggaaagatctggttacatcttcagaaaattctccagatttcttaagttttcaggatgtcacacttgcacatgggacatgtcctatgggctaaaagccaggggtcaatgcatgccttatggaaaaaatgtttgcaagttaaaatgcgtactacatcttggggtttgtatgtgtcaaagcaaacaacacagttgtcttcatttaggtctaattcctcatccccttctttgagaactcgcagttgaagctggtcaatagctttcttcacatctgtctttatttgacttcgcctcctggtgaaagaattgggcactctaggtgtaagtctccagacgcaatctaagtaaaagtaggcaattgtggcagccaggaaggtaaatagatacatgatgtaatggctcacccactgcatgtgcattctccccacttcaatgatgactgtcacatagactcctttctgaatcgagtgcaaaatttccatgcctttcaggttgcttatcatcaccgcgactatattttccgtcccctggtgagacatgggaaatactttactgcccgtaccttgatagttgtagatgatcaccccatttgctcccttctctgctgccacgttgattttatgtgtaaaagtacagcctccacgttcgatgagggccagccatgagtctgcctgtttgggcctgctgaaattggtcaaaggatgacaggcattctgattccatccttcaggaagtgccaccacaccagacaccctttccagaggagaatgattcccgaacactccactctctcctaattccgatgtgatctcatttccaacctgaaatgttatattcaggtgagctgtccaaatggcttttccgtttgagtcaggaaagctaagtagtagaaagatactaagcctcaaaagtccagatgaaacagaactatgcgtcgaaggggtaattctaaggaagctcatgcctccatttgtctattaagagacaaacatgagaaaacaaaacaacatcagttgtagaagaacataaagaagatagcttgttggcggcagattactaaagcacataaatggaaaaggtctccctggatcaaagctatcttgctccttccagtattttaatatttagtagattatctttctcataatgaaacaaaataacaagacttgtgattggtaccatgtgatttcaagaaaattatgacatccaaatggggaaattatgacatcagaggtagttaaaccaatccaagagtttatattagtgcattgcatcctgaaatcctattggccaaaaagctaagcaatgagtcaagatacataacaatttgaataggctgtaaagcaataaataaactggtaagaattttttaaagccttgggtttcttccttagttctggagagactgaaaatctacccagccatataatgttttttctagctgtaaggcaaaggcaaagataaaaataattcatgtattagtgcatgtacctgggccagttgccagttttcatgcatggttcaacactacccaatatggcattctgtgggatggttcaacactaccgaatatggcattctgtgggatggttcaacactacccagtatggcattctgtgggaagtaggagcaaaccattcccacccacttcccacattaaatgcctatcccacacctaaagatccaacactaagaaaacagtgtaaactcttattgttagcctaatacagtcccatcttctggtaagaacctactatgtgctggcaaatactgagagtggacatatattggagaagaaaatagagacggccctactcttgtagaggctaaggattttggatgatgtcccaaggacaagagaaacacactgtagggttctaagccagggaggtgacaaatgtgtttcaaaatgttcactttggttgctttatggggaaaatgtattggagagggagaataacaagagaatgagcttaggcaaaagaagatagtggcttggactcaaagtagcagcatagatgtagagacacagacaaaggctgaataacagatttagtaactggaaggacagtagtgggaagaggaaaggatggccacaatgataaaaaatcactacatgatttttgcaaattacagaatctttacggctttaaagatgccttattgtttagttttatcttaaatctttatctaaagtctgtttcaaggagccaataaattggcaacacccactcaaaaatttattttctatcatgtataggttatcttctatgtgctcagcatgccacaaagtcctagggatagaaaaagaaaagaccttatttcctagtgtgaaaaatggacatgaacatttaatcatagacatgatagagttttctcatttggacaaaagcatttattgtattccctggcctattttagttaatatttgttagtattccctgtattttagttaatatttgcttttttaaaaaaaaactctaggaaacagtctacttgtcccattcatgcaattctgttgaagcatgattcaggtaacacctgaactgtccttacaggtagactttttttttttcatgttcaaatggagtgaattcctggctgattctattaacagtgacaaattgaagcctcattaagaagacggtttaacatcatcatattagaggtaatttgttaaatctgtgattatttaacctttggaagtaggattacaaaataatataactctgactttttattttgcagattttttgtgggtgaagtgtttaacctgtaactatattttgcttcaaaacatatctcacatcaaaaggttctctgtatggttgaaaggaccaatttgaggaacttagctcattcattctatttttctcattataatataaagtggttaaggcaatgatagaactgccctctcttctgccctcgtcttacaacaaaatagacctataagaaacaatcatctatctcttaaaaagtggttttcaacttgggggcaattttgcctctcaggggacatctggctgcttctgcagacattttttgattgtcacaattagagagtgctaccagcatctagcgagtacacaccagcgttgccactaaaacatctgaaaatgcacatagtagctccacataataagaaattatgtggtccaaaatatcaatagtaaggttaagaaaccctaatctaatgaaacagcctgaggagagaagcatcccaaaactctcccaaccccgatgggtggtcaggtataaattctcgacacaaaataagcttttataattgacaatgcttccatcaaggatgaggccctcaatgcaacttaatttctctagttttccctggaatagaaacaggagagatctgtacaagttaccttttagtccattaagtatcatgacaaattgcatatattttatcagaatgaggtctaagagtcttcctggaaccgcatgtgactgggagacagagagagagactggatgattgaggctactgtaatctgttccttttagatcatttattcaatacatggacattctttctaacagccaaatattgaagagtttttcattctgttgaattttgcaggtaggttacagagaattgaaatatattagtagagataatatataatatgtaatataatattatatattatctatattatatattatatatatttatattatatattatctatattatatattatctatatttatattgtgtattatctatattatatattatatatatttatattatatattatctatattatatattatataatatattttatatattatataacatttatatatattatatatgatatataatatattatataatatatctcatatataatatattatataatatatcacatattatatataatatatcatatattatataatatatcatatattatataatatataatatatataatatataatatatgatatattatataatatatatcatatataatataatatatatgatatataataatatatatttatatataatatatattatataacatattatacatattatatataatataatataataaatataatataatatataatatattatataatataatatataatatattatataatataatatataatatatatataatataatataatatataatattatatattatataatatttatatatattatatattatataaatatatattatatattcaaggatttatatattcaaggaatatatatatgtttatatattcaaggaatatatatatatgcttatatattcaaggaatatatatatatgcttatatattcaaggaatatatatatgcttatatattcaaggaatacatatatatgcttatatattcaaggaatacatatatgcttatatattcaaggaatacatatatgcttatatattcaaggaatatatatatgtttatatattcaaggaatatatatatgcttatatattcaaggaatatatatatatgcttatatattcaaggaatatatatatatgcttatatattcaaggaatatatatatatgcttatatattcaaggaatatatatatatgcttatatattcaaggaatatatatatatgcttatatattcaaggaatatatatatgtttatatattccttttgtaggcaggctaaagagaactgaaacatattactagggttggttcaactggttcaaaaagtcattctacctaactcttgttaacagcgaatatgtatatatatatatatcacacacacttaagagataggttgtgtgtgtgtgtatatatatatagttacatgctcttaacaagagataggtagaacatacatatatatattcttttatatatacatattccttgctcatatatatgtatatatacttatataagagcaaggaatatatatatatataaaatgtatgtgtgtgtgtgtacatacatatatatatacacacacacacatatatatatatgtatgtacacacacacacacattttttttttccagaaacttaccagacttccctcaatgtctctttggctagaattgcttcacaaacccatgcctaatgaaatccttggaaaccggagtggaatcatcatgattatcttaggttaatcatgatttatcctgttgtagagagctctttccctggctgagcacatggccagaggaagggtgaagatttgaatgctgtgttactaaggggaaagacatgaaccagaaggtaagcaggcaggcacaatggcagttacaggctctaaattcctgaagtatccccaaaggaataatacttaaccattaaccgcaacaaacatgtaatatgcactgtacacaaggcactgacatgagccagagtctctgttaatggggacacaacatggctctgaccttaaggagggcatcatctaggcagaataaaagagttacatgcaagttggatgtatatatgcatgtatcctataacttccaggcgccaattaaattttttagaaggttataactattattaagagagaaaaaatcaactaactgacctctacccctctgctattctttgatctctatgggtaagagtgctcacacttccagaaatctctactccaataaagcaaaacagataaatacaatcacattgcactgctcagatagcatctttaagatgaaaggaaaaccaataaactacctcacaagtgtcagtatccagagctataatatcatgagagctctctaggaattcaaaaaacatttattttgcatttaggctcaaacactacaactatgtatgttttttttgcaagaaattaaatgaatcataacgagatctgaggaaaacagaatattgactctaaagtacctcactgagagcagcacaaaagcaaagagtactaatgataatatttttctgaaagcagaatctttacttttacaatttttaatgttttcttatatatatatatatgttattatttgcaagcatctcctctaattacagctaatatattactggttaaaaaaacttcatagtttcatgtaacaaaactagtttatataaaggcatttctggattgtggcaactataattcttatttctatatatatattttaagtaaattttgttgtgtatatttaatgtgtataacatgatgctgtaaggtacacatatatagtaaaatggttgctataatggaacaaatgaccatatctgtcatctcatatagttatccatttgtcctcctgttgcaagtgctgctataatctacccatttagaaaaaatcctgatataattccctctacaaaattaactattctattaatctccttgaaggacaggattaaatcttattctcatctttttaatacccagcttctaggacaatatctaccacatcataggttctcaataaaagttgaattaaattgatagcgtcattatcctctgtattctatccagtaatattccttatgcaaaattgtatctactgagttttatcttcagaaaggtgatcatttcagtaagagtataggatagttagaatattcataatgagttcaactgattctatatatgtacacacaatatgtgtgtgtatatatatatgtgtgtggatatatatatatatatatatatatattggatatgtagatccaaacatattgtattcgagatatatatatatatatatatatatatatatatatatatatatatatatatatcttccttgctcttagcaatcataaaacttgattccttagccataccttaatacaaagataaatgagcatttggaatatgatcaaatccatttaaattgtaatgggcataaataaactaaattaaactctcttcttcattcagaattcaagtcatggtctacataactttaacaataaattgaaaacaattttttccttattcagtctaccgatttagaagatagaatggtaatcagagtaggaactcattattactactctgggaagtaacggggggaaaaattcacattgtagtctttgcactaggaggcagaaggaagaggtaaatagtcttaagtaaacacaagattaagacaatatttggccgtagtataattattatctttgagctcggaacaaaatgtatcttcatattaactcaaccatttagactggatttttgtttgaggcagtggtgaataggcaatatactcaaaagaggaaaaatataccaagcagattcctttaaatcaccaccagcaattgtcctgttctcttaataggctactctgcccttctcattattaagatccaaggatgaggaccaaaaggttctgcaggctgcttctgggactccatcatttcaagattgtcctaaagcttaaaacagactctaaatcttcctaagccacaaggatatgaacagacacttctcaaaagaagacatttatgcagccaaaagacacatgaaaaaatgctcatcatcactggccatcagagaaatgcaaatcaaaaccacaatgagataccatcttacaccagttagaatggcaatcattaaaaagtcaggaaacaacaggtgctggagaggatgtggagaaataggaacacttttacactgttggtgggactgtaaactagttcaaccattgtggaagccagtgcagcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggagtaagaaaatatggcatatatacaccatggaacactatgcagccataaaaaatgatgagttcacgtcctttgtagggacatggatgaaattggaaatcatcattctcagtaaactatcgcaaggacaaaaaaccaaacaccacatgttctcactcatagatgggaattgaacaatgagaacacatggacacaggaaggggaacatcacactctggggactgttgtggggttgggggagagggaagggatagcattaggagatatacctaatgctaaatgacgagttaatgggtgcagcacaccagcatggcacatatgtaactaacctgcacattgtgcacacgtaccctaaaacttaaagtataataaaaaaaaaaaaaaaatgaccttctgccaacccaaaaaaaaaaaaatcttcctaagccacaatcagtcattgaaagtttgcatatgcattgccttcctaatacaagtcctatgatggttaactctgagtgagtctgtggttaactctgagtgagttcccagcagtcagaaataacagggcagaggtgattaaggagattttctccttacgtttttccaattcacagatcacaaaaccctttcttatttgttatataatttaatccctcccgtgaaggagcagagaaaaacgatgacaacaacatgagcatagagacatcacactagcagaaacagtgaacagtgtattaaagcaccaggccgtgtgacagatgtgtcatgtagtgaaatccagtttctgctacatgctagccatttaagctgagccacattgagcctcagctttctcatctgtagtctggaaaagtaaagtctgcctctagggccttgatgagtattggatgacatatttcacttctgtttgtaaatcgccaagcacactgctagcttagcttggtaggtattcaataaatgggccttccttcctcttctcaatcctgaaaaactttttcttccattttccagctaataaaattcccatcatctttacagacccatttcaatctcccatttgtgatctccctagccaaaaccacctgttcctatgacacattatttttgtacctatttggcagtcatttaattttgccttatattatatataattagaggcatatatgtctgtctatactttcacttggtttagaatatcttgtgagcagtggtcttatctgattcattttttaaaaatcctgttttctcccttctgtctctacactagcacaataaaacttgctcaaggtccctgacaaaatgttgattttcaagtactttctcttcaaaatattaagacatatctggagcttttataatctatgctttatacaactactcacttttttaaagaaagagaacaggcaatgatttgacaagtcttccctcagttaagaattacattgacaacagttgtccagaaaaaggcttatttaatatcacaggatcagaggccatctgtcttacattttctctccaaaagtcgagaataaatttcatctacatctctgtatctgaaaaatggactaaatatggaataatatgcagccataaagtaataaccatttctaacatataagcagcagcctttacagggataaaaattctcctttaattatttttatgtaaatgaatatatagctatatctctcaagatatttaaatatagatctacaactatatatcaggtcatgagccccaaagagtcattattaagagaaaactataccaattatgtataccatggtacctcagagaaaactctaacattacatcaggagtaatagttaaaagaaaaaatttctaattgcaaccaactttttctccaatccagaatgccttctatttctaccccaagtgacagttgaatcctgcagtccccacaaagcttccctgattaattcagtgcaaagtgagttctttttcctatgaactgtcacaatatatgttttacattttttttctttttttagacagagtctctctctgtcacccaggatggagtacagtagcgtgatcttggctcactgcaacctctgcctccagggttcaagcgattctcctgcctcagccccctgaatagctgggattacaggcacgtgccaccacacccggctaatttttgtatttttagtagagacggggtttcaccatgttggtcaggctggtctcgaactcctgaccttgtgatccacctgcctcagcctctcaaagtgctgggattacaggtgtgagccaccacgtccagccatgttttttatttttgtatttaaacatattttgcagttaaaacagtacatacagcatacatgtacatttttaaatttaaaaaaaaacactcttgtatcttttaagcaataagcactattttcttcatactctacatcctttcttaggaaattatttctataatatcttgtgatatttttcttctagtgttgaaaacaatgttactttttccccctcttacaaaggttgtcatctttacctctcaaattataagattttcgagggcaggacttcgctatgctccttcatcttcctacaggacccagtgcactgatttgtatcaatttcttatttgatttgatataacaaaggtgcttctctggcatgactaaggacctgccatgccttagttgtttttcatattccctctagaagcacaatctaagaaccatctattcaaaatgtctacattattgattatttcactcattcgaatatttatcaagaccctactatgtgcatagtacttaatagtaagtgcacacaattttagggctacagcactgatcaaaaaggaacaatctcctgtcctaatgactcttttgtgtacccagggattcaaagatgaggtcatggttatattttttccaaggaactgactttctgatatgataatacgctaaataaggtatgaaggaaggaccagagaagcacagtatcttagtctgtttgggctgttataacaaattaccataaactgggtagcttataagcagtagaaatttatttttgcacagttctggaggccgagaagtccaggattaagtagatttggtgtctcatgagggcttgctttctggttaatagaaagcaccttttcgctgtgttcttacattgtggaaagagtaagggggtctctctcaagcctcttttataagaacactaattctactcatgtgggctctgctcccatgagctaatcacctcccaaagtccccacctcctaataccatcaccttgggggtcaagatttcaacatctcaaggggaacacaaacattcaggttacggcacacacaaaaataaatcctgtccccaaggtaggacagtttaatcattatatagttctgatatcctaagttatcactttccttaggatatttcatacaatgaaaaacaaagcagcccatacagcatatctgttcacaaagtttccttcattcagatctgatggagctttaaatttttatatttaaaaacaaagctttgttttatataattttcacagtcttaagtctcgttagttttaccaggaatagcaattgttgaattttgcaagtttaattaatttttaagccagactgcctgagtttaaatcctgtacttaacactagctctacaacttaggcaacctatctaaactcatgtgccttagttcccttacctgtaaaagagagataacattagtaccaaatttttgggactcccatgaggattaaaagaaacaatgcacagtctttaaagcacttagagcactacttggctcatacacaaactgatgtgtgttcactgccagcacccatcatatttaaatcattgtcttattcacccaatttactaaagatgatgccatgatctgtaaccatttttttcaatcttaacaattgtaaggaagtttctattttgacataaaatattggtaaagaaaaaaaaaagtgataagtatcacttttccatatataacatatattcttgaagacaagtgatctctttacacaaatacctagtaacacctccagctaagcagctagtatttgaatgcacattagggataaaatatttcatgattcatagaagatgcatgaaaacagtgatagaacttacttattatacattttatagttataatgtacaggccaactttaaaaaacaaaaaggtcttttttgttccctcacatccacagaccacccataaaaacaaaagtaaaacaaagaagtaaagcttttcattagctctgctggcacaatatttttcaatatgttgacaaagagcctggtttctccaactaattattacattcataatccatgtcaaacttcaagaagaacattcatgtcaccaatgattcaaatttagtttgagatttagggaaaagaggaggttaccatgacagaaagcaaatgtttgtataatccacttaaacaactagttctagcaagacctagaggtaaattattattgttctagtagtttctatttatttggtaaggttatactaacagattactcaggtgggaaaagtaaacgatattccataaaaatcgagaagcaaaacgacatggttaatctgaaaatacatgtaagtagcagtctatacctacaagaatacaaagtggacatagtattcactgtttctatcaaatctacaactttcagattgtttctagctgtctttagtatttagcttgatttcctatgtctcattttacttacatttccattttaaaatctttggtaaacaacttcttttaatgttttactatcatcatttttttaaaaaaacaaacaataagtggggctatgggtaaaacagttacaaaaagaatccatagtcaagtggagagacgaaggacccaaaaatttgctttttgcatgttaatttcttaccaaaacaaatacatacaagatgggctatgaagggtaagcaataaatcttcaagaggagactagcacaagatccattgccactcataggaataagtctatttactcacaaggtgtttcgtatagtgttcttacaaaactgtactagctaatatttcaagtgtattacttataatttgttgaataatagaaacttacagtaataataagttccgatttgagtctttacttaacatttggtgtttagcactctgtcttatctcatttaaaattcacaacactgcagtgaagtagacactatcagaatctcgttttatcaattagaaaatggagatcaagtgtgtaattggttaaacgtcatacagctataagtggatgaaccacaggaagacatctcccctagagcttctagagggagtacagccctattgataccttgactacagacttctggcctccacaactgtgagagaataagtttctgttgttttaaacaattccgtttatggcaatttgatacagcaactacatgaagctaatagagcttattggtcatttaagtttcctattctttgacttgttattcatatcccttattcacattgttcagggattgtctgagttttcataccgatatacaggagttatggacacaccttagattttaagcctctgttgactataagcactgtaatgcctttctcagtctttggcagccaatgtccctagttaggactggttaggcctcagaaccctatctcctaggtaaggtttctccttccagaacgcagatggcaaagtggtgacttgagcttgtgaataagacacatgaatccatgattggctcttttataactgacacaggatttccgtgccttgtaatttaaaagtagcaaatattattctgcctatgccttaaaaacatgaaaaagactctcttttctgtacactgtccaaacagaggtcattctgctttgaataaggtctgaagcatacagggtctgcctgtaaaacgaaagctgctttcctacggacaaagatagctttagtcatcttctatggtcaaaattctcacagacacaaggcttaaaacctctcaacacaacgcattgcaaagaaaaaaaaaaagccaattgtacaagtacaaaaaccaaccacagtgcaaagctccaaagtaaaaaccccacatggtctgcccctagtaaggtactaccaaagcttaaagtcatccaccctgacactagcagaaacaataatgacatgattttgctcctctagattttactaagagctgtaatcttctatctacaattcaatatgaaaactctaaaggtattttttccccataagtatgcagcaaattcattgggggaggggaaaaaacctgatatttcaaaattgctagaagaatacatttcaaatgttctcatcacaaaaaaagtatgtgaggtgataaatatgttacttagcttgatttactcattccattttgtatatatgtcataacatcacattatacaccataaacatatacaattataatttgtcaattaaaatattaattttttaaaaaactgatctgaagtaatggaagtctatgcattcattcagtatgactattcatatatgttgctgaaggaatatttgttttatgaaaaaaagcctgcctcggaccttactggggtactatctaacatgtggcatatgtactatgctacatttctgatatctaaaacaatggtccacactgcatagggcaggcccacccccttctgctaccatcactaccaaaaaggcaggaaaatacaacctacgtctctactcctagacaaaatcccttgcaaagctaacagcctaaaagagcaggggtaagggagctcccagtcagcagaaagctccacacagaaaggaacacatttggttttctgtcctttgtagggtcgggggagcggggagggatagcattaggagatatacctaaggtaaatgatgagttaatgggtgcagcacaccaacatggcacatgtatacatatgtaacaaacctgcacgttgtgcacatgtaccctagaacttaaagtataacaattaaaaataaataaataaataagaaaggcaggcatgcctggtttctccttccagcctcatctaccaggtaaatcatgaggagggagtaaaaggtagagtgcgaccaaggggcactgactctgctaatatggtggttcttgggaggggtggggaatggagggaggcccagaaagggaaacactgatttataaacaagaaagcagaacccaaaggaaataatggggttttgtccctacttgcaatgtgaacatgactttttctactagaacacaaaataaaatttcaaatgttgacaaactctgtaacgtggtatcatttctgattttcaatatcccaacaaaatttgccacttagaactttataatgagctaaatggcaaaacaaagactccttttgttgtgtgaatacttcctaatatatttttgatatccatacttttgaattcaggatacaatttatcctacagcttattttcaacatacttgtctttatctttcacttgttataattgtgagttaatttttcaaataggcttgtcaaaacccaattaagaagttatctcatcttctcaatttggtcccacaaagcaagtaaagttgacaaacatttagtagcaatgcctgagtagtctggcaacttcaaagatgtgtaaattgagggtaaaaacacataaaaaccagattacaaataattattcctgcatttttcaaatacttttagaataggtaagaatattaaactgaaaagaccacataaaaatgtttacaaaaattataagacacttacttatgacacaacttacatatgatactggttaaatgtttctatgtggaagttatgttggaactgaaagagtaataactaactttcataactagatgtaaatactcaaaatgaagtagcttcaagattcaggagggtaaacaacactctaatatagaaaatcttcttatacaacctgcagcaaccgaaatctttccatccctttcattgtttagctaatgggccttaaatttataaatgcaccttggtgagggcataagcattttccctgtgtagtaaaattcctgtgcagaaaaatattgaaatacaactcaattatcctagcacaagagcagtatatcccacattcttttttgtctgtttgaagacaaggtcttgctctgtcacctacgctggagtacagtgacacaatcataggtcactgcagccttaactagctgagttcaagtgatcctctgcttcagcctcccgagttgctggtactatataggtgcattccaccacactcggctaatttttttttttttttttttttttttttttttttgtagagacaaagtctctctatattgcccagactggtctcgaactcctggactcaaagcgatcctcatgcctcagcctcctaaaatgttgggattacaggcatgagccaccacgcctggccccctcattctttagtttaaaaaaacacatttagagtttactaagctagaagctttatatatgtagtttatgtgattgccattatacaattcaaccattacatcttaatttgactactcaaagaactgcctgtcagcattctccatcatattcctatatatctggaaatttcttgacatggaaaaatgacaagaagggggaagaggatgtgggaggggcaaaaggaaagcaggtgagtaggggagagagggaaaaggaggtaggagagaagtagaaagagggaggaagaaagatggggaggcttagggaaagcagcctataggatattgccagtgagctcagtcttacaggacaggaaaagttcagatagttaagggtagccatggccttctaaacagggaacagaataaatagcaagttgtatatggcatattcagtacccacaggtttttctccgttgttaacagtctagtgagtgtaacaaagcttagtgaaatgaggatacaagagttggcagggaactgatcaaatggggccgtgttaaggcttttataatccaagcattacaacacaacacttaaagaaagaaccaaacgctgtggtcaagctgaagcgctgaccactgactacctcttagaggaccaagttgtgagctcaagactctaatcataagctggtatgggataacagagaacagatacaatggaattaatctgtttcttagaaagaatgtgcccaacaatcaatggtcatggtggactctatcctgctttctcctccaacttggcttctctagaacctgctggatttatgataataattacttgccacctactgttttgataataaaacttttaggactgacatcctatgccataaatgtacacaattttgaggaagtgagtaaaggaaaagccacaggtaaatccctctacgttatataaacacagctccctttgaattctcatcagagacatgggcaagccagggtctttgggtgtaggaggagggagccatgggcatcagtcactgagagggccctgaggggtgggacagcttgactggtgccaagagctctgcacagaggggaaaggagaagtgaggaaaggaagaaagtgaggggaagaaggggtgggggagagagaaagggaatgagtggcttcatgcatgaggagaacaagctggaagtccccaacacagccttcctccctgctctgaacttgttcaaatcacccacttcctccgactatctgactatccccctatccttctgttaaagaaggcagggggccaagttcacaccagagctgccaccttagtgcactggcatgtgcaatgacgccaatttgaaaaacaaaggcatgctgggcagaaagagagagagaaaaggctggtctccactttccttcctaacatgcacgagcagaggttaagtgtatttaatacttttattcttgaaggttcttcacatccatctacaatcactgacttaataacttctgtccatgctacaccatcaaatgtgcacataaatttattaggaaagtagagaatcaggtcggcaattaaattctatgtgatataataatttttagaacagaaaactcaataatgaagctaaaatctcagcagtatataaagaattaaatatattccaaggtgattgaaaaaaatcatgactgaaaaaaaggaaaaaatatcatcatttatggctttatcaaaatcttgcatagattaatggtcattagggaaagaaaaactacctctctgcagtcatttgttgtaacatagaaaatacaagctcatataaaccatctcaaagaggaaagaacttgctcaataaagagttattggaatggaaactctaattattaaaatagtatttcctaaacattatgcttgaattaaatactgcagtctcctcctaactttggagcactggactatttcaataccaaataatcagtggatacttgaaaggtgactgagtagaagtaaaaccaatagaacgtcatactaaaagtgtcaatcagacctaacgagtcattctagagttaactattttaaaggcagtaaacgtatgccataataaaaccacaataccatttaattacacttttagttataatttctagaaggaatttgagaggacacgcaaaacatatccaaacaaaattaaaaacacatgaaaatagtattaatgctgtaattgtatattcttaaatatactttgacaataaataaggtttcaggtactgtgaaagcataaaagataacttaatagaggtttgtatatatatatacatatatatgtatacatatctacatgtatatgtagatatatgtatgtatgtatatatgtatatgtatatacgtataagtatatatacatatgtgtatgcagatatgtatgtgtatgtatatatgcatgtgtctgtatatacatacacatgtatatgtatatacatacatatatacgtatacatacatatatgtacgtatgtgtatacacacagagcgagagtgagagcccgtgcgaaactttgggatcttttaatatacccctaaaaaggatatacctcctgtaatattcctaaaagtgaatcacctagtttcagattgaaaactgaatgttcataagattactgccacacatagaaacaacgatgagagttaacaagtagaattgattattgctgtttgaatattattaaatttaccgacataaagctggggtgtatttttttgtacatcaaaaatggccaaatattggcagtttcatatggtttaacaaaaaagctatcatttgaaatatatgtgccaggcgttgtgttaattatgttaacatacttaatcttaattttcagagcttcatgagaaattcatgtatcaatttctgtgtgcataatattttcattttgaggtgggcatcatcacattcaagtcctctaggtttgctcaacacaaaaaggaaaacttaaaagaaagacatcattgtcttcagtaccccactccaagctggtaaagtcggccaggacaattctaataattaattcctgcttataaatctgtctctccttagagacacaaaaaacccttcaaaaaaccaacaaatccaggaactgcttgtttgaaaagatcaacaaaattgatagactgctagcaagactaataaagaagaaaagagagaagaatcaaatagacgcaataaaaatgataaaggggatatccccaccgatcccacagaaatacaaactaccatcagagattactacaaacacctctacgcaaataaactagaaaatctagaagaaatggataaattcctcaacacatacaccctcccaagactaaagcaggaagaagttgaatctctgaatagaccaataacaggctctgaaattgaggcaataattaatagcctaccaaccaaaaaaagtccaggaccagatggattcacagccgaattctaccagaggtacaaggaggagctggtaccattccttccgaaactattccaatcaacagaaaaagagggaatcctccctaactcattttatgaggccaacattgtcctgataccaaagcctggcagagacacaacaaaaaaaaagagaattttacaccaatatccctgatgaaaatcgatgcaaaaatcctcaataaaatactggcaaactgaatccagcagcatatcaaaaagcttatccaccacgatcaagtgggcttcatccctgggatacaaggctggttcaatatacgcgaatcaataaatgtaatccagcatataaacagaaccaaagacaaaaaacacatgattatctcaacagatgcagaaaaggccgttaacaaaattcaacaacccttcatgctaaaaactctcaataaatttggtatcgatgggacatatctcaaaagaataagagctatctatgacaaacccacagccaatatcatactgaatgggcaaaaactggaagcattccctttgaaaactggcacaacacagggatgccctctctcaccactcctattcaacatagtgttggaagttctggccagggcaatcaggcaggagaaagaaagaaagggtattcaattaggaaaagaggaagtcaaattgtccctgtttgcagatgacatgattgtatatctagaaaaccccatcgtctcagcccaaaatctccttaagctgataagcaacttcagcaaactctcaggatacaaaatcaatgtgcaaaaatcacaagcattcttctacaccaataacagacaaacagagagccaaatcatgagtgaactcccattcacaattgcttcaaagagaataaaatacctaggaatccaacttacaagggatgtgaaggacctcttcaaggagaactacaaaccgctgctcaacgaaataaaaaaggacacaaacaaatggaagaacattccatgctcattgataggaagaatcaatattgtgaaaatggccataatgcccaaggtaatttatagattcaatgccatccccatcaagctaccaatgacttggaaaaaactactttaaagttcatatggaaccaaaaaagagcctgcattgccaagacaatcctaagccaaaagaacaaagctggaggcatcatgctacctgacttcaaactatactacaaggctacagtaaccaaaacagcatggtactggtaccaaaacagagatatagatcaatggaacagaatagagccctcagaaataataccacacatctacaacagtctgatctttgacaaacctgacaaaaacaagcaatgggtaaacgattccctatttaataaatggtgttgggaaaactggctagctatatgtagacagctgaaactggatcccttccttacaccttatacaaaaattaattcaagatggattaaagacttaaatgttagacttaaaaccataaaaaccctagaagaaaacctaggcaataccattcaggacataggcatgggcaaggacttcatgtctaaaacaacaaaagcaatggcaacaaaagccaaaattgacaaatgggatctaattaaactaaagagcttctgcacagtgaaagaaactaccatcagagtgaacaggcaacctacagaatgggagaacatttttgcaatctactcatctgacaaaggcctaatatccagagtctacaaagaactcaaacaaatttacaagaaaaaaaacaaccccatcaaaaagtgggcaaagcatatgaacagacacttctcaaaagaagacatttatgcagccaaaagacacatgaaaaaatgctcatcatcacaggccatcagagaaatgcaaatcaaaaccacaatgagataccatctcaaaccagttagaatggcaatcattaaaaagtcaggaaacaacaggtgctggagaggatgtggagaaataggaacactttcacactgctggtgggatgggaaactagttcaaccattgtggaagacagtgtggcgattcctcaaggatctagaactagaaataccatttgacccagtcatcccattactgggtatatacccacaggattataaatcatgctgctataaagacacatgcacacatatgtttattgtggcaccattcacaatagcaaagacttggaaccaacacaaatgtccatcaatgatagactggattaagaaaatgtggcacatatacaccatggaagactatgcagccataaaaaatgatgagttcatgtcctttgtagggacatggatgaagctggaaaccatcattctcagcaaactgtcacaaggacagaaatccaaacaccacatgttctcactcataggtgagaactgaacaatgagaacacatggacacaggaagaggaacatcacacactggggcctgttgtggggtggagggaggggggagggatagcattaggagatatacctaatgtaaatgacgagttgatgggtgcagcacagcaacatgacacatgtattcatatgtaacaaacctgcacgttttgcacatataccctataacttaaagtataataataattgaaaaattaaaaaataaaaataaaataaaaataaatctgtctctcccagtagactgtgggctcatggaagtcagggaccttgccttgttcatctttttatttccagggcatagggcaatacctgactagcacttaaaaaaattcacttaattaattatttactcagattaattgattgcttagtgtctagtatatgttcagtgtcgtataagccatggtatcctgctctgaagcagcttataattatcacaaagcagtacacatgataatataaattaagtgctgaattgtgcaaaaccatggcagatacttgtgggaaaggaatgctgtaggtaataatagtaatagcagctcacatttagctaaggcagtgtacttagcaatttaacttcattaactggttcaatcatcaaccatccttggaggcaagtacattattatctccattttacagatgaataaactcaagtatgggaaggttacataaactccgtcagtcacacagatctggaagtccaatccagatagaacaaaactcgcaacgttttttcacctttttttttcccatgtgtttaaattctatttcctctgtgctgaagcctccacaagtcctgtaagtcagcgatttctaaccatttttgaatcatgaaccttttggcagtctgttgaagtctagtgattgtgatctcttctcaggattatgcttttaaatgcataaaaataagtccatacgattacagagaaaagcaattataatgaaatagttataaaattattttaaaaaacaaatttgtgttatagtagtatgtgtttctatgacaactcattaacaaagtttaaaaagggatttaagagtaatgtagtttcggtgtagttcatgaacacaaacatattttgagagagctgcagtggaatgtaatgtgatatgaaaatatatgtgtttcttttggtgataatgacacaggcactgctagtactactgtactttattgtctaagtcataatataagtaaatgctatatcttagaggttagtgaatataaggatctaatgttttcccatcctagttcacagaccccctgaattctatccagattaaaaatccctgtttgcaaactacaactcgtccattttactgtgaaaacatctcttttatatatatatgtataggtatatatgcatatgcgtgtgtgtgtgtatatgtggatggatggatggatggatagattgattgatttagggggtataagtgtagttgtgttatatcatggatatactgcatggaccatctgggcttttagtgtacccatcacccaaatagtgtacacgtacccaataggtagtatttcatccctcacttccctccccccaccctctcattttgagaaatgcaaattaaaaccacaatgagatagcatcttaacaccagtcagaatggcttattactaaaaagtcaaaaaatggccaggcacagtagttcacgcctataatcccagcactttgggaggctgaggcaagaagatcacttgagcccaggagtttgaggctgcagtgagctttgatcacgtcactgtactccagcctaggatacagagagacaccatggtcttgcctcacatgtaggttacaaatgccgggaatatactctaatccatactgaaacaggaagtacttaagagcaaggtagaaccaacacgccctgcaggacgcctggatgacacctcacagatagcagatacctatttacaagataaattcatccatattttatatcatccccgtgtccctaaaaagagttggtgtctcctaaacagtttgaattttttttttcaaatagtgtttattcaagacagtaaattttaactcaccagcttaaccactctaaataaaactcccattcacccatctggattcagaggcaaaagaatgcttttcccaatgatcttatgaaaataagattctccatactgtcttatagaaactgtcaatgacaaaaatgaatattcttgacaactgtaagggggactatgtctttagtatgttttatgttgtgtcaaatgaaaattatcctcccaataagtactttgataatcaatacaaaattaaattttataaacaaaaccaatagtgtactaggaaacagacgaacaatgactgtcttagctaatcacaggcttgcgtacgttacttgtttaatgttccatgctttccaaaagcttaatctatccatttttatgacactgaaagagaaaagctttaaatatgtcaaggtgaagccagcccccactgtgactgtgctaacacaggtacacgtgttttctctcaagatctatccctgaagccaaagaaaagaaataaagctctaaaatagaagcttaatgataaaaagaactattgagtaaatctgacagaggattagcaaacgacatgcacgaaactgacttaagagtaacatttgagcaaacataaaacttatgatgctgtcagggtcatagagtcagggaaatgggattatttactcttaaaaacttttaaaaaagaacataaaagaaaattgtaaccgtaaaattaggaagagcttcctgatacaaaaaaaaaaaaaaaactatccacatataagatagagtttgcttgaatgaggtggataactaactataggtgttcaaagaaacattacttaaccttaagctgacaagataaagtaaaatgaataaaactaaataacttcctgaggaaaggcatttaaagttaaagagcatttccctgattaatgaaggagtaatcctgtaaaatggaatctgtggtcaaatggacctccccatcagaaagcttcagcagtgccacggctcagaattcctctaagtactaacttggcatttttccctcatgaaagacacagctttgctgacactggatttaaagaaccaagggtatcagagagcctgataaacaaatgtgcccttcaaaggattataaataggtatgagcgtaaattctttctgaactggggtgccagtttaaagtattaagactatggcatagcacaaacataagcatctcagatctgtcaaggtcctacctttgcaatgtgttagctctaaactgagcagcctttccttgggcctgggaattagaaaatgctacactgaagtaaattgcatgtgcttctttctgttattggcagctacctagcttgggttaaatttctaggccactggtgaaattgagaatttacaccagatttacttacccacagcccacctatatagatgtactatccttttttaagaatatacaagcagaagaaaagagaatgaagagttaacagaggtctagccctgccctctgccacaaatttgctaagtaggcatgaaaaattgacactctcagtttcacctaaaaatgcatgaagagagaagaggaaaatgctcaaacaagatgttttcctcagctatcctcaagcaacaaaattctacaatccatgcattatccagtcttcataacaaaatggatgccatcaagaatgcaggcaactttacagaacacactcacaggcagcagaaacccagatattgtatacaacaataggaatctcagacatgaaaacacattgtgcaaattcttactcaacacttaatttaaaatgccatccttagaatataagaaaatatgaagtgaaacacaatggttaatatcaaaaacagcaaatacaatgtgatctgcagagctcagtgcaaatttagaatatcacttctcattactggttatggatttcatctatgaatgtgttgacattttttatctcctcttgccacagcctgccaatcttggtttacttagcgatcaacaactcactacaaaaaaaataggctttttccagggcattattgcaaagtttaaaaggtatttagacaggtcaaacatcccttgaaatatgaaaagtaaatttttctattccaaagtaaaatgacaaaaatttttcatcaaaatatttaaatgccaatcttcccagctcctctctctctctagcttacaaacataagaccaagcaatgcagtatatctatcaaggataaaaaagtaaggtaattacataaaattttaaaagcctgaaaaggctcttagtttttacaaagaaatcaataaacaactgcaattatttttaagtaaatatgaagagttgaggtataatgttaggggaagaagagagataagtgaaatggaatgataccaatctgatagctggtggtagaaaattggagtagatattcccaaattccttgggaagaagctaatttctgaagtcaagttccttggtattctagactaggaagtaagagtgtgtataaagattgaaaaacaatgacctgaagatttgtcctgaaagtaaagtatcaagtcatgctcctttatttgttctttacagttttgggggactgcaagaatacctaggataaaggaaagagaagtacaacggaagaaattaacattcagacacttgtgcaactggagggagctttgtttttatttttttcaattttatttattttaaatttatcttttgatacattatatttgtacacattcatgggggcacttgtgatattctgttataggcataaggtaacactaatgataattttcttacatttgtaatgatcaaattagggtattcaggatgtctatcacccaagtatttattatattacaagtcgcctctcttctgttttgaaaaatacataattgttaactataggcaccctactctgctatcaaacattagaactttaactgtatgtttgtatccattacccaacctctctttaccctctatccaacacctgctcttcctagcctctggtatttatcattcgtttgctacctccatgtgatcaactctcttagattctacatatgagggaaatcatgcagaatttgtcctcctgtgtctggcttatttcacttaacacaatgacctccagttcaatccatgttgctgcagatgataggatttcattcttttttttacggtcaacagtattccattgtgtatatatatcacattatatttatccattcatctgttgatagacacttaggttgattccacatctttgctattgggaatagtgccacaataaacatgaggatgcaggtattcttttgacatattgatttaatttcctttggataaataccaagtaatgagattgctgaatcttatggtatttctatttttaattttttaaggaaactccatactgttttctgtagaggttgtactagtttacattcccaccaacagtatataggaaatcccttttctctacatacttgtcaacatctgttattttttgcctttttaataatagccattctaactgaggtgggatgatatttcattgtggtttttattttttcatatacatgttggccatttatatgtcttcttttgagaaatgtctatttatgccctttgcccatttttaacggtttttttttttttttttttttactgttgagtcctttgagctccttgtatattctggatattagtcccatcttcccccttctacagatagggaaacagttccaaagcaatggcatgagttgcaccaacataatcagctcttgaggagaacctaaatcacagaggtactaatacacgaggggtggtaactggaatgaagaggagcagcagcagagggaagtatgatgtaaatcattgttatcagtgatttataatcatgaaaacagaatccaaaggaaataaaatgaagtgtagtctctacctgaaatgtgaatgtgtctttcatcctaagagaacagaaaatgagtgaatattggaggtaagaaacttacaaaaaattaatgcaaaatacaaaaaacaaaatgaagaaaataatcacatcataacagagggttaagcatcttcttagtgtataaacaatgcctatatgaatcagtattaagaaaatgaacatgtaaatgggacataggacatgaacagataattcacaaagaaatatgaatgaccaatatagaaatgttaaacttcactaatagcaaataataataataagggaacctaaccattggcatttattttatgataataccaaatgtgcaagtaaaaacagcactcatatatggttatggtagaaaaacctgttactactttgagggcaatttaataatctgtataaataacctaaacagtgctcatcacctatcacccagtaattctacttgcagaaatttatccaagataataaacttatgactatgaacaattatttcagcatttactttttaatagtaaaaaatgaaaacataactaataagcaagatattaaataatatttagatacaagcacacaatgatttattatgcatttacttaaaaccatgtttatattgagtatctgatattaaagtatgctaatgtcatataaatcagattccagttttatacatacaaaacagaaacaccaaactgtaaaaggagttgctatagctattgaaattatacaggcggtatttgttttctttttctctctttttataatgtactatttttagagcagttttaggatgacaaaaacatttcttattttaaatatttcttaaatttgccaacataaacatatactacttctattaaaaagtgttcttaaaataatatcacagtagaaaatttctgaatttcacaattcaagacattttgcaaaaaaaggccagaattagaacatttttgagataaaaatgagtactgttccccaaatttcataataaacatattgaaaaatttttttttaattcattgaaggaatgaaggaatttgtcccattataaagcaggaaatctgaacagcaaatggtggtgggggtgggggtggcaacaacaaagctgattttaatacttttttggtaacttttaaaagattaaatacctctctctcatttattctttggaaccaaagtagaacataaacaaatgaaaacagtaagaaaactatacatcctttctgaaaagttgtgaacaaagccaagtcacaaattttttttttttttaagaagctctagcatccatattttgtacaacagcagaacttgaaagtttgtattatgctgaaagcagctagtaagcaactgtatactgccttttggaaatctacaagagaaagaccatttacttttccacatgtccactgtaaatcacattgtcatttgttatatttggataaagtgcacctgaattctgtgaaacagaagcagatatctgaggggaagaatagcttggaaagtaacaaattgcaatcaacctatgtttacctaactgcagagtcagatgatgtttcctaaattgaaaaatagaccaaaaccaaaaaatggccaaaaacgaagagcaaacacttgtagaatttgtgtacattttagcacttcctttagacaatgaggtgcttaaagaaaaaaaaaaggtgaagaggggaaaaaaaaacccttcaattaacaaaaaagatgaaagtgcagcagaatcaaacaacaattaggaaccgcaaaattatcaagattataactgccaacttttattaagtagttaggtatgctacctgccatttctttcttctcttcctattctggtccgtccctctaccatcatgtctgccaacttaggtggtttagatatttgggtcaatttttaattatgccaactgtgtgtgtgagaatattgaagaaatttcacaaacatacttctttattattcttgttacttataatacttaagacatcttattaaaaatatgatataaattatattgttacataaaaatcattatcattcctcagtatatgcttttatgtaacatgttgaacagtattcatagtaaatattaattataactaacatatacacacaaagacaccccccacccaagaaaacaccacatagaaatacccaaaaagatctaatcctggaataatctagctgaaagaaattatttcctttaaaaaaatgtaccaagaagaaatgaattttgtcaaataacgtggagaaaaagaaatatatctcgggtttcataccaagatcccaggtattaaagtaaaccgaatatctgaaggtacaaccactataagaacagacagaaaactttttttttttgagatggagtaattgtctatagactatatagacctacaatcaagatggaaaaggctattcataaaaatcattcaagaaatagcaatcataaagctgagagagaaaaataatagcaaacagattttgagaaaatgtatatactacgagtacaaagatatcttttcaatttaatttgtaatacacatttattaggattgttcatatatatattgttgaagaatataatataatatatattctaggattagatctttttgggtatttctatgtgctattttcttgggtgggggtgtctttgtaatatatatttgtgtataatatatattatgtaataaatacatatatttacattatatattatatataattatatattacatatcattatatattatatataatccttcaagccaatccttcaacatacattatgtatataatatatatacattatatattatatacataatgtatattatatataatatacattatatatgctatgtatattatatgatatacattatatatgctatgtataatatatattatataatatacattatatattatgtataatacatattatatacagattcagaaatggctatcacagctaaaggattgtaaacataataaatgagcaaattaccacttaaagattattaatagttgacaacagctgcatacagcaaacaatatatataacatccctgaaaac

SEQ ID NO: 155 - DNA, 206955 bp, Homo sapiens
tgccattagttcattagtttagtgaaaggtaaaatgatttttgggggaaaactttggtgttcaaaaaagtattcaattcaatttctggcaaaagcaagaattctcaactattaggtaccagttttatataaactttgaaataaactttgaaatgttaaatgttaaaattaatggatatttgctgaagtacaacactaactcagaacaatatattaaggtggaggggtgagggacagatcagcctcaaaaattataaattagtggaatttttaattaaatgctattgtatttcaaaagcagtatatattgcaagcaaatattaaggcaggttaaccagttcacagaagctttactgcaaccaacctaaaggtctatcactagaatagaaaaacaaattgtgatatatccatacaatggaagagtactcagctcatgccaacataaatgactttcataaacattagatcaattgaaagaagctggacacaaagaatataaaatacaaaaattagctgggcgtggtggcacatgcttgtaatcccagctactccggagacatgagaatcgcttgaacctaggagacggaggttgcagcgagcggagactgtaccaatgcactccagcctgggcgacagagctagactctctcttaaaaataaataaataagtaaaattctgtatgattccttttatatcaagttccagaataggcaacactaatctgaggtgaaaaagaaaaaaaatcaaaacagcaattgcctcaggacagatggctattgactgggaaggtgaaaatgaaaaacatagtgtcttggtgagtgtgtgggtcaccggggcttactgtttgtcaaaatcctacagctgagatttgtacactttaatatatgtaaattttacctgaaaaaaaagagccataaatcattatcaagcaggagatagaaactgggtgaaggcatagatgatacaagaatggcaaaatgttgatcactgttgaatctgggcaatggtagaaagaggttataccattttgtgttctttgcatatgtttcaaatttttcataagaaaaagcttttagctgggcgtggtggctcacacctgtaatcccagcactttgggaggccaaggtgggtggatcacttgaggtcaggagttcgagaccatcctggctaacacagtgtaacaccatctctactaaaaaaaaaaataccaaaaaaattagccaggtgtggtggcacatgcctgtagtcccagctacctgggaggctgaggcaggagaatcacgtgaacccaggaggctgagcttgcagtgagatgagatcgcaccactgcactccagcctgggcgacagagcgagactccatctcaaaaaaaaaaaaagaagaagaatctctgcattaagtcctaaatatgatatacccatcaggtacccgtagttctcccaggccagatgcaatctatcaattaggggtcaattttgtcatgaaaatgttgtctacaatatagctgacattctacagttatcaggtaccagatgtataatcaaagtagcttatactttcagaaaatagtgacagcattacttctggtcccacatggctcttccaaaacattgccacatatccatcaagagagactctatcttccctccctgaaaaccaggggaaactttgtgactgccagatagaagtaacacactgtgacttctgaggttagatcaaataatgtgatacagctttcagtttgatccctcaagacatttgtctttggaacccagctaccaggcaagaagcccaggccacatcgaaaggccatgggttagtgtattggccaagagcccgagctaaagcctcagccaacagccagtatcaaccactggaaaagtgccttcagacgattccagatcccagccttgaatctaccttagctaaagatgagcagagaagacataagctctccacttgggaccctgcttcccaaactgtgccctaaggcactctggggcaccacaggaaaatacaaccgcatctgtcaataatgatgtaaactaagcagttcacagtaacattgcagcagtccatatctgcagggattgggggatgtggggccatgggacacaggcattatttccaagaacagctgtggccacccccaggatggatgcacaagccccttatataaaaaggcagagtacctgcatataagtaatacacatcctcccgaatacttttaaatcatctctagattacttataatacctaattatgtaagtagttgttatactgtatattttttatgttttcaatcagattttggttgaatctgtggatgcagaacctgcgcatacagagggccacctgtatattgccccattcctatcaataacattatatctttgttaagatggtttctcaggagtggttgtgataaaaacaaatatcccaggaaaatcaatgtggaacagggatgaacacggtaatgtccaatcttattacaaggctaggtcattaaaaagaaaatacagctttctcttggctcactttctcttgaaacacccgctccggaacccagcgaccatgtagtgagaaagcccaggccacgaggaaagccacatgtaggtgtttctgctaaccaccccagctaaggtctcagctgacagccagcaaaaactgccagacctatgagtgagaaaacttcaaacgattccagcctcagacttccatgccttccaactgaggccccagacatcacagagcacagactggccttccccactgtgttctagccaaattgctaacccacagaatctgtgagcataatgaatgaatgttttatgccactatgtttgggaggtagtgtagctatggtaaccatatcaatgaaggttcaatatataatacaaagaaaaaaagcaggctatgtgtgaagcaatgatgacagtgccttatgaagcaaagatcatgactaacctaatcccgtgcaccttagagtccttgaaaaagggggaggggaggcaaaaatcattaaaagacacatttttaaacctcaacacaggccgggtgcggtggctcacgcctgtaatcccagcactttgggaggccgaggcggggagatcacgaggtcaggagatcgagaccgtcttggctaacacggtgaaaccccgtctctactaaaaatacaaaaaattagccaggtgtggtgatgcacgcctgtagtctcagctactcgggaggctgaggcaggagaatcgcttaaaccctggaggcggaggttgcagtgagccgcgatcgcaccactgcactccagcctaggcgaaagagcgagactctgtctcaaacaaacaaacaaacaaaaacctgctgccctgtgaattagcatttcctttcagtctttattactgatgtagaatcaaaatgagacctaggtttcatttttcaaaaatggccttatggccgggcacggtggctcacgcctataagtaatcccaacactttgggaggcagaggcaggtggatcactggaggtcaggagtttgagaccagcctggccaacatggtgaaaccccgtctctactaaaaaaacacacaagaaaaattagccgggcgtgctggctgatgcctgtaatcccagctgctcaggaggctgaggcagaagaatcaattgaactcaggaggtgggggctgcagtgagccgagattgtgccactgcacttcagcctgggcgacagagtgagactcttatcagagtgagactcaagaaaaaaaaacacataagaatttaggccggtgcgcggtggctcacgcctgtaatcccagcactttgggaagccgaagtgggaagatcacttgaggccaggggttcgagaccagcctggccaaaatggtgaaaccccgactctactaaaaatgcaaaaattagcctggcgtggtggcgagtgcctgtaatcccagctactcgaggggctgagacaggagaatcgcttgaacccgggaggcggaggctgcagtgagctgagatctcaccattgcgctccagcctgggcaacagagtgagacctggtctcaaaaaaaaaaagaaagatgcaagtgcgcttttacctgtccttcatgaaatggggaaccatgaccccagaaaagatgtggggttcccaaacttggaagggcatgagaataaatctggtgggaaatgttggctaataggacacatgggaaccactagcctaaaattccataaaggcattcccaagtttacatcaacattttcctgtcctctcaaaaaataatcaaggtggggaggtgagattttgtgatgctaaaacatagcttacattgagcagaccttcctgagatccaccaacactaatagaaactttgtgactgaatgctctacacagtacacttggggatgcttactttatcttatttgtaaataaactttaaaaaaaaattgaagcataactttttcaaaagacaaaattacagcaaatttagtttaattggcttttatttgtgattctagaatagggcaacatctcattcggtaaaataaaatgagtgttctagtgagttgagcagaggggtttggctttataggcacaaaagggttgaagaaaatagaaaaagggaacaaaaatcagattggtcatttcgaagttaccttccttatagggttaaaacagaggggatttccttatcattgtgttggctcaggtaaactagaccccctctgattggtgctgtgaatctcctgcttttggaaaactgcccccgatttcaaagttcagtttgattacttggcacaagtgactattcttctttggtctggtgtgctgcaggctagtacaggaagcttgtccaaaactatggcctcctataaactttaacaacttcaatacagaaaagtacatgaattataaatatgttgatgaaaatgtatttttgttatttttgagatggagtcttgctctgtcacccaggctggagtgcaatggtgcaatctcagctcactgcaacctccacctcccaggttcaagcgatccccctgccctagcctcccaagtagctgggaggcatgcgccaccacacctggctaatttttacatttttagtagagacatggtttcaccatgttggccaggctggtctgaactcctgacctcaggtgatccgcccacctccacctcccaaaatgcagggattacaggcatgagccaccgcacctaaccaaaaatgtgtttaaggaatgatcacagagttatattcacctatataaacctccacatggatcaataaacataatattagcaatagggcacacttttctgatatcacttgatacccagttgaaaatccattcttgagtatactaagtagtccatctggatcacatttaatagttacttcaccttttttcaatttcttataatatccttcaaatgggtttttaaaaaccctaaaaactcatagtacagtttgaagtcaggtagcgtgaagcctccagctttgttcttttggcttaggattgacttggcaatgagggctcttttttgcttccatatgaactttaaagtagttttttccaattctgtgaagaaagtcattggtagcttgatggggatggcattgaatctataaattactttgggcagtatggccattttcacgatatcaattcttcctacccatgagcatggaatgttcttccttttgtttgtatcctcttttatttcattgagcagtggtttgtagttctccttgaagaggtccttcatgtcccttgtaagttggattcctaggtattttattctctttgaagcaattgtgaatgggagttcactcatgatttggctctctgtttgtctgttattggtgtataagaatgctttgatttttgcacattgattttgtttcctgagactttgctgaagttgcctatcagcttaaggagattttgggctgagacgatggtgttttctagatatacaaccatgtcatctgcaaacagggacaatttgacctcctcttttcctaattgaataccctttatttccttctcctgcctgattgccctggccagaacttccaacactatgttgaatgggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttaacatgaagggctgttgaattttgttaaaggccttttctgcatctattgagataatcatgtggtttttgtcgttggttctgtttatatgctggattacgtttattgatttgtgtatgttgaaccagccttgcatcccagggatgaagcccacttgatcatggtggatacgccttttgatgtgctgctggattcggtttgccagtattttattgaggatttttgcatcgatgttcatcagggatattggtctaaaattctttttttggttgtgtctctgccaggctttggtatcaggatgatgctggcctcataaaatgagttagggaggattccctctttttctattgattggaataatttcagaaggaatggtaccagctcctccttgtacctctggtagaattgagctgtgaatccatctggtcctggactttttttggttggtaagctattaattattgcatcaatttcagagcctgttactggtctattcagagatttaacttcttcctggtttagtcttgggagggtgtatgtgtcgaggaatttatccatttcttctagattttctagtttatttgcgtagaggtgtttatagtattctctgatggtagtttgtatttgtgtgggatcagtgatgatatcccctttatcattttttattgcatctatttgatgctatctgacttcaaactgtactacaaggctacagtaaccaaaacagcatggtactggtaccaaaacagagatatagaccaatgaaacagaacagagccctcagaaataatgccgcatatctacaaccatctgatctttgacaaacctgacaaaaacaagaaatggggaaatgattccctatttaataaatggtgctgggaaaactggctagccataggtagaaagctgaaactggatcccttccttacacaccttatacaaaaattaattcaagatggattaaagacttaaatgttagacctaaaaccataaaaaccctagaagaaaacctaggcaataccattcaggacataggcatgggcaaggactttatgtctaaaacaccaaaagcaatggcaacaaaagccaaaattgacaaatgggatctaattaaactaaagagcttctgcacaacaaaagaaactatcatcagagtgaacaggcaacctacagaatgggagaaaatttttgcaatctactcatctgacaaagggctaatatccagaatctacaatgaactcaaacaaatttacaagaaaaaaacaaccccatcaacaagtgggcaaaggatatgaacagacacttctcgaaagaagacatttatgcagccaaaagacacatgaaaaaatgttcatcatcactggccatcagagaaatgcaaatcaaaaccacaatgagataccatctcacaccagttagaatggtgatcattaaaaagtcaggaaacaacaggtgctggacaggatgtggagatattggaacacttttacactgttggtgggattctaaactagttcaaccattgtggaagtcagtgtggcgattcctcagggatctagaactagaaataccatttgacccagccatcccattactgggtatatacccaaaggattataaaacacgctgctataaagacacatgcacacgtatgtttattgcagcactattcacaatagcaaagacttggaaccaagccaaatgtccaacaatgatagactggattaagaaaaagtggtacatatacaccatggaatactatgcagccataaaaaaggatgagttcatgtcctttgtagggacatggatgaagctggaaaccatcattctcagcaaactatcccaaggacaaaaagccaaacaccgcatgttctcactcataggtgggaattgaacaatgagaacacacggacacaggaaggggaacatcacccactggggcctcttgtggggtgggggaagcggggagggatagcattaagagatatacctaatgttaaatgacgggttaatgggtgcagcacaccaacatggcacatgtacacatatgtaacaaatctgcacgttgtgcacatgtaccctaaaacttaaagtataattttaaaaaaaccagaaaaaaataaaaataaaaaccctaaaaactcttgacaaaggagatggaaacttccatctcaatttcacagtttcctctaggggaagatcttgtcccagttaccctgttcttaatctactctaaggtagtgcagacacagtaaattacctccctgctgcatgagggcagataggctgtgactatatgaaagtgcccgaccgagggtcacaagcaggaattgaaatttagccttctctaccatttggttccttcaactatcactttcttataaaagaggctttgtttgactaccgtggttaatgtagtctcatccagttgcactctggcagggattgctcttgtccacctatagccatcctcgtctggaattttagctggacatgtggccacagagatagagactacattgcccagcttcccttgcagatagatgtgtcatggactagaagttctaatcaatagaatgtgaacagaagtgatgtacccttaaaaaaatgggcacatattcccacaacctttttctcctttctcctagttggaatacagacaagatgataggaattgaagcaactagacaacagaaaaatggaaggttgtagagatgtgggtgacaaaggcattctacatgtgtatttcaccacctccttcagacagttaaggagaaaagaggaggaacccacttccatcttgtttaaatgtatttcccagtctctttgttacaagtagcctaggctgtaccttaactaaggtacccttgatgtcaaaacattgtttcattttctacagagtatttatcgatgatctgaaattatctcatatatttatgtgctaaaatgcttgtctatcttgccgtgacagaatatgtgcttcacgaaggcatggactttgtcttatcagctgctgcaagcttagttcttagaactgtacctgcaattaaaaataggtgctcagaaaatatttggtgaataaattaactgtttccaactaaaaaggaagagacaggtgcagagggatcttaagtaatttgcccaacttcatacagctaataagtggcaaagccacattctaactcaggaccatctgatatacttgttcattctggaatagctgagggtctcttactttagtcatgtgtaaaagtcacacgggggtgtttgttaacacacattactgagtagtagctcagacacactgactcagtagatctcaatctgagaatccaacaaggaccccaggtgattctgcaggtgttcctctgacagagctttgagaaacattgccatgtccctatgtcttatttagctattcaaaactctgcaggcccttagaatacacataaagaagttgatgtaattggtacagtactaaaggtaaaaatctgaaacaatatggatggatctcaaaggcattatgctaagtgaaagaagccagacataagatgaccaatcctgtatgattccatttacatgacattgcgaagacaaagctatagggacacaaatctgatccctggttaccaggaaaaagagatggaaggaaggaattgatgacagaggggcaggaggaccctgttgggggatattgaaacagtctattaagagattgctaagactctggtgggcttatatgacctctcacatttgtcaaatctcataaatctgtacacctatactgtgaattttactacatataaattatacctcaataaacctgacttttaggctgagcacggtggctcatgcctgtgatcccagtactttgggaggccaaggcaggaagatcacttgagcccaggagttcaagaccagcctgggcaatgtagggagaccctgtctctacaaaaaaagcatcaaaaaattagccaggcatggtgcacctgtggtcccagctacttgggaggctgaggtgggaggattgcttgagcccagaaggtggaggctacagtgagcagtgattgagccactgcactccaacctgtctctaaataaataaataaatttagagacaaccctgtctctaaataaataaataagactttaataaaaaagagaattaatagggtagttctagttagccataaattaaaccataaagagaatttcaataaattccccacaaatttcaaaagtctgtgctttgaaaaactaatataacttgtgtaattttttttccagagcaatcatttatgagagtgacaaaaataaagccagaaagtagaagatgtttttcctcttctaactttctattatggtatttgattcaccagtcattttcttcccagggccccctggaaatgtactctttagaaacaaggcacctttggcaagaaatagaaaatcaactgaaattgctcctgatatagatcggtgactttgtcctaggtatctcataaaattctatactaattaactcaacaagccttacaagaaaatgaagaaacaaaatcatcctatattccagttatccattgctgcaaaacaaaccatcctaacacttagtatcttaaaacaacaatttattatctgtcctagttctgtggtggacggggctcagctaggtggtccctactttgatctctcatgtggttgccatcagataagactgaatgtccaggatggtttcttcacccacacatctgatgcctcagctggaatagctggaagaaacaggggctgactgggcctctctctacacctttgccctataacctttgtacctggctaggttgggcttcctcaaaacatggcatctcagcatatttggacttcttacagagcagctgacttgccttaaagtgagcattcattcacaccaggttatagctgcacagaatggaaagtcacatagcatcactttcatcacattctactggtgcagaatgagtcacagggccagtccagattcaaagggaaggaactacatttccttgctggtaccagtagcagtggctcactgggggaccattttcagagacttgctaccacatcctaggaaacttttaattaattccattcatttcatcagtgtattcttttttaaaaatttatttttaaatttttttgtgggtacatagtaggtgtatatatttatggagtgcatgacatgttttgatataggcatgcaatgcatattaatcacatcatggagaatggagtactcaagcatttatcctttgaattacaaacaatccaattacattctttaaggtatttaaaaatatacaattaagttattgactatagtcactctgctgtgctgttaaatagtaggtcttattcattctttctatttttgtacccactaaccatccccacctcccccaaccaactccccaccacccttctcagcctctggtaaccattcttctactctctatgaccatgagttcaattgttttgagttttagatcccaccaataagtgagaacatgagatgtttgtttttctgttctgagcttatttcatttagcataatgacctccagttccatccatattgttgcacagactggaactcattcttttctatggctgaatagtactccattgtgtatatataccacattttatttatccattcgttgatgggcacttaggttgttcccaaatcttagctatagtaaacagtgctgcaacaaacacaggagtgtggatatctcttctatagtcagatttcctgtcttttgggtatatacccagcagtgggattgttggatgacaaagtagctcaatttttagttttttgaggaacctccaaactgttctccatagtggctgtattaatttacattcccaccaacagtgtacaagggtttccttttctccacctcctcaccagcatctgttattacctgtcttctggatataagccatcttaactggggtgaaatgatatctcattgtagttttgatttgcatgtatctgatgatctatgatgttgagcacctcttcataggtctgtttgccacttgttttcttttgagaaatacctattcaaatctttttgtcattttttgatcagattattagattttttttcctatagagttgtttgagctccttatatattctggttattaatcccttgtcagatggctagtttgcagatattttctcacattctgtgggttgtcttttcactttgttgattgtatccttggctgtgcagaagcttattaacttgatgtgatcccatttgtccatttttgctttggttgcctgtgcttatggaatattgctcaagaaatttttgcccagaccaatgtcttggagatttttctcaatgttttcttgtagcagttttatagtttgagttcttaagtctttcatccattttgatttgatttttgtacatggggagagatagtggtctagttttattcttttgcatatggatatccagttttcccagcaccctttattgaagagactctcttttccccaatgtatgtctgggcaccttcgttgaaagtgagttcactgtggtgtatgaatttgtttctgggttctctattctgtttcattggtctatgtgtctgtttttatgcaagtaccatgctgttttggctactatagctctctagtataatttgattatactagagattggaggaatcacattatagtattataatttgttccaattttgttctttttgcttaggattgctttggctactctgggtcttttgtggttccatgtaaattgtaggattttttttttctatctctgtgaagaatgtcattggtattttgatagggattgcattgaatctgtagattgctttggatagaatggacattttaaaaatatcaattcttccaatccatgaacatggaatgtctttccattttttggtgtcctcttcaatttccttcatccatcttttatgactttcattatagagacctttcacatctttggttaattcctaggtatttaattttatgtgtggctattgtaaatgggattactttttaaatttctttttcacattgttcactattgacatatataaatgctactgattttttgtatgttaattttgaatcctgcaactttactgaatttgtttatcagttctattagttttcttgtggattctttaggtttttcctcatcagtcaattctgatggcttcttttttttggtttaatttccaaccatcttgatgatcttttaacaacttcatattttgcttcatatacaattttgtaaagagctgccacacacatttaatttgatcatcataacaatcaaggtaggcaaggcaagaattttttttttttttttttttgagacagagtctcgctctgtcgcccaggctggagttctgtggtgccatctcggctcactgcaatctccacctcccaggttcaagggattcttatgcctcagcctcccaagtagctgggattacaagtatgtgccaccacacctggctactttctgttttgttttttgtttgtttgtttgttttttggagacggagtcttgctctggggtgcagtggcatgatctctgctcactgcaagctctgcctcccgggttcatgccattctcctgcctcagccacccgagtagctgggactacaggtgcccgccaccacgcctggctaattttttgtgtttttgtagtagagactggtttcaccctgttggtcaggctggtctcgaactcctgacctcaagtgatctgcccacctcagcctcccaaagtgctgggattacaggcatgagccactgcgtccagcctccttaactctttaatacatggagacagttctcaggtaaagaggcaaggcagggggctggtacaatttgtggactaagcaatttgaagggtgccacgtgtcataataggctgctcacaaaatgttcatcactagaaaaagaaaattctaatatatgttcttaaatgacttgaaattttctcccaagaaagaaaaagccagagaataaagcaatcacactaagcctccagtgctcaggtgttgagtagacacagcggaacattgccatgctgcaggataggtgcaaccaggcagccaggccctgcctttctctgtgggactttgagcaagtttttgcaccctctctgtgtctcagttgccttatcagtggaaaagggaataatgtcagcacctaccttgcagggttgctctgaggattaaatgggttaaaatatggaatagtgcttatagcagtgtctagcacagagtatgcactatataagtgtttgcagctgttatagtcaaaatggaaaggtggaatggaaatatcctttgaaagtctacataggccaggtgcagtggttcacacctgtaatcccagcactttggtaggccaaggtgggtggatcacctgaggtcaggagttcaagatcagcctgaccaacacagtgaaaccctgcctctactgaaaataaaaaatctaaccaggcatggtggtgcatacttgtagtcccagctactcaggaggctgaggcagaagaattgcttgaaccccagaaacagaggttgcagtgagcagagatcgcgcccctgcactccagcctgggtgacaaagcgagactccatctcaaaaaaaaaataaaaaataaaaaaattttttttaaaagtctatataaaatcaaggaagttatacaaaaaaacaattttgggtgaggttgttatctagaaggttagtaaacactggtctttataaggatatcttctgatttctaatgtagccactcctagagaacacaatttttttagcaattactacttatggatgtaagagtgaactttcattagtcgaccttatcaaacagtccagaatgttgttaagaatgttaatatattgccacatgcaagggctgaagaaaatgaaataatgttaagaaataagaatattgtttccagctattaataattcatggtgctgcagaatcttgaatctatcactaaaaggcataagtctaagtgaaaatagcgttgctcttgcattccattgtattataaagcaataaatatatttagcactggatgttatgaagagtttttctgtattccaaagtatagcatatctttggatgaagccagcctgaaaacttaggattggtcctatcctgagatacagataggcattctcagtcttctccagtgggatgagcagataggaaggaccagtgtcaagaatctgacttgctctgggaggttgcatgggtgcagaaggaccacccggaagggattggtccagctgcccaaatgaaatatttgaagcgtgtgtgtgtgtgtgtgtgtgtgtgtgtgtgtgtgtgtgtgtgtccagctggtctatcttataaaccagatcaaattacagtatcaaacacagcctaaaacagcattttaggaggccgaggtgtgtggatttcttgagcccagatgttagagaccagctggacaacatggcaaaaccccatctccataaaaaataccaaaaaaaaattagctgggtgtggtggcatgcacttgcagtcccaactacttgggaggtggatgtgggaggattgcttgcacccaggagacgaaggctgcagtgagccatgatcatgtcactgcactcaggctgggtgacagagttcagagcctgtctcaaaaaaatagcaatagatgaacatacatgcatgtttatataatacatagatagatattagtgtaaatgtataacactgtgtgaagaatgaagctttagtccccttaaatacacggatgagtatgacttgctccctgcttcaaggggctggtgatccagcagggatcacagatgtggagcaggtaatctaaccagatatgcaatgcaacaggtgccaggcttgtgggggcccagagaggttgcacccagatggatgagtcttctagatcccattaccttcttcacaaggtctttagagcccaaagccaaatgacaaagtaagggggaggggcacggaaaggccctcagcagcggaacttaccggagaggggcacggagaggcccgcagcaacagaacttccgggggaggggcacggaaaggcccgcagcagcggaacttccgggggagaggcacggaaaggcccgcagcagcggaacttacaggagatcagacagaagcggaagtggtttcgtgcccttcaagttagattatctagatactcatctttcccctccatgaaaaatgactcattcttagtacatttatgtgtaaaattgctttggattttaagtgcatggaagaccaggatcatgtcacactaatgtgtattgcacagcatgtgacatagaactgagttgaaacagtgcttagcacataatttttggagatgacagagatatgaccaggcagaactgtcctcaggacactttctaaagtacatcaaagtactctggttcccccagcccatcctcttgacttcttgtactcattctctcctgtcccttggccgtctctatgtggccttctagcttcttagagcctccttgctttgggtctcacccacacctgacacccttgccaagaccgctctaaattagcctttcctcccctctcctacacctgtcaaacccctctctcatctatccaccagggggagggctatattattaaactaacactaatgtatgaaagcccacattgctagcttattgtactaactatctcaagaaaatttaatttttaaaagaggtgctttcaaatttcaataagcaaaggcttcagctgagattattttcttcttgcattcctagccctctcaagttatgccttcggcaaactgcttctctaagtgctaacccaagctggcccttagatgcatttgttatgttcaagtgccctctggaggcaaaaacagtctcctgttagatgaaagacaggcctgccaaagacccacaaatgattggtccctgtactgtggggttcattcattcctttccatctttctttctgcaggtccagcacagccttgccttggggccttcagcttaggcacggaatcttctttggcctggaatagccgtcccaaagactgtcccatgattggttccttcacaccatctgctttagctcagcagggctttctcaggagtacatcgcatctagccaagccgaccttcccgctctgtcatgtcgggccgtttccttgccttcttgcacacagcactatctgaaataatctccttccagtcattcagcacattcattgagtgcctgctcgtatgccctgtcttatgcacttgggatagatcaaggtacaaatgcaacaccttctctaccctggtggaatttacaggccttgtgaattacattgtttcctttttcatcatccgcctctggctaaaatgtaagctctaggggagcagggacctctgtcagccttgttctctactttttcccaagagcctagaactgtgtctggtacatccttcatggtcaatcaatatttgtggaatgaataaacaaatgtttatattaaccaggcacaatggctgaggggagaggatagcttgataccaggagttcgataccagcctgagcaacatagcaagacccccgtctctaaaaaataaaaatgttttatattttctatcaggatacacaattaacattttaaacttcttttgctgtgacaaagttaattcattccattatcacaactataaaaaatgaggcaaactatatacctcattgttattcaaatgatcaatagcaataatagcatttattgaccacttactaagtactagaggctgtaataagtgctttatatgtatcatctcatcttcacaaatttttctgaggcaagtaacaccattcttcccttttttttttttttttttttgagacagagtctcgctctgttgcccaggctagggtacagtggcccatctcggctcactgcaacctctgcctccctggttcaaatgattcttctgccttggcctccagagtagctgggactacaggtgcatgccaccacgcccagctaattttttttgtgtgtgtgtttttagtagagacggggtttcaccatattggccaggctgatctcaaactcctgatctcatgatctgcccacctcagcctcccaaagtgctgggattacaggagtgagccaccacacctgacccagtcttccatttttaacatgagaaatttgaggcttacaggagcttctcaccatcacaaggtcatcttctggggactggatagtcaacccagagtccatgccgtcaacctcctccacacagccacgttcaaatcacgatgtctgcattactcagcggctccctctaccatcctctaaaactctacactctcttagcagggcctgtgagacccctcaagatcagctctgcctcctttgctggtctccttcccattacctctcctcctaccctgactggagcccctgtagctcctggacacggtcatgccttcccctacctccttgcaatcctatggtgtgctccctccttctgccctgcctaactcctactcctgcttcaagactcagctcttgccacccccccagaccctttcctggcgctctgggctaggttctgtgcccatgcactgctgctcccagctccctgtgcctggctctgtgattcttagtgaatggaatgaggtgtggcttttcatctccaaatttccagggcttagttggaacagagaggttggcaaaatgaatgatggagcatttgggaattggccatgttttacaattttagacacagtgaggaaaagaatactattgtaaataagacggttagggctgggcacaatggctaacacctgtaatcccagcacttagagaggctgagataggaggatcatttgagaccaggagttcgacaccagcctggtcaacataatgagattccgccttctttataaacaaacacacaaacaaaataatttaaaaattagccaggtgtggtggcacatgcctatagtttcagctacttaggaggctgaggcaggaggatcatttgaacacgacagctcggggctgcagtgagctataatcaagccactgcacttcagcctggccaacagagtgagaccttgtctctagaaataaataaattaataaaataaaataagagggttagaatgtggcccatgggagtcctcaaaggtgcaattgcatgaagctgagaagcagcagcatggagcagggagtacttagagtgtcacctggcagaacctgatctttcctctcattcccaccccaagagacttttccaactcatccagctggaagcagagaggctaggattttcccctcaggtgtctgacccagagcctgcatgctaagtcctaaggtgatggcgtctcaactgcgctgggcctttatttgtgagctttcaatggttgtatctgcctgtgtttgaccagaataattaatttaataaaagcactttaaaaatgtttgtaaacggctaagtatctagtgttgggtaccatataagtatttagatacaaaaggtctaaattcaggttatttttactgggggaaccattattaatatgattataaaatagtacactgcggatctgtacacacgagagagagaagttgtgtacacgtgctacttcacaacaatgatgcaattcaacagatttatgacaacgattcctttagacagatactgactaaaacttaccaggggcagggccctgggccaggcaaggagtaagtcacagctcctgggcctcagcagggaacactaagatacaagtacttgcccttgctgggtggagtagctcacacctgtaatcctagcagtttgggaggccaaggcaggaggatcacttgagaccaggagttcaagaccagcctgggcaacatggcaaaatgccatctctacagaaaaatacaaaaattatctgaaggtggtggcgcacacctttggtactcaggagactgagatgggaggatcgcctgagcccaggagtttgaggcttcagtgagctgtgatcatgccactgcactgcagcctgggtgacagagcaagaccctgttcccctcaagccgcaccaccaaaaaaaaaaatatatatatacttgcccttgtggttggagccacaggggccatgagttcagcagggactcccgccggctgctccaagccactctcccagcactccctgctctattctcctgcagaaccaaactgcttaccgttccccaaatgtgctctgccggttcacacctctgtgcctttgcatgtttcctcagactggaatgctcagtcagtgcagagtggacatgtgtcatgtgttctggctgcttagcagggtttgaaaaccctgcctatgttctgggaatttcctaacacaagaatgagtcctgcctctccaaggcagatgccagagcaagcagggtacaggcacatgacccagcctccctccatcagctgtgtctacacgagatactaacttagacatgagcaatccaaggcagtagacacagtgtggaagtgatgtatcaggcaatgctggtacagaggcgccaggctttggaggagcaatagttaccaggctgtggccctggcacaagaagaggcagcgtcacaaaccgtcatatccagagctctagaggggcagcggcgtggtttccattacaggccaggtctgcggtgggcgtagggccttgtttcaggaaactcttcatggcactttacctccccatccagaagagtcactctatatccttttaatcattttaatcaatctcttttatgcttttgttgattacaactaagagtctggcttagttgcaactcttccaacccctgtggtaggtgatacaccaacctacattaatcctgttaacaaaaggccacttactttgcaaaatccatgttggcatgaaggtctcctgtgggcctcccctgaaatcttctattccgtccttgatccatgccctcctggggtgccctcactacccacacgcctctcgcctcatgcccccctggattagaattgcctgtttcttctgcctctgcttggaccatgatttatttgaggctagccattggctctttcacttctgcatttccagcagttagtttgggttgacagcgtccaacacatgataggtactaaagggaagtttgttattgagaggaaggaatgctccagtttgctttctgagaaccaggaatcagaaacaggtgctatgaggtggctgcgtctaacatagatctcggtgaatggcagggattttaacaggcggaattggtggggatcatcctgcccataagacaaattattatatccctcagcattttcccatatccttaatatactgtatgtgacattctcagttgcacaacaacccttcccttgcccttctttttttcaggtttgggtggtgatgtctccgggaaggtggaccctcccacagccccaaggggatgagttttcattgctctaaaccaggggttgaccaactacagcctgctagccaaacctggcctgccacctgtttttttatgtcctcacaccatacaaaatgctttttacagttttaaacagttgggggaaaaaaaagaaaaaattctttgtgagaggtaaaaaatatataaaattcaagtttcaatgtccacagacacactggaacacaggcataggtatttgtttctggtgtgtctagctgctttggctctacaatggcagagctaaatatatgtgacagggaccgcacaccctgcaaagcctgacatatttactggctgattctcttcagaagaagtttgctgaccctgttctcaagcaatcatgctaatgccaatctccttccagtattgatttttgggaggagcataagacccatttctgggccaatgaaacacaaaaggaagcctgacagagggctgctgggaaagattgttttctctgatgagagggagatatgtgagcatgcttccttcttgcctttggatgttgcatgtgaggatgtgataggcagagctgtggcagccatctagtcatgagggaaaagctaagagaaccacagagaagctgcccccagatactgttgagctgttaaataaaccagctctggaacttcctacttctagaattttttaacactcaaaataaatatactaggctgggcacagtggctcatcctgtaatcccagcactttaggaagctgaggtgggaggatcacttgagcccagcagtttgagaccagtctgagaaatatagtgagacccttgtctctacaaaaaaaaaaaaacaaaaaaaaaaaaactagctgggtatactggcacacaactatagtcctagttactggggaggctgaggtggaaggatggcttgaacccaggagttcaaggctttggtgagctatgatcatgccactgtactccgcctgggcaacagagcaagaccctgtctctaaacaaacaaataaactgatagttggacatcctgttaactgtggccagatttgtcctaaagcatatgatgtgagaagagtatttcctcttactgatgaaccataaaattttaaccatttatgagcattttcctttaattatttactattgtaagttttatcttttaaaaatatttatcttacaaattcaaatttaaggctcattaaccatcagagggaacatggagaaataaaataaaataaaaacaaatttaagcctcataaaatatgtgcctcagctagtgccttctccctccccctcttctgcttccttctcctcccccttcctctccccatttctttccctgtaccattaagatgttgccaaggaaaagacaaaaaaaattgcccactcccaaaacactgctctaacaagtcttttgctggatgcagatcaccctcttattctaagaagaccgacagaaatccaaatccatgtttatttgtttaaaatacaaattccattatggttattagaggctgggaagggcagagggaggaaaagatagggagaggttggtcaacagagatgaaatttaagcaagataagaggaacaaattctagtgctctatagcactctagggtgaatatagttaacaataatgtattgtggtcaaagagctggaagggaggattttcaatgttcccaacacaaagaatgagaaatatttgaggtgatgcctatgctaattgccctgatttgatcattacacattgtatacatgtattaatatatcaatctgtacgccacaaatatgtacaattattatatgtcaacttgaaataaaaggaacaaataaaataacatataaattctacctgactccaaaaaaaacttgtgggagttttcaataaaagttatatcagcagccaagaatatttaatgggtactaaaattgtatagtcaaaagcaagctttcttttctttctttttattttattttatttttttattatactttaagttttagggtacatgtgcacattgtgcaggttagttacatatgtatacatgtgccatgctggtgcgctgcacccactaactcgtcatctagcattaggtatacctcccgatgctatccctcccccctccccccaccctacaacagtccccagagtgtgatgttccccttcctgtgtccatgtgatctcattgttcaattcccacctatgagtgagaatatgcagtgtttggttttttgttcttgtgctagtttactgagaatgatgatttccaatttcatccatgtccctacaaaggacatgaactcatcattttttatggctgcatagtattccatggtgtatatgtgccacattttcttaatccagtctatcattattggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcaccacactgacttccacaatggttgaactagtttacagtcccaccaacagtgtaaaagtgttcctatttctccacatcctttttttttttttttttttttttttgcaacagtcttactctgtcacccaggctggagcgtagtggcatgatctcagctaactgcactgcaacctctgcctcccgggttcaagcaatttgcctgcttaagcctcctgagtagctgggattacaggcacccgctaccacagccagctaatttttgtatttttagtagagacagggtttctccacgttggccaagctggtctcaaactcctgacctcaggtgatatgcctaccttggcctcccatcttctttcttattaactataaatatatttgagtcagagatgttttatgctgttgatctgtttgcaactccaattaactcactttgttaaaatatgccccatgtggtatcaaccacggatacattttgtgaaattatttctccttttagtgtcattaaccagtgctttgtgaaattctgttgaaatagcaaatgcttgctcgtctatgcagacattccatgtctgtcctctcacctctgacctgcgtcacacctgccacccatcacaaaactagctgcattgaaatctctgaatcgggcaatcccaagcgcagcaaacagtcacctggagcagagaggtcagtgtgtttacgtgtttcctgtttggaacctaggtctgaaatactattgagttgagctacctctatagagagcagtgacccatgtctctaaaatattgttctcaagaggccacaggattcctaggaattttttttttttttttgagacagagtcttagtctgtcaccaaggctgaagtgcagtggcacaatcttggctcactgcaacctccgcctccctagttcatgcgactctcctgcctcagcctcccgagtagctgatattacaggcgtatgccaccaggcccagccaggattcctaagaaattacactgagaacaaagcttgcatggacactttcttgatttagtgccaaccagatgattttacagtcacttctctgagtatctgagagataggaagcattttaacatctatatatttatttctctattcctaaaataaagatagcagaaagagccactgttgtgggggattttaagctgctaaagtgacttttataaaatattatagagggagatgtatttcagaagaaagaacttccagttcctgcagcccacttgcttttaataagaagcctctgggagggagcaccgcacagtgtagcagctgagcgcctgaccttcggagttggacagaactttgctgagtccctgctcttctcttagcacctgtgtaacttggcctctctaacccttggtttcttccccaacctcattcttacaggccactgggctaggcaaggggacacagcaagtaagttggacagaagacaaatgaatgagtttgtgcaaaaaaaaaaaaaaaaaatgtctgggtgttggggctcacacctgcaatcccagcactttgggaggccaaggcaggcagatcacgaggtcaggggttcgagaccaccctggccaacacggtgaaaccctgtctctactaaaaatacaaaaattagccaggcgtggtggggggcgcctgtaatcccagctacttgggaggctgaggcaggagaatcacttgaacctgggaggcagaggttgcagtgagccgagatggcaccactgcactctagcctgggcaacagagtgagactccatctcaaaaaaaaaaaatggtaactttgtagattaggtattaaaaatctgagcaaaattctgattgtttcttatattacaaattgaagctgatgcttgcacaggggaagcatggagtggagaaatatggaaggcttgggagtgatgagagtttggaacagcccttgtgaggataggagaggaaggggctcaaggaagacaagacaaagcactaggcttggggccaaaggctcaaggagagtaccaggcaccctgcatggtggattgttccagcaggttgatggagcataggggcttcaaaggaaccggtgatgcagtcatgctgtggctggagtttacgaaaggctgactcaccaaaggtcaacagagacatttacacaaacatcctgaccccaagtccagtgctctttctaatctataacagggttcttcctttttttctttttctttcactttttttttttttttttgagacagggtcttgctcagtcgcccaggctggactgcagtggcatgaacacggctcacttcagtttcaacctcccgagctcaagcgatcctcctgccacagcctccccagtagatgggactacaggcatatgccaccacaccaggtttaaaaacaattttttttttttaaattttttgtagagacaggggctcactgaaactgcctttgcaaaaattataaccgagaaaactatgatgatgaaagagagctgacctaacggactccatcttgcttctaacctccaaactgtccttgttctgggtgtaggttgaattaactttgggagaagcttagtttatagtttagttttgaaacaaagacgataacagccctttcccaaaagaaacccccttcctgcctgaggactagactgccttggtaggactaataaattagccacaagattacaaatcatggtttaggagtcatgcagctggaggctgcaagattctaaacctccccagattgctcatcggatgacatcactgttgtaaaacctaagatcagtgcttgagatattctgcagaccctgtacttgatggcttcatcagctggcactacccagattgataaattggctcatctggttttgtggcccctgccgaggaaccgactcagcgcaagaggacagtttagactccctgtgatttaatctccaacctgaccaatcagcactcttactcactggccccctacccaccaaattatccctaaaaactccaatccccgaattcttggggagattcattagagtaataataaaaccctggtctcctgtatagctggctctgtgtgaattaaactttattgcaattcccccatcttgataaactggctcagtcaaggcagcaggcaagaagaacccactgggcagttacatcactatgttgcccaggttggactcgaactcctgggctcaagcaatcctcctgcctcagtctcccaacatgttgggattacaggcgtgagccactgcacccagccaagtctgtccttaatcagggttcttttggatctcattttcttaaggtgcaaaagccactggaccaagtgatactgctagcccctctaggttgctgtaactagttacggctcctggatctgcttccaattagttaatttcccatcactttggacaagtcatcccaactccctggcttgtttctgtaactcaattacggtccagaagccctagttctaaagtgctgattctgatgagtgcccatttaccaggcactctgatcccgtcataacatctactatagcctgggaggtctattcaggtgtgcattcatgttaagcactaacaccaatcaaatcacttaaataacataggtaataatccaacagcacgctgggtgcagtggctcacgcctataatcccagcactttgggaggccgaggcagatggatcatctgaggtcagaagttcgagaccagcctggccaacatggtgaaaccttgtctccactaaaaaacacaaaattagccgggcttggtggcgcatgcctgtaatcccagctactcgggaggctgaggcaggagaatcgcttgaacccaggaggcggaggttgcagtgagctgaggccgtgccatttcattccagcccaggtgagaagagtgaaactctgtctcaaaaaaagaaacaagcaaaaaaaaaaaacaaaacagaaaaaacaaaaaacaaaataccaacagcacatccaaacaagactgaaagttgtaaaagaaaattacactgtgtggacagttggggtgtgtgtatgtgtgtgtgtctgtgtgtcggtgtgtctgtgtgtgtgttttagagatgaggtctctctgtcacccaggctggagtgcaacagtgccatcatagctcactgtggcctccaattcctggcctcaagcgatcctcctgccttggcttcccaagtagctgagactagaggcatgtgtcatcacaccctgtttttttttcgtttttgttctttttcagatggagtctctctctgtcatccaggctggagtgcagtggtgcaatctcagctcattgcaacctccacctcccgggttcaagtgattctcctgcctcagcctctcgagtagctggggttacaggcacacgccaccacgctgggctaatttttgtaattttagtagagacagggtttcaccatgttggctaggctggtctcgaactccagacctcaggtgatctgcccacctcggcctcccacagtgctgggattacaggcgtgagccacggcgcctggcccacaccctgtttaaggaagaaaatagtgttgaaaatgaaaatcaatacacaaaggctgaaccaaagcaatgggaaggcagtggctgtgtgttatgttgagtggctgtctcaaatagaccaagacctttctgaccctttgtcttagggcattaaagaaaattactctgggcaaacaacagcttccttgaatgctttcacttgtttaacaaaatgccagagaaccacagatataacctatagttccttagggactacaagatcagagctgacagtgttacagttttcatcagtgcacttgcagaaatggcatcagatggatttccttgggagagggggattgggaaatggctttttttttttttttgagatggagtctcacttttttgcccaggctggagtgcaatggcgcgatcttgggtcactgcaacctccacctccggggttcaagtgattctcctgcctcagcctcccaaatggcagagattacagacgcccacgactatgcccggctaatttttgcatttttagtagagaaggggtttcaccatgtgttggtcaggctggtctccaacccctgacctcaggtgatccgcccacatctgcctcccaaagtgctgggatcacaggcgtgagccagcgtgcccggcctggctttaaaaaaaaaaagaaagaaaagaaaaaaaacaaaactggttgtggggaaaagcaagagagatcagattgttactgtgtctgtgtagaaagaagtagacataggagactccattttgttctgtactaagaaaaattcttctgccttgagattctgttaatctatgaccttacccccaaccccgtgctctctgaaacatgtgctgtgtcaactcagagttaaatggattaagggcggtgcaagatgtgctttgttaaacagatgcttgaaggcagcatgctccttgagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccatctcccagcccgacacccgtaaagggtctgtgctgaggaggattagtcaaagaggaaggaatgcctcttgcagttgagacaagaggaaggcatctgtctcctgcctgtccctgggcaatggagtgtctcggtataaaacccgattgtatgttccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacatgtttgtctgctgaccctctctccacaattgtcttgtgaccctgacacatccccctctcggagaaacacccacgaatgatcaataaatactaaggaaactcagaggctggcgggatcctccatatgctgaacgctggttccccaggtccccttatttctttctctatactttgtctctgtgtctttttcttttccaagtctctcgttccaccttacgagaaacacccacaggtgtggaggggcaacccacccctacaactggtaataagggaatttactttccatcactacaattccagttttttgttttgtgtgtgtgtgtgtgtgttttagacggagtctcgctctgtcgcccaggctggagtgtagtggtgcaatctcagctcactgcaacctctgtttcccgggttccagcgattctcctgcctcagcctcccgggtagctgggattacaggcacgcaccaccacgcccggctaatttttgtatttttagtagagacggggtttcaccatgctggccagactagtcttgcactcctaacctcaagtgatccgcccgcctcagcctcccaaagtgctgggattacaggtgtgagccaccgcgcccggctaattcctgtattttcatactcaactgtattttatattagggccttgaatcccgagtataattttgtactcaaatataatttataaataaggccttagcctcccaacaaggtcaaactagctaaaaacttaagtcctcccaaccactgacattcccagcccccagccctcatcctcagcccagctggctgagggtccgacctcagagagggtctccgggagcccagaggcgggaaagtccccagaggcgcaggccctgccccacagctttcctagggcaggcagcagcgacacgccagctcgcgggctaggctgggcgcgggaactggccgggctgggcgcgccgcggtcccgcgcccacttccgcttcccgtgcgggggatggcggcagagccggtgggctgcggcggctccaggtacctgcctgagcgtggcactgcgcagtctgcccccgggtcgcaggggcgctcctgagcttcgcggggccgcctctagggctgcctgcgcggagagccgaccgcggccgacgtcggtgttaagtggccgccccggccggctacccggagccaagagcaggcggcgcagcctgagcgggacgtggccacgctggcgaggcggtaagcgcagaccgacccggcgcctccagctgcggggagtgtgcggggcggagggagcggggcacggggagagcctcggcgtccgggcggcgtgaccttcccgggcggcgggggaagcggccggcgccgccgcacacgtgccgcgggaaccctcaccgccccggggtggcccgccggggtcgccggagaatctcggggtcgtcggcctccttcccgcagtgcccacctcgtgggaacttttgtcctcctttgccctcaagtcctatcatttggccgggctccgcgccgccggggcgccagcgctgggcagcacggagccgcttctgcatggagacttgcaggctgccagagagtgggtggctgggcaggggcggcgagcgtttagggccgggcagagaaagttggaagtcgtctccctaacctgttccttgtgaggcccgggagaagacgcgcctggccgggtccttggcggcaaaactggtttgcatctccacgctttacctaaagcccgggctctggggactggatggctagctagctggcggctcctactgccccagctttagccagaagctgggatcttcccgcagcagtttgtgttccctgatggaaaatgaagcctcatctactgactctcccatccaaaaaaaagttaatttcccgaaggatcgagaaggatgggtggtctgcgctgttgttcctcagtcgcaccctgatgtaatttgagagaggggtcaaaagcgctgaaaagattatttttttctattccaagtgctacagcaagctcataaatcaattttaattcatgctgaacagttttgcttcctccaagccctgtgtctcctccgagccagagctacacgtatgtgaattagttttagcccagcccttctgagtgaatgttagtacccatcatggttttctatcttaataattctactagtggctatttgtggaatgaatgaatgaatgaatttattgagacggagtttcgctcttgttgtccaggctggagtgcaatggcgcgatcttggctcacggcaacctctgcttcctgggttcaagcgattctcctgcctcagcctcccgagaagctgggattacaggcatgtgccaccacgcctggctaattttgtatttttagtagaaatggggtttctccatgttggtcaggctggtctcgaactcccgacctcaggtgatccacccgcctcggcctctcaaagtgctgggattacaggtgttagccactgtgcccggcctatttgtagaatttaatgcgtttaagtttggttaacccagcggggttgaattcacatggacagagtgcaatgtgatgtgactttccttcaaagttcagaaggaagtgtctgtgccaaaagaagtaagtgcattgaggtttatctgggaggccacattggacttgcccctgtctgtcttctcagttgcctccgttattttcttcccctaaaatgcatggttgggtgttttgtgttgcttttggccaggttgaaatagtcagattaagtgttgatttgtaggcacagacctgaaaggacaggactttgaaatgaatcctctgtcactgactagttgtgtggccttggagaagaccttgtcttgttccaggcctcagtttgccttctggaaaaggattaggaccttgatatacttttttaggaagataccagatgaccaccaccttttcagcctagtaaatggtcctgcctctccagatctatcaacagcatataaatcagcgtcttgcacttctaacttagttgctttattaagtactgtgcctttgttgccactggttttaaaatttttgtaaatgaagatgattgaaatctggtcattggcaaaatgcttcaagaggtttaaaaaacttctccacagccagtgttttctgttgacgttcaggatgacattggtgttaggaaggcacttggtgtttgtctctgatccagcaggtagggtcgcacagctcctcagtgtgatgaggaataaattgttccttattcacaaataagttactgtaggggatcggtcagggtggtgggagaaattataaaaataaacttataggaaatagacacaaaccttcttggaaggccgggaggtttgcatggcttcagtaaaagatttggctgaaggcaactgaattctcttaaaagcttagggcgtagatacataggaatgtagaggagttcatctaaatggcttgtttgctcatgtggtcctaagaccgacctttggtcctctgtgggtgcagtactgctctctactcgggaggtcagcaatgttaattaccctctagtggtgtttactcgagacctttgtcattaaatctgtactgaataaatgcacagggcgccagcttgtcagggctggtggctgctacagctctttctgtgaagctgcctggacctctagcctgctctttcaggggatagatacctgtgtctgagtgcatttcttcatctgtcatgcggccagggtctgcaggtcagacccagcagtctttggctgatgtcagcattcctagcatatgtctgtttccagggtctggctacccagactgtggccctcagtgtgcaaaatgtgcatgtgcagatctcttgatccatttcttcttacttagggaaactaggtgtctcaagaaattatttcatgaatcttgcttttggtgttgcatataaaagctcattggcaaatccaagttcatctagattttctgctgttatcttctagaagttttctagtttggcacttttcttttctttttttttttccccagagacagatcctccctctgttgcctaggctggagtgcagtggtacagtcatggctcaccacagtctcaaattcctgggctcaagcgatcctcctgcctcagcctcccgagtagaaggacgagaggtgcatgccaccacacctagatagttttgcactttttacatttcagtctgtgatcgttttgatttgtaaaaggtaaggtcatagaacatttgtgttttgtaaaaggtgtaaggtcactttccgcctttctccacacaaccacttgcaagccattccccctctaccttgtgtaaaatctggtttctttgacattccctacatgttctcatcgcccccatccaccagccacccaagacctccctcattcctgtggttcttgccttcatcttcagtgacttccagcatcctgagctatggcctggcctaatgccctggctggtcactactaacatttttagaagttctgtttgtaatgatctacatatgagcactgaaattaaaagaaaaagtgaagaatttttgcctatatttggaaactttcctttcaataggtaataagcagaaagacaaagcaagagaactctgcctgggtattatgaaaaataaatgcactgaaggagaagatcttcctattttagattagtcataaggaagaaatccaggaaaacctcttctgccgtgctagctagggaggagtggggtgacagttaagatgtctcacgacacttgcatccagacatggccaggtagacagagggtggcccaatcaaaaggggcgccagcggccaggtgcagtgactcatgcctgtaatcccagcactttgggaggcagaggcaggtggatcacctgagcttaggagttcgagacaagcctgggcagcacagcagaaaccccatctctacaaaaaaatatacagaaattagccaggtgtggtggtgtgtacctgtaatgctggctacttgggagtctgaggcatgacaatcacttgaacccaggaggtggatgttgcagtgagcccagactgcaccatggcactccagcctggatgacagaacaagactctgtctcagaagaaagggacaccagctctaagcagctgatttgcttataccaggtatccagcaaatatctgccctacagaccagaacagtatgagaggtctcaattctggaaagatattgctggagttggcattggaagcagagaaggctaattgtcttcctgtgtcaattcccaggatttgattctggccagccatccagctggagtgcacacccttgcatctgggagtggccatgacactcatttctagccaatggaatgtaagtagatttgatgattgcaacttccaggtcaggtcctcaaaaagggaaacaacttacttactgcatcctaccattttccttactcatgggctttgagtcacctccaccctgtagcagatggcacaccctggtgcagctgcaggccccaagacaaaagggtgtccctggatgaaatggaacaaaaacacctactcacccagaaccacctgcccactttcaggctgctaagtgagaaagaaatatgctttatcttgtttgagctactgcatatttggagtatttttgtgacagcaacttagccagtattgtaaagaaacagcattgtatctgtcttaagagaacgacaccctagtggcaccaacgctactcctccattcctccccaggactacaaggagataaagcccacactgcaaaccccatcaggcctgagaattatactcagacctgaggctgggcaaggggaataggcaactgagcaattggtatcatttcccattttaaacaaattaaagaaaaaaacgcatctctcaacctcactttgtcacctgcccttcagccgtcactgggttcattcctaacctttacagatttgtccagggtggcttatcttcctatctcactctgcagtctactctctcactagtattatctcatgcttccttctgtctagcactattccaaaattctcatccaaagaccacttttttggggtttttgtttgtttgtttttagagagagacagggtcttgctttgttgcccaggctggtcttgaacccctggcttcaagtgatcctcctgcctcagcctctgaaagtgttgggattacaggtgtgagccaccacacctgctccaaaaaccattttttagtccttatctttctatacctctcaaaagcttttttttttttaatttttttttatttttagaaacaggtcttgccctgtcacccaggctagagtgcagtggcacgatcgtagctcactgtatagtcttgaactcctgaactcaagtgatcctcccacctgagcctctcaaagcactgtgattacaggtgtaccaccatacctggctaatttttttttttaaaaaaagagggggtcttgctatgttgtccagtctggtcttgtactcctggcctcaaatgatcctcccaccttggcctcccaaagtgctgggattacaagtgtgggccaccacacttggactcaatagctttctatattcttaatcatgtaagtatatagattggtgatttttcacaaattgaacacaagaaactgacgtccaagtcaagaaataaaaccccacaccccagaagcctccttcccacttccttccaaccatgcctgtttgtgtacttggtattagtggaatcacacagtatgtggttgcttgtgtccagcatattttgcttaacattgtgtttctgccattcagccacgtcaggaaaccaccccgatacctaccacagaatgagtaattacattgatatccatgtgtaccaagtgtcagtttagggctgtcctgaatggcgtgctctaagcaatattctagcgcaatgcccgtgactttactgcgcacgcccaccgctccttcctcctccattctgcctttgtttttgcctccaatttggccagtcattcccaggctcatttgcaggcccttcctctgccatttcctaagtgatggcagggctcaggatcgcaagccattttctaactctacattcttttctggtgtcctcatcccctcatggattaattgtcatcaacaggttggttgttttctaatcttatctcaagtccagatctctctcttgagctcctcttggcccaaatatccgtttgggcattctgttatttccttttttcttttttcaattatggtaaataaaaaaaaagacataaaatttagcattttaaccactgcgcccggcctagctttaccatttttaagtatacagttcagcagtgctaagtatatgcacattgttgtataatagatccctagaacttttcatcttgaaaaaagaaactttattcctattaaatatcaactgccaaccgatgccgtggctcatgactgtaatcgcagcactttgggaggtcgaggcaggcggatcacttgaggccaggagttcaagaccagcctggctaacgtggtgaaaccctgtctctaccaaaaatataaaaattagctgggcatggtggcacgtcctgtaatcccagctactcggaggctgaggcaagagaatcgcttgaaccccggaggcagaggtctcagtgagccaagatcgcaccactgcactccagcctgggcgacagagcaagactgtctcaaaaaaaaaaaaaaaaaaaaaaaatctactgcccatctcttcctttctctcagccctggaaaccaccattctactttccatttcaatgggtttgactgcgttagatacttcatatgagtggggtcatgcagtatttgtattttgtggctgcattatttcactcagtgtagtgtcctagatgtccatccatgtgtaccaaatgtcagaatttcctatcttttcaaggctgtattatataacattgtatgtctgtttcacattctgtttatttgttcatttgtggacagacatttcatttgcttctacctcttggctattgtgaataatgctactatcaacgtgggtgtgtaaatatctctttgagatcctgctttgaattcttttgggtgttttgtttttggtttgttgttgttgttgttgttttgagacggagttgtcacccaggctggagtgcagaggcgtgatctcggcttactgcaacctccgcctcccgggttctagtgattctcctgcctcagcctcccaagtagctgggattaaaggcacgcaccaccacacctggctaatttttgtatttttagtagagatggggtttcgcaatgttggctaggctggtctcgaactcctggtctcaggtgatctgcctgccttggcctcccaaactgctggggttacaggtgtgagtgaccatgcctggcctgtttgtttgatttttgctctcttaaccttatcatccagcagaggatgaattcttttgtttaaggattgttggatatgataatgtttctaattttttgaggaatctccacactgatttctatagtagttgcaccattttatattcctaccagcagtgcacaaggattccagtttctccacatatttgccacttgttattttctggcttttaattttttatagtggcccatcctaatgagtgtaaggtatttcattgtgattttgatttacatttctctagtgattactgatgttaaaacatcttttcgtatgcttcttggccatttgtacatcttctcaaaagaaatgtcttcgtcttttgctctttttaaaatcaggttatttggtttttgttgttcagtggtaggagttctttgtatcttctggatactaaacccttatcataaatataatttaaatagttccttctagtctgtatgttgcctttaatttgttgattatttcctttgctatacagaaatttttgagtttcgtgtggcctcatttgtctgtttttgcttttgttgcctatgcttttggtatcatagccaagaaaccattgccaaatccaatgtcatgaagatttccccgttttcttccaggagttttagagttttccatctttcatttagatcttttattttttgagtcagagtttcactcttgttgccctggctgaagtgcatggcgtgatctcggctcactgcaacctctgcctcctgggttcaagcaattctcgtgcctcagcctcccaagtagctgggattacaggcatgcgccaccatgcctggctaatttttgtattattagtagagtcggggtttatccctgttggtcaggctggtctcgaactcccaacctcaggtaatcagcctgccttggcctcccaaagtgctgggattacaggcgtgagccaccacacctagcctcatttagatctttaatccatttttagctaatttttttttgagatggagtctctctctgtcacccaggctggagtgcagtggcatgatctcagctcactgcaacctctgcctcccgggttcaggtgattctcctgtctcagcctcctgagaggctgagtgatgttccccttcctgtgtctatctggtattacaggcgtgtgctaccatgccctgctaatttttgtatttttagtagagacagggtttcaccatgttgcccaggctggtctcaaattcctgacctcaagtgatccacccgccttggcctcccaaagtgctgggattataggcatgagccaccattcccagctcatttttagctaattttttatatgctggaaggaaaagatccaacttcattttttttgattttagatatccagttttccagcagtgtttgttgaagaaactgtcctttctccatcgtgtggtctactcacccttgttgaagatcattttaccacatacatgagagtttatttctgggctctttattctgtgccattggtctatatgtctatatttaagtaaggatcacagtgtcttcattactgttcctttctaatatgttttgaaatcagaaagtgtgaggcctccatttttgttctttttcaagattgtgttggctattcaaggtcctttgcaattcaatatgaattttaggatcttttttttctattcctgcaaaaaaggcccctggaattttgatagggattgtactgaactgtagatcactttgggttgtatggacattttaacaatataaaatcttccaatccatgaacatggaatgtttttccatttatttttgtcttctttcatttctttcagcaatgtcctgtagttttcagtgtgtaagtctttcacctccttggttaagtttattcctaagacttttattttattttattttattttattattattttataagagagagtcttactctgtcccccaggctggagtggagtggcatgatgtcgtctcactgcaaactctgcctcctgggttcaagtgattctcctgcttcagcctcccaagtagctgggattacaggtgtgtgccctggctaatttttttttgtatttttagtagagatggggtttcgccatgttggccgcgctggtcttcaacccctggcctcaagtgatctgcccgcctcagcctcccacagtgctgggattacgggcgtgagccaccgcacctggccaagaattttatttttaaatgaaaaatcaaatttgtatatacttgttgtatacatgttgttttgaaatatgtatacaatgtggaatggctaaattgagctaaataacatatgcattaccacacctacttatcctttttttggtgtggtgagaacacaaaatctactcttttagcaattggtttcaagaatacaatacattttttttctatgtcttttttttttttatactttaagttctagggtgcatgtgcacaatgtgcaggtttgttacatatgtatacatgtgccatgttggtgtgctgtaccctttaactcgtcatttacattaggtatatctcctaatgctatccctccctccttcccccaaccccatgacaggccccggagcgtgatgttccccttcctgtgtccaagtgttctcattgttcaattcccacctatgagtgagaatatgcggtgtttggttttttgtccttgcaatagtttgctgagaatgatggtttccagcttcgtccatgtccctacaaaggacatgaactcatcattttttatggctgcatagtattccatggtgtatatgtgccacattttcttaatccagtctatcattgttggacatttggcttggttccaagtctttgctattgtgaatagtgccgcagtaaacatacgtgtgcatgtgtctttatagcagcgtgatttataatcctttgggtatatacccagtaatgggatggctgggtcaaatggtatttctagttctagatccttgaggaatcgccacactgtcttccacaatggttgaactagtttacagtcccaccaacagtgtaaaagtgttgctatttctccacatcctctccagcacctgttgtttcctgactttttaatgatcaccattctaactggtgtcagatggtatctcattgtggttttgatttgcatttctctgatggccagtgatgatgagcattttttcatgtgtcttttggctgcataaatgtcttctttcgagaagtgtctgttcatatcctttgcccacttgttgatggggttgtttttttcttgtaaatttgtttgagttcattgtagattctggatattagccctttgtcagatgagtagattgcaaaaattttctcccattctgtaggttgcctgttcactctgatgatagtttcttttgttgtgcagaagctctttagtttaattagatcccatttgtcaattttggcttttcttgccatggcttttggtgttttagacatgaagtccttgcccatgcctatgtcctgaatggtaatgcctaggttttcttctagggtttttatggttttaggtctaacatttaagtctttaatccatcttgaattaatttttgtataaggtataaagaagggatccagtttcagctttctacctatggctagccagttttcccagcaccatttattaaatagggaatcctttccccattttttgtttttgtcaggtttgtcaaagatcagatgggtgtagatgtgtggtattatttctgagggctctgttctgttccattggtctatatctctgttttggtaccagtaccatgctgttttggttactgtagccttgcagtatagtttgaagtcaggtagcgtgattcctccagctttgttcttttggcttaggattgtcttggcaatgagggctcttttttggttccatatgaactttaaagtagttttttccaattctgtgaagaaagtcattggtagcttgatggggatggcattgaatctataaattaccttgggcagtatggccatttttacaatattgactcttcctatccatgagcatggaatattcttccatttgtttgtgtcctcttttattttgttgaacaggggtttgtagttctccttgaagaggtccttcacgtcccttgtaagttggattcctaggtattttattctctttgaagcaattgtgaatgggagttcactcatgatttggctctctgttattggtgtataagaatgcttgtgatttttgcacattgattttgtatcctgagactttgctgaagttgcttatcagcttaagaagattttgggctgagacgatggggttttttagatatacaatcatgtcatctgcaaacagggataatttgacttcctcttttcctaattgaataccctttatttctttctcctgcctgattgccctggccagaacttccaacactgtgttgaataggagtggtgagagggggcatccctgtcttgtgccagttttcaaagggaatgcttccagtttttgcccattcagtatgatattggctgtgggtttgtcatagatagctcttattattttgagatacgtcccatcaatacctaatttattgagagtttttaccatgaagggatgttgaattttgtcaaaggccttttctgcatctattgagataatcatgtggtttttgtcattggttctgtttatatgctggattatttttattgatttgtgtatgttgaaccagccttgcatcccagggatgaagcccacttgatcatggtggataagctttttgatgtgctgctggattcggtttgccagtattgtattgaggatttttgcatcgatgttcatcagggatattggtctaaaattctctttttttttgttgtgtctctgccaggctttggtatcaggatgatcctggcctcataaaatgagttagggaggattccctctttttctattgattggaataatttcagaaggaatggtaccagctcctccttgtacctctggtagaattgagctgtgaatccatctggtcctggactctttttggttggtaagctattaattattgcctcaatttcagagcctgttactggtctattcaaagattcagcttcttcctggtttagtcttgggagggtgtatgtgtcgaggaatttatccatttcttccagattttctagtttatttgcatagaggtgtttatagtattctctgatgataatttgtatttgtgtgggatcggtggtgatatcccctttatcattttttattgcgtctatttgattcttctctcttttcttctttattagtcttgctagcagtctatcaatgttgttgatcttttcagaaaaccagctcctggattcattgatttttttgaagggttttttgtgtctctgtctccttcagttctgctctgatcttagttatttcttgccttctgctagcttttgaatgtgtttgctcttgcttcactaattcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacgtctttatttctgcctttattttgttatgtacgcggtagtcattcaggagcaggttgttcagtttccatgcagttgagtggttttcagtgagtttcttaatcctgagttctagtttgattgcactgtggtctgagacacagttataatttctgttattttacatttgctgaggagtgctttacttccaactatgtggtcaattttggaataggtgtggtgtggtggtgagaagaatgtatattctgttgatttggggtggagagttctgtagctgtctattaggtctgcttggtgcagagctgagttcaattcctggatatccttgttaactttctgtctcattgatgtgtctaatgttgacagtggggtgttaaagtctctcattattattgtgtgggagtctaagtctctttgtaggtctctaaggacttgctttatgaatctgggtgctcctgtattgggtgcatatatatttaggatagttagctcttcttgttgaattgatccctttaccattatgcaatggccttctttgtctcttttgatctttgttggtttaaagtctgttttatcagagactaggattgcaatccctgcctttttttgttttccatttgcttggtagatcttcctccatccctttattttgagcctatgtgtgtctgcgcacgtgagatgggtttcctgaatatagcacactgatgagtcttgactttttatccaatttgccagtctgtgtcttttaattggagcatttagcccatttacatttaaggttaatattgttatgtgtgaatttgatcctgtcattatgatgttagctggttattttgctcgttagttgatgcagtttcttcccagtctcgatggtctttacaatttggcatgtttttgcagtggctggtaccggttgttcctttccatgtttagtgcttccttcaggagctcttgtagagcaggcctggtggtgagaaaatctctcagcatttgcttgtctgtaaaggattttatttctccttcacttctgaagcttagtttggctggacgtgaaattctgggttgaaaattattttctttaagaatgttgaatattggcccccactctcttctggcttgtagaatttctgccgagagatcagctgttagtctgatgggcttccctttgtgggtaacctgacctttctctctggctgcccttaacattttctccttcatttcaccttcggtgaatctgagaattatgtgtgttggagttgctcttcttgaggattatctttgtggcattctctgtatttcctgaatctgaatgttggcttgccttgctagactggggaagttctcctggataatatcctgcagagtgttttccaacttggttccattctccccgtcactttcaggtacaccaatgagacgtagatttggtcttttcacatagtcccatatttcttggaggctttgtttgtttctttttattcttttttctctaaacttctcttctctcttcatttcattcatttgatcttccatcactgataccctttcttgcagttgatcgaatcagctactgaggcttgtgcgttcgtcacgtagttctcgtgccttggttttcagctccatcaggtcctttaaggacttctctgcattggttattctagttagccattcgtctaatcttttttcaaggtttttaacttctttgctatgggtttgaacttcctcctttagctcggagtagtttgatcgtctgaagccttctctcaacttgtcaaagtcattctccatccagctttgttccgttgctggtgaggagctgcgttcctttggaggaggagaggagctctgatttttagatttttcagtttttctgctctgttttttccccatctttgtggttttatctacttttggtctttgatgatggtgacatacagatggggttttggtgtggatgtcctttctgtttgttagttttccttctaacagtcaggactctcagctgcaggtctgttggagtttgccagaggtccactccagaccctgtttgcctgggtatcagcagcggaggctgcagaacagcggatattggtgaacagcaaatcttgctgcctgatcgttcctctgaaagttttgtctcagaggagtacccggccgtgtgaggtgtcagtctgcccctactggggggtgcctcccagttaggctactcgggggtcagggacccacttgaggaggcagtctctccgttctcagatctccagctgcgtgtggggagaaccactactctcttcaaagctgtcagacagggacatttaagtctgcagaggtttctgctgccttttgtttggctatgccctgcctccagaggtggagtctacagaggcaggcaggtctccttgagctgcagtgggctccacccagtttgagcttcccagctgctttgtttacctcctcaagcctcagcaatggcgggcgcccctcccccagcctctgtgccgccttgcagttcaatctcagattgctgtgctagcaatgagtgaggctccattggcgtaggaccctccaagccatgtgcaggatataatctcctggtgtgccgtttgctaagactgtcggaaaagcgcagtattagggtgggggtgacccgattttccaggtgccgtccgtcacccctaggaaagggaattcccctaccccttgcacttcctgggtgaggcaatgcctcgccctgcttcggctcaggctcggtgcactgcacccagtgtcccgcacccactgtcctgcacccactgtccgacagtccccagtgagatgcacccagtacctcagttggaaatgcagaaatcattcgtcttctgcattgctcatgctgggagctgcagactggagctgttcgtattcggccatcttggctccacctcagtcacttttcttttgttgctttcaaaattctctttgcaattttgacaatatgtgattatagtatgactctatataggttttgctgagattatttttattggagtttgttgagcttcttgaatttgtatggcaatttctttcctcaaatttgggaaatttggggtctgatatgggttggctgtgtctcacccaaatctcatcttgaattgtaactctcacaattcccatgtgttgtgggaggaacctggtggaggtgattgaattataagggtgggtctttcctgtgatgttctcatgatggtgagtgagtctcatgagatctgatggtttttaaaaaaacgggagttttcctgcacaagctctcttctcttgtctgctacaatgtgagatgcgcctttcacctttcgccatgattgtgaggtctccccagccacatggaactgtaagtccaatatatctctttcttttgtaaactgcccagcctcaggtatgtctttatcagcagcatgaaaacagactaatacagggtcattatttcttcaagtaggatctcaatgctgtctctcttctatgtttgggatatccgtagtccatatgttgtttcattcgatgttgtcccataagctccttaagttcccttcatttttcttcatttttttccctctgactcaataatttcaaatgaactgttttcaaagttactgactctttcttctctttgatcaagtatgaaccctccagtcaatttttccattcagttattatattcttcagctccagaattttcatttggttcttttctatagtttctgtctctttgttgataccctcattttgtacatgcattgttttcctgattttgttttgtggtgtatgttctcttttagctcattgagcatctttaggatgattattttggattatttgtcaggtaattaagagatctccatatctttagggtcagtttctagagatttattgtatttatttgggccatgtttctccgcttctttgtatgcttgcaatctttttttaagcgttgggcatttcaggctggctttatacagggtaagaccttcaccagtcaacccgctagagattctagggctttttctaacttctttttggcaataagtcttttctgggctgtggatataattcctcaaaggtttgcttgcctcttttctgcagcccataatctcttgctccccttggtgtctgtctgtggtactacagtcttattgttgccataacaagctgtggcactcacctttgatctcagtgaccccagcctggcatttaaaccgctgtttccatcagcactccaagtcaggagagatagaaatctgctccttgggcgaactgtcaaaaggcctgcgcattggactcatggttggttcccttctctttttctctcttgagggagaagaggattggaaattttcttccaattataccacagtgtgctagggataataggtagggtgacaaataatctctccttggccacactttagtcagattcctctgaaccctctacttaaccaggacttgacctttgagctcctgtattcatctttgcatcacaaaactatttcttgcagttttagcaagaatcctccactcttgacatctaatcaaattcatcatcctccaccatcctccagatgacattcgatcatcctggtctgccttcagcaagaatcctgtcaaatcagttttaccagaatgtcacccttcccttgacgttgcctcttagtaattttccatccaatgcccgcctctacccccaccccaccaccaccctgcactctgctctttgactgtaaatccccacttgtcttgctgtaactatgacaattgtccttgctgttctctaccagtggcaagtaaaatgccacaccgtttcctacctgtttcattgcatctcttggctttgtgcacctttgggtgctgcaaactctcaactggtttttggagttctcaggcaattttgtccatatgatgttgttaagttgatgtctctatgggagaatgagggtctggggtttcctattctccatcttgcttatatcactcagcacactgttacttcataagtacatcaaaactggacttttttgttttgtttttttggagatggagtctcactctgttgcccaggctggagtggagtgatgcgatctcggctcacggcaacctccacctcttgggttcaagcaattctcctgcctcagcctcccaagtagctggtattacaggcgcacgccatcatgcctgggtaatttttgtatttttagtagaaacggggtttcaccatgttagccaggccgatctcaaactcctgacctcaggtgatccacctacctggggccttccaaagtgctgggattacaggcgtgagccaccacgcccggcccaaaactggacttttttgatcttcctctccaaaacctgctttaccacggtgttccttaaacaacagaaagacaacacctgctgccatacagtacttaaactagaaacttaggaatcatccttacctctgccctctcctgccatgtcaaattattaaccaagtattcttgattttgcttcataaatagttatcaaatctgcccccatctctttactgccacacaaagccatcccttttcatttggatgattattaacagtctctttaggccgggcgcggtggctcacaactgtaatcccagcactttgggaagctgaggcgggcggattacaaggtcaggagatcgagaccatcctggctaacacagtaaaaccccgtctctactaaaaatacaaaaaattagctgggcatggtggcgggcgcctgtagtcccagctacttgggaggctgaggcaggagaatggcatgaacccgggaggcggagcttgcagtgagctgagatcctgccactgcactgcagcctgggcgacagagtgagactccgtctcaaaaaaaacaaaaacaaaaaagcagtcttttttttttttttttttaaacagggtcttactctgtctcccagcctggagtgcagtggtgtgtgatcacagttcactgcaaccatgacctcctgggctctaacaatcctcccacctcagcctacctagtagctgggactataggcatgcagcatggtgcctggttaatttttttaacttttgctgacatgatgtctcactatgttatgttgcctaggctggtctcaaactcctgacctcaagcaatcttcccacttcggcctttaaaatcacgctgggattacaggcgtgagccaccatgcctggtttataacaatctcttaattggctttcctgactttaactccttcaatttaatctccatagtgtaggtagagcaattctaaaatgcatatgtggccctgtcattctgccacttaaaacctttcagtgtctctctactgtcttagaaataaattctagcctcttttacaaaggttacacagctatttattgtttacaatcccctgctcacccctccagactcacaaaacaaatagttatttggtccaaaatgtcaataatgtgtgtcagggttgagaaatctagtcctagaggatgggctccagaaaatgaaggagtcagccatgaaagaggaagaaacggaacccccacaataagagatccaacaggagaaggaagcaaaagaaatccccaggatttatacattataaattaagagcagtgaccaacaccaagttattcctgctgctgttggacatctccaactttgaaggcttccacattagcctggtgcttatctttccttctttcattttcctaatggttaggctattcctgtgcccactgtcagtggtgacggggcagcctgagaatcatattctgggatttctgtcagctttagccttggagctggtccagagaggaacaaacttcagatgctctgaaagtcttaatatgggccaggcatggtggctcacacctgtaatctcagcactttgggagtccaaggcaggcacactgcttgagcccaggcgtttgagaccagcctgggcaagatggtgagaccccatccctacagaaaaatacaaaaaatcagctgggatagtggcacatgccggtagtcccagctactcaggaggctgaggtgggaggatcacctgagcttgggaggttgaggctttagtgagccatgataatgctattgcactccagcctgggtgacagattgagactcggtctcaaaaaaaaaaaaaagaaaaaggaatagaaagtcacaatctgaaatcgatgggactgagagcctctcacatagaaaagttgatcctgctgaaaaagtggattaaaaaggaatttagggtcttgcttgttggttgcttctgtccgtggagtcttgcatttcagtttccctattaggaggctggattggtaaaagcctaccctgagtgccagactagtctgggaggagtcttactaccgggttgttgaggctcttgtttacaccttggggaaacaggcttcctgtaactctacctgactattctagcagacttagaatagatgacgggggagtggacagctggcagccaatagcaccactctgtctctgcaactgtaaaactaaattaaccaggaatttatctgagagctgttggggtctagaaaaagaacatcagaacaaacctaaagaaattgacaaaaaggaataatgaagataaaacaaaataaggaattaaaggaaaaagtcaaatagcaatagattgctaggtaaaaccaagggcttattccaaaaaataaacaaacccttggtaaacctgagcaaggaacaattaagagaacccaggcggggcacggtggctcacacctgtaatcctagcactttgggaggctgaggcgggtagattgcctgagctcaggagttcgaggccagcctaggcaacatggtgaaaccccatctatactaaaatacaaaaaattagccgggcgtggcagcatacacgtgaagtctcagcgactcaggaggctgaggcaggagaattgcttgaatccaggaggcagaggttgcagtgagccaagattgtgccactgcactccagcctaggacagagcgagactccgtctcaaaaaaaaaaaaaaaaaaaaaaaaagagagaaaacccaaatacagaacaccagatatgaagaagggggaaaatacatatatgaatgaaattaaagaattataagaggccagacatggtggctcatgtctgtaatctcaatactttgggaggctgaggcagaagcatcacttgaggccaggagttagagaccagcctgggcaacatagcgtgatcctgcctcttcaaataaaataaattagccaggcatggtggtgcatgcctgtagtcccagctacttgggaggctgaagcaggaggatcacttgagcccaggagtttgatgctacagtaagccgtgatcgtggcactgcaatcagcaagaccctgtctcaaaacaaacaaacaaaaaaacccaagccgatttataagataattccatatacaactttatgcccatacatttcaaaatctcagtgaaatgaacagatttctgggaaaataaataaattatcaaaattagaacaagatgtaaaaagcctgaataacctcataatctgtaggggaactgctccatgatggccctggtcaccttgcactgtcatcataggacatacgggcaaaagcttaaaccacagctatcctgagtcctgtgatactcctggaacacaaaaggatggggcttgagaggagctgccatggggcttctcccacctgcctccttttccccaccaaggatgctgccagagagtttcttgtggccatccagttctgatgaggtctaaggctcaggctaaaaatctctgcagctgcagtctaacatcagctcctcagcaacgtggttatctcacaactcatttcacagtgatctagctccttttgcttccatgttcattttggggtgtgggacaaggaccatggggaactgacatatttgactacccttccttttgctgtttatgtaagtaataaaccatctaaatctaaagaggggccgggtgtgctgtctcacacctgtaatcccagcactttggaggctgaggtaggcggatcatttgaggtcaggagttggagaccagcctggccaacatggtgaaaccccatctctactaaaaatacaaaaattcgctggtcctagtggcaggcacctgtaatcccagctacttgggaggcttgagctctggaggcggaggttgcagtgagccaagatcgcaccactctactctaacatgggcatcagagcaagactgtttcaaaaaagttaaagaaattaaagaaaaataaatctaaagaaggcttgttacgtctttcctggctggatctgttaggtgatttggtcttgcctgccctgtgcttgacatattcacagcagatcaactgtcttttcttggttggccagattaagttatttaaaagattgcaagtgcccagtagcacagagagcatgggtaaacacatacttccttacatattactggaaacaaatacagttggtcctccaactgcagatcattatgcgtatgatggttgcatctgtactgacccatgtacacactttttttcttgtcattattctgtaaacaatacagtataacaagtatttacatagcatttacattggattagctattataagtaatctagagatgattaaaatatatgggaggatgttcataggttatatgcaaatagtacaccgttttgtatcagggacttgagcatctttgaagtttggtgtctgcaggacattctgaaactaattgcccgtggacatcaagggagattatacaagtgaaacaaaatttggcaatagctattgtctttgtctgttttctgttgcttataacagaatacctgaaaatgggtaatctataaacaaataaaatttatttcttacagttctagaggctggatccaaggttaagggaggggcatctagtgagggccttcttgctggtggggactctctccagagtctcaaggcagtgcaaggcatcacctggcaggaggcaacacgtgccagctgaggtttctcttccccccttacaaagccactagtcccactcccatggtaagccattaactcattaatccattaatccagaatggattaatccatttatgagggacacgccctcataattcaatcacctcttaaaggccctgcttcatgtgaaatgagtttgggaaagaaaaaacattcaaacagtaacatctatcgaaatttaaatcactactttctttcactcataaattctactaataagaatttcacttctagaaatttatcttacagaaatatagacacacacacatgcactatatatatcacagtttatacgtagcaccatatattatatatgtagcagttgtaaaacaatatgcaatagagcccattttaaagattatgttcacatggggtcaggcacagtggctcacgcctgtaatctcagcactttgagaggccgagacaggtgggtcacttgaggtcaggagtttcagaccagcctgggcaacatggcaaaacctcatctctacaaaaatacaaaaattagccaggcgtagtggcctgtgcctgtagtcccagctacccaggagactgaggtgggaggatcacttgagcccaggagttcaaggttgtactgagctatgaccataccactgcactccagcccgaatgaccaaaaaaaaaaaaaaaaagattatgtgtgtgttggtgcttctatgtgtataggctaaaaatttgtgatgtcatattacaaattggttatctttgatgaatgggaactttatttctaaaatatatatggtgtatatatgtatatagtattttagtgtgtatatatatatgtatatatatatacacactaaaatagtatatactgaaatggcatatatatatattagagacagggtcttgctctgttgcctaggctggagtgtagcagcaggatcatagctcattgcaccatgaaactcctggctttaaacattcctcccaccctggcctctcgaagtgttggaattggtgtgagccatggtgcccaacattttttttttagagacaggatctgatatggttagcctttgtgtcctcaccgaaaatctcatcttgaattgtattcctcataatccccacgtgtcaagggaagagtcaggtggaggtaattgaatcctgggggcagtttcccccatgctgttctcatgatagtgagtgaattctcacgagatctgatggttttataaggggctctcccctgcttcgctcgtctcttcttcctgctgccttgagaaggtgcctgacttcctctttgccttccaccatgattgtaagtttcctgttgggaacaggccccccgacatctggccataaactggccctaaaactggccataaacaaaatctctgcagcactgtgacatgttcatgatggtcataacgtccacgctggaaggttgtgggtttactggaatgagggcaaggaacacctggcccacccagggtggaaaaccgcttaaagccattcttaaaccacaaacaataccatgagcgatctgtgccttaaggacatgctcctgctgcagataactagcccaaccgatcccattatttcggcccatcccttcgtttcccataagggatacttttagttaatctaatatctatagaaacaatgctaatgactggcttactcttaataaataacgtgggtaaatctctgttcgggggtctcagctctgaaggctgtgagacccctgatttcccacttcacacctctatatttctgtgtgtgtgtccttaattcctctagcgccgctgggctagggtctccctgactgagctggtcttggcaagtggcatccatcttggggccacaaatacaggttgaagggttgccagagcgatggttggagaacgtggaactagctggaggacacccgagtactcttaaagcaatccccggggtgagtaagaaggggagctcagaagcatcagggtaacaatgggacaagtgtgggctgtggttcattccaccttttggaactttttcacactgatggggaggaggaaggagagtataacaaagtaacagaagaggttacagagcaggtttatttgccagctaaagctaaagcagcaaaggagggagaggttcatccctacccttctgcactccctccttattattttgaagaaaaagaccctccagatctttcttttccagaggacactgggcaaaaagtagttgccccagtgactgttcaagcagcgcctcaagtgactgctcttagttctattcaggcagaaattcagcaagctagatgagagggtgatatagaggcttggcagttacctgttagaatacaccccccagatcaacagggaaatattatagctacagttgagccttttccttttaaattcgggaaagcacatttagttgattatatcaaggcctgtgatagtatcagaggtaatctgcataaagctacttttttggcataggcagtggcaggactgagagtggataaaggaaatactccatttcctggagcttgttttaattgtgggaagcatggtcatactaaaaaagaatgtagaaaaaatcagcgagtcaggccgccagataggggaaaaaagaaaactgctgagcctgaaatatgtccaaaatgtaaaaaaggaaaacattgggctaatcagtgttactctaagtttgataaaaatgggaacccaatttcaggaaacgccatgaggggcccatcctgggcccgttctaaaccggggcatttctagctcaggccattcccttacccctatacaatgtctgtcccccgccacagccggtagtgccacagtagatttatgctgcacaaaagctgtgagccttctgcctggggaaaccccgcaaaaggtcccaacaggagtctgtggacccttgccagcagggacgataggattacttttaggaatgtctagtttaaatttaaaaggggtccaaatacatacaggagtcactgattcagattacaatggggaaattcaaattgttacatctacttctgttctctggaaagcagagccaggagagcatatagcacagctcctgattgtgtcgtatgtgggaataggaaaaagtgaaattaaacgaacaggaggatttggaagcacaaataaacaaggcaaaacagcttattgggtgaatcaaattactgataaacatcctacctgtgaagtaactattcagggaaagaaatttaaaggtttggtagatacaggagtggacatttcaatcgtttctctacagcactggccgtccgcgtggccaattccacccactcaatttaacagagttggagttggtaaagcccctgaagtatatcaaagtagttatattttgcattgtgaagggcctgatggacaacctgagactattcaaccaattataacttctgtacctataaatttataagggagaaatttattacaacaatggggagcacaagttctaattccagaacaattatatagccctcaaagtcaacatacaatgcatgaaatggagtatgtccctggtatgggactagaaaaaaatttgcaaagtttgaaaaaactgcttcaagcggaaagacaaagttcctgccaaagattaggatatcatttttgatggtggccattgttaagcctccagaacctatacctttaaaatggttaacagataagccaatttggataggacagtggccgctaagtaaagagaaactggaggctttagagaaattagttactgaacaattagaaaatgagcacgtaactccaacattttccccttggaattctccagttttcgtaattaagaaaaaatgaggtaaatggagactgttaactgacttaagagccatcaattcagttatataacctatgggagcattacagccaggattgccttctcctgctataattccaaaaaattggcctttaatagtcatagatttaaaagactgtttctttactatccctttagctaagcaagactgtcaatggtttgcatttacaatttctgcagtaaacaaactgcagcctgctaagtattttcattgttttacagatgggtctagtaatggtaaagcttcttattctggcttgaaaagtaaagtttttcagacgcccaatactttagctcaaaaagagcttgtagctgtaattgaggtattgactgcttttgatatgcctattaatgggatttctgattcttcatatgtggttcattccacacagttaattaaaaatgctcagttactatttcatacagataaacaactgatgacaaaaacaaaaaagggggagaaataggcattacgggacagcccatacacaactgaatctagcattattaactttaaattttttgagcctgcccaaaggccagatgttatcagcagctgaacagcatctacagaaaccagctgcaaagacagaagcagaacaactggtttggtggagagatccaataacaaaaagttgggaaataggtaaaataataacttggggtagaggttatgcttgtgtttctccaggccaaaatcaacagctgatttggataccatcaagacacctgaaaccttatcatgagccagattccgggaggatcccgaggacccctcagttgcagccatgttgagactgatggctgaggaggaccccaactgtcacaagcaacacccgtctaacacagccacccacctggggacagatcaagaagctgtcacagatggcggaagaaaacctgaggaaagcgggacagccagtcacaatgggtaatttaatggtagctatgatagcggtgatcaccattgccgtaagtattccttcaacaagagctgacacagagaacaattattcttattgggcatatttatcaatcttggctggcaataatgcctggatgtaatcactctatcacacagttacacatgctttctgatctcagtatttaccataataaatctgctcctataattgaggcataccgccctcaaaaacctatttgtacacaggattggacccagttagacaaaatgaacatacttgtttaggaagattgcattgcagaacaggcagaggtgctgcacaacgattcctatggaatcattattaattggtcccctaaggggatgtttagcttgaattgcacctctcagtctgtgtgccactgctacactatgtttagatgatctgaacaaaatggtcagatggtagaaatgataaaaagtacggcaagagttcctcttatctgaaaccatggcggtatagtggcacctcaacctcagatgatatggcccgttgtaggagctaaacataagataaggatttgtggcttaataagatcaaaaatttgggaaagaataaaaaagcatctagaaagacactctacaaatttgtctttagatattgcaaaattaaaagaacaaatatttaaagcatcccaggcacacctgaccttaatgccaggaactggagtgcttgaaggagctgcagacagattagcagctagtaacccattaaaatggataaaaacacttggaagctctgtgatttcaatgatgattgtgcttttaatttgtgttgtttgtatagtctgcagatgcggatcctgactcccgcgagaagtagctcaccatgacaaagctgccttggcttttattgctttgcaaatcaaagaaggggaacatgttgggaacagcacccccccccccaaaatctggccataaactggccccaaaactggccataaacaaaatctctgcagcattgtgacatgttcatgatggccatgacacccacgctggaaggttgtgggtttactggaatgagggcaaggaacacctggcccacccagagcggaaaaccgcttaaaggcattcttaaaccacaaacaatagcatgagcgatctgtgccttaaggacatgctcctgctgcagataactagccaaacccatccctttatttcggcccatcccttcatttcccataagggatacttttagttaatctaatatctatagaaacaatgctaatgtctggcttgctgttaataaatacgtgggtaaatctctgttcggggctctcagctctgaaggctgtgagacccctgatttcccacttcacacctctatatttctgtgtgtgtgtctttaattcctctagcgccactgggttagggtttcgccagccaagctggtcttgccatttcctgaggcctccccagccaagctgaactgtgagtcagttaaacctctttcttttataaattacccagtctctggcagttcttcatagcagtatgaaaacggactaatacaggatctcactctgtgtcacccaggctggagtgcagtggtgctcaggcaagccacagtccttttgcctcagcctcccaaatagctgggactacaggtgcgtgccaccatgcccagctagttttttttttttttttttatctttgtagagatggtttctcactatattgcccaggctggtcttgaacccttggcctcaacatctcaggtgatcctccacctcagcctcccaaagcactcactggaattacaggtatgagtcaccatgcctgacagacagacagacatatatatatatgtgtgtgtgttttttttgagacgaggtcacactctgtcacccaggttggagtgcagaggcacaatctcaggtcactgcaacctttgcctcccaggctcaagggatcctcccacctcagcctccctagtagctggggccactggcatgagccaccacgcccagccaattttttgtatttttggaagagacagagttttgccatgttgcccagcctggtcacgtactcctgagcgcagacgatcctcccacctcagcctcccaaagttctgggattactggtgtgagccaccgtgcccggccttatgtattttttaattgaaaactttcatcatgaatatgtgtccttaaattttatttaaaaacacataaaagcagagaatagtataataaacctgttaagatttaaaatattttaaatgttgccatgtttttcatctcaaatcgttacaaatctacaacaatcttctcctccctctttttcctttaactggaagaaacagtcagttgtccaataggatatcccacattgtggatttgtctgattgtttccttttcctctttcccctttattctttcctataactggaaattccacttaaaggcctgagtatattaaggatcaacatttttgttaacagaaagcatacagtctggttgttccacttgtagtaatgctaacattgatcagtgggctttcaaatgtgaagccagatttcccctacaaccaacaaatgatctgtggatctatagtgccttgtgaatatccagttcctcatcatcaccgtttcatataatgctttgttccttagatcttttgcacacattattgtgatttttctaacttttcttctatatttatcatctggaattctgtaaaaatgagctttctcccatcaactaattatatgggtaatatttttacagtttttaaaatacataattgttagtattggtgtgtgtcttcctgggactccttcctgtgggtcctaggaaggcatactacactctactgatctttgtattcctgttactaatgcctactatagtgatggtacataggatgtatttaataagctcaacggtatatcatttactatctgattacagttgagtgaaaaaaaaaaaatcattgagccaactcaaagatctggtgatcctttccaaaaggatttgccggaccatagattgttcttcagttaaagctcagagatttgacgatgaggctcatcttacaaattaagtccactgttcaaagaaacaaaaatagaaagcttgatgccataaagacttcagttgcacatccgaaattcaaagtgagaaaaatatattatccttaaatgtattttcctagcagtatttcgctaactttgggtggtgtaatttttgtcaactcttcacaacctgaacaaatacttttaatcacgtccttctccgatattttcaatgaaaaggcaaagggcgctagaacttggaaaacggatgctttttaggccgctaaatttccttgtctttaaacaacactcattaaaatataagagcactgtgagttatgtttgattggatcatccacacgtgctaaacctatcaaaatcatatatgacttctgggaagccgttctgcttggctggggtttcggcagcagcagggttccctttcctagaaagtccccagctctggccctaccgacgtccgcacctgaggcttccctgctgggggatcaggcactgtcagctcctcggggccgccctcagccctgggacgccctccgccccaacgaccctcctcctccccagcgtcgcgccactcggcggcctcgccggctcccctcccacccttgaccttttccgccacagctacagaacgcccaagcgctcttccgcctagggtgccctccctgccccgcccacctgcgtcccgcgggctcagcggtgttacgccgcgcccgccttaatatgattggtttttgttcctgtcactctaggatccaagcccgccattggtcggcttccgttacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgagggggtatgtggaggggccccggcgcggggctgggcggggagctccgggcctggcggggaggacgcgagctggaaacagcacgggcagacccaaaacaggagcgggggaggaatgtgagagttcaatgcaagcacgcgaaatcgtgggaaaagcgaagtgacatttccaactgcactcttagggctgagtgtgtgagggaagcttcagcaaattttggaggattgttttggccgaagagacgaagcagtttgggatgtggtgtgtggtgatcacaaggctgcaggcagctggtgaagggagctgctgcgctttggcgtgatatgatagtgaagtaatgcttctcgtcgtagtccactgtccacgccatcgttacagtgttttccaaaaccgtaaccaactccctggtttaaaatcttccggaattttcatttgcccttggagtaaaatctcaatcttacccagagggtggcatttaaaggccttcataacctgatcagcatcatccctctctcccctatgcgttgtatagctcgcagccacacagaaatacttggaattcatcacaccatgccttggtgtttcctgttctcctggcctggacagttctctgccctcttcttctggtgaaatcttactcaaatgcttccaaggcctcggggtgtagctctctgggaaagctttttttgaccctaacctctgcagagtgaggagcttctcatctctgctctttttactttttgtattgacctctatgaaggcatttaagccattatcgttctttgtttgtctctcctgctatatgtggtctcctttaatccaaggggaagcatggacaataagaaaacaatctgtttcagtagatggatgtgaggtaaacaaaggtcccacagtggtcattctgtatgttgtgttttcattgtctgttatttcccattggtcatatgctgccttgtgtcaattttttgcgcattcattcagcattttttatcaactactgtatgccaggtgctgtgttaggtccggacaatatagagattttaattgaagcatacacagttgctaatagtggaaacttttcctatgaggagttaagtaattaagagctgatgtcattaatattgttatttgcaataaagatggaaatgtttttatgtataatttctccaaatatattgtaagcactttgaggtgaaaggatgagccactgttagactattttgtatcacttgcatttaacacaatacctggcacacaggaggtatttgaaaaatattcggctagggccgggcgcagtggcttatacctgtaatctagcactttgggaggccaaggcggacggatcacgaggtcaggggttcgagaccagcctggccaacatggtgaaaccccgtctctactaaaacacaaaaaaatacaaaaattagctgggcgaggtagcgggcgccagtaatcccagctactcgggaggctgaggcaggagaattgcttgaacccgggaggcggaggttgcagtaaaacaagattgcgccactgccctccagcctgggcgacagagggagactccgtctcaaaaaaaataataataatttggctagaaggataaaatctttagaattaagatgattctcattcatacagtgtttaattttgccagcctcaaagaattgtaagcactgtatacctaaagcctcaccagtctaaagagggtgaaactaagaaacttatttgtgtaaggcaattaggctttagtgttgtgagttaaaattcaagttcttgcatttttaggtgctcttgtgaaggagtggtttatatgattaaagatgatatggtttggctgtgtccccacccagaatctcatcttgaattgtattccccataattcccatgtgtcaagggcgcgaccaggtggaggtaggatcgtgggagtggtttcgcccatgctgttctcacgatagtgagtgagtctcaatctggtggttttataagcgtctggcatttcccctgcttgcactcactcgatcctgccaccctgtgaagaaggtgcctgcttctcctttgccttccgccatgattataagtttcctgaggcctccccagccatgctgaactgagtcaattaagcctctttcctttataaattacccagtctcaggtatttcttcatagcagtttgagaacggactaatacaaaaggtgttagcggaacaggactattgcagttttctgttttcactgctgagtgaaccagccggttggttagccacctagccattgacaaacttaagggtactgctagcggtttgttaggcctccttatagtctagtctatagtctataatcagaaacacttacaattgattcactttttactaattaataatatttcttgattctaactatatgtatgaataattaacataagaactgtggaaatacatacatacaccaccattccaaatcattatttataatttatttggggtaatagagtaagcagagaattaaattctaatagtgtatattaatttccttttttttttttgagacagattctctgttgcccaggctggagtgcattggcataatcatggctctctgcagccttgacctcccaggctcaaacaatcctgccacctcagcctctcggagtagatgggactataggtgtgctctaccatgactaatattttaattttttatagagatggggtctccctacgttgcccatgctggccttgaactcctgggctcaagtgattctccacccttggcctcccaaagtgctgggatttacaggtgtgagccactgtgccaggccaattttttaatttttttaacaaaattttaaactgttgctctagtgtatatgatctggtagaataggggtctgccttttagtttggctcactgattaaaggaaactttggctaccaagaaatagactgcttctggaattttgaagtcaaatttataaatcctagggctatcatgcaatttccttatacatggcaaaaccctggacaattttttggatttacatgactccatacaaagacgtggaattcagggatttcatctgtatttgtatactgccatgctcctaaaactcagaaggttcctgaaacatagtgaccacgttcaataactatttgttgaatgagtgaatgaatgaagcacacctgttgaagtaaagggtaacaattatcagtaaattaaatctggagctataattaagatatgttccttaatacttgaaaattgttcttaataccctcctcatcaattaggtcatatttcactgataactagcattagatttataactatgttaatgtaaaaggtaattttctagtctccactgctttttaaaaattatcagaaatgtaagaattagatagactctcatataccttcacccagattctctagttgttaatcatttatttatcttttttctgtttatgtacatttttttctggcccatttgaaagtggtgtttttaagggctatgttgaataacgcatttaccactatttttatgcacacacacaaacaaggatcatttttgttcccatgacccattactgataaaattagctgataaaatccacccgcctcggcctcccaaagtgctgggattacaggcatgagccaccgctcctggctctgatgtttattctaaaaccaaatatattgctttcttttaggcagttctgcatactattgactaagatttcttttcttttcccccattcatgcaagctaagaagctgtcttcttagctgtgctgtctcatctttaatttcttcagttttaattatgcctttacagaagacagaagctcttacaaagttatatacaggccgggcgcggtgggtcacgcctgtaatcccagcactttgagaggccaaggcaggcggatcacgaagtcaagagattgagaccatcctggctaacatggtgaaaccccgtctctactaaaaatacaaaaaattaggtgggcatggtggcaggcgcctgtagtcccagctactcgggaggctgaggcaggagaatggcatgaacccgggaggtggagcttgcagtgagcagagatcgtgccactgcagtccagcctgggcgaaagagtgagactccatctcaaaaaaaaaaaaaagttgtatacaatagttttccttttgtatattattttgcctaaaagaatatgcatatattctcaatggataaaatcaccatcttcccacccatttaatgtagctgaacagtaaaaataaaactgtattgctgaacaataaaactgtattgatgtactcttaactattattttaaaattttaaggcttttcaggcttatctttaaaagttaagattttgaggctgggcacggtggctcacacctgtaatcccagcactttgggaagccgaggcagacggatcacgaggtcaggagatcgagactatcctggccaacatggtgaaaccccgtctctactaaaatacaaaaaattagccaggcgtggtggtgtgcgcctgtagtctcagctactcgggaggctgaggcaggggaatcacttgaacccaggaggcgaaggttgtggtgagccgagatcgtgacactgcactccagcctgacagagcaagactctgtctcaaaaaaaaaaaaagttaagattttgaatttgttctttttctgatatttcttgagttcagattctactcagtgcttgtacttgatctttctacacagataactgaatgattgaagggcagtgtgggtacaattgaagggtaaaatgggtggggagcagttcttggcacttcgcttggaaagtttattgccttggtggtggtgtgaagaaaatcaggcaagtgttaagtgtgtagctagaatggtgctagcggatctcttgaggtcaggagttcaagaccagcctggccaacatggtgaaaccccatctctactaaaaatacaaaaattagccaggcgtggtgctgggcacctgtaatcccagctacttgggagggagaggcaggagaattgcttgaacccaggaggcagaggttgcagtgagctgagattgtgccactgcactccagcctgggcaacagagcgagactccgtctcaaaaaaaaaaaaaaaaatttaccatagggtttttaaaaggcagcttggtatgggagacatgtgggagtggtgctacagggtctgtgtgtctttgtttggatggctattttggctagtcacccatctggaggtctggttggcgctggtggtagcctagttgcttgcgactcctcctgagcaggaggattctacagtgcctggtttgtttgagattagcctctggaatgtcttttttttttttcttttgagatggaatcttgctctgtcacccaggctggagtacaatggtgtgatctcagctcactgcaacctccgcctcctgggttcaagcgattctcctgcctcaggctcctgagtagccagaattacaggcacacgccaccacacccggctaatttttgtatttttagtagagacacggtttcaccatgttggtcagggtggtctcaaacgcctgacctcgtgatccacctgcctcggcctcccaaagtgctgggattacaggtgtgagccaccacacctggcctaccctctggaatttcttaagcaagagcataattagataagcatgcattgctggaagagagtgtctagagaggaaaggaatgcaggggtaagagaggagggaaggaagaaaaagaaggtgattaaaatatattttaaaaactgaggtccccagttacagatgcattgccaaatccaaagtcgtgaaaacttattcctgtgttaagaattttatgggccaggcacagaggctcatgcctgtaatctcagcattttgggaggccgaggcggacagatctcttgagcccaggagtttgaaaccagcctggccaacatgccgaaaccccatctctactaaacaatacaaaactcagctgagcatggtggtgcccacctgtaatctcagctacttgggaggctgagcgatgagaatcacttgaacccgggaggcggaggttgcagtgagccaagatcgcgccactactctgcagcctgggcgaccctgtcttaaaaaaaaaacaaccaaaaagaaaaaaaaagctgtggggtaagacactgggtttgaatttcagctgaactacccattagctgtgtgatctttgactagttactttatctagaagctttagtctcctcatctataaaatgggtaatactacctagttcatggggatgttgtaaatattaatgatgaactaataaatgcaaagatttagacagcgcatggcacattgtaaagcagttgatgaatgtaattcttttgatttccctttaaccatttaaaaatatagaacaattcttagatcacaaggtgagcaaaaacaggaggcaggccctgctgtagtttgctgacccctgatacagagagatggactcttgtatctggtggagtgtaaattggagcattttttctggaaggcatttggcagtgtgttttaatctttaaatggcttgccttttttttttttgagatgggatttcactatgttgcccaggctggcttcgaactcctgagcttaagcgatcctcccacttcagcctgtcaagtatctgggactctaggtgcctactaccacgcctggctgccatcaaccctggaaatggctaggttttttttaccccattgacctcctttctgggaatttattctaacaacttaataagagatacacagggatattacagctttatttataagtacaaaaaaaatggaaaagggagcgtttttgtactattttttgttgtatttgtatgatggaataatcttaagtcactaaagagcgtttgaaaagttataacaaaaagtgcttgatacgtaagtgaaaaagcaatattaaaaattatagtattatcctaatgttttaaaaacattctaaatatgtattaatgtaataggtgaaggaaatagatcaaattgttttcagtatccatttattatttggttcttcctatcttttctatttttcattgcttttcaagaattacgtactgctttatggaatcagaataggacttcagtctttggtttatgaaaaacagatcaataatatactgttttttcttttcatttctctcttttgttttccacaccagggtctggctctgttacccaggctggagtgcaatggcactatcttggctcactgcaacctctgcctcctgggcttaagtaatcctcccacctcagcctcctaagtaacttggaccacagttacatgccactgtgcccagctaatttttttttttttttttttgagatggagtctcgctcttttgcccaggcaggagtgcagtggcacaatctctgctcactgcaacctctgcctcctggatacaagcgattctcctgcctcagcctcccaagtagctgggactacaggcacgtgccaccatctttttttttttttttttttttttttttgagacagagtttcactcttgttgctcaagctggagtgcaatggcgtgtgatcttggctcactgcaacctctgccttctgggttcaagcgattctcctgcctcagcttccgaagtagctgggattacaggcgcccaccaccacacccagctaatttttttgtgttttttagtagagaaaaggtttcaccatgttggccaggctggtcttcaactcctgacctcaggtgatgcgcttgcctcggcctcccaaaatgctgggattacgggcatgagccactgcgcctggcccataatttttgtatttttagtagagacaaggtttcaccatgttggtcaggctgttctcaaactcctgggctcaagcagtctgcccaccttgacctcccaaagtgctgggattataggcatgatcccactgcacctggtcaatactttttttcttaagccacttttctcaggagatgtgtgtactttagaatgtgaaaatttccacttagaagcaattttcaagttctttcatgtcttctcatcagttttttttttttttttggaaatttaatcaagttagcaatctgctttatttgcctccttttattttctataacagggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcaggtactatgttttgtctcatatttgtttttacatacataaatttattgtaaattttaactctcaaagtatgtgtagtaaatgatttacaaataacaaagtgtaccgtattctttagtgtaaattccatgtagccaattctcacagactgctttcagtgatttttgctgggttcttctttctgtacccaacctacagttgcagttgacaaacaagaatagtttggagatgaatattgatattttcctttaagttaagagtaaggtcaaggtggagaaaaaagagacatgccaaactatcatttgttcgtccgtgacatgagcaacttgtttttgtatatttattctgcattattaactatgtcttatgcctgctttttctgctagttaaaacaaattatctggtgaggacctggtttaaaaaaaaaaaaaacaacttagaactatatagtgaagatatctcacattaagagaatgattctcatgattttataggctgaacattgatctttctccctacaatttaagtttcaactatgttttttaaaatacctagtcttttcttaaatgaccaaaacaatattagttttgactgtgtgtagtagttgttaataataatagcaataacagaagtgcctggcatttattgagcatgtgtgtatactacataactaccatacactgggtcagcactggtttagtaagtgaagcaatcacttagtaaaacaggtgtatttataagatgaccactggtctgtcatgagctttgagtgatgttacgtgacactaatggacttctactgaactgttttgtcaacatcgtagtatttttagcttttttttcttttttgagtaaacatggagtgtctcataggggccagacccctaaacagttacagttacggaaagataggtaaaatctattttctgcgcttgatctgtcttcaggttatacgtagatgtatgatttttttcttttcttctcatttatttttaaatacagtcttgcttctgtcacccaggctggagtgcagtggcacagtcatggtccactgcagcctcaacctctgggttcaagtgacaatcctcccacctcagcctcccaagcagctaggactatagatacacgccaccaggcctggctaattttttttcttttttccagagacagggtctctctctattgatcaggctggtaggaactcctggcctcaagtaatcctcgcacctcggcctcccaaagtgttggttgggattacaggtgtgagccactgtgcccgacctgatttttcttttaaagatggtaccatatactaattttgccctttgcccttcctttaaaataatcttttattaatacatattttattcagaaaacaaatatgggtattttttttggcaccagtacattttcagagattcttttattcaacatgttactattggtgctaaaactgttgtacatttagctggaaccccttcataccagcccctgtgtcctggcgctcccactcagggtagcactgctctcttttttggcacagtggcacatcccagcctcaataaatccatgctgacctctgtaactcggcctgtcaccacagtgtcaccacagagacctacgtgttctcccttttcctaccaggagaactctggtcacaacagtattgcatgtcctcatttactaaatcttacaatacagagaaattaacctcagatttgctatgccctttctactgtgaatgacaaacagtatttgttaatctatttgataaagttccacattcatttgtagttctttttgttcttagaatatatgcactgtttaatgttcagaagttacttgaatttttttttctgtgtggttatcaattttataaacaggttcatttgtctgtttgtattcagttttagggttcctccatccttgccgatgcaattttgttgagtatgtaaaatacttaatgtggttcaaaggataaaactagaaattaactaggacctatcttctccctgccctctctctccctctatatctaatttgaaatactgtcctttactcccagttaataactataatcagcaagcataatattcctttaatatgttctcaccacatctccctgttatttcctagatacactgtaccttgttagaacatttagtcacacatactacagtctctcttataaccctcattcagtcttagtcctagaagcaaatacataattaatgctttccaccagtccttatggtgatgtttgtccagtcatttttggttatctgaagttcatgctttagtaccggacgtctcaaagtgtggactccggcaggagcatcagtccccagcagaggtgcatgcaagagtttgcaacccacctctgtggtaggaaggctcttgagaacaatattcactgacttcttttgtttcctaacagtgtgttggcagcctttctatctgaatgccagttgcagattccttagtgcacattttcttttctcaggtgtcttactgtgttaatccattgttatctggcacaaaacattgctcttgatgaccagttgagtttatttgtcttgtaagtgacttggggtctttttgcctgatgctccaaagtttttgtttgttttctcttctgttttatagacatgtctttttggtatgcttttattgcttttaggatagtcaacctggctaattaaaaaaaaatttttttttagatcttttgtttctgtcttctctggcctacttggtttggaatctaatcctagcagtttttcctccttgtggggcttggtcctggaagtcctgaggagagcttcactggtcccttttgcagggcctgggaggggtcagccacctctccccttctccgccttgcccagtgcacagcaggccccaccccacagctgctctctcaggcagcagcagcctgggcttttccagattgttgccttcgcttcccctgagtgaccatccacaccacatgggccttaccactgttttagttttggtaaggcctgtgtggtagggacttgggacttactaaaaccaaaagctgtctgtggggagttttgttttgctgtcctagttgccttgttttttatgaggtgattcagggagattggaaaggttaagccagtgccaccatattcccacttgttaaccttggtggtgtccatttcttaggcagtgcagggaagacatttttaaagtatatctggccaggcgccgtggctcacccctgtaatcctagcactttgggaggccgagaggtcaggggttcgagaccagcctggacaacatgatgaaaccctgtctttactaaaaatacaaaaattagcagggtgtggtggcacgttcctctaatcccagctattcgtgaagctgaggcaggagaatcgcttgaacccaggaggcaggggttgcagtgagtcactgcactccagcctgggtgacagaatgagactctgtctcaaaaaaaaaaaaaaaaagctatcgtttccatcccttctctctacccccaagtcatttaggataaggtggttttgggaaatgggaacagaaaatactttgcatagtgtttttgtgtttatacgagtactttattcttaagtttctttttttcaattttaaaataggaaaatattttttcataagcaatatttcagataacacatgaacttgggaagtaagatttgtgtgcagtcttgcttgttctgtacataactgtcaaacgtaggagcaagtttaaggacattccaggatccagggtcttagaaaacgttttgtatttgcattggtaactactttgttggcagccaagaaagtctgtaaaaattactttcttggtggttttggaaatgttgaaattcaaatcatttatagcccaccatacctgagtcctttcactcccactttgggttgggcgctcagcagcactgagtttctgtgcacccctgccttccagactcacacttgccctcaccgccaagacctgtttgctgagtcagagatagaggtagcatacgatttcagcttaggtaagcagttttaagaagttgagattctgcttggaacaaaaaatattcttaccaaatttcattagtactacttttcaaaacctttaaaatcaatatgttaatgaatattttaatctgttttgtattttatagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggtaagggccacgggaggcagcagaaaacccatgttgagtggtcaagacatttcacaagcaaggaaagggaaacagtcaagctataagaaagtgtttatgaccatgggcggtcataaatgaagatcctccagcttttggacaccgcagcttatctcttagtctctggtttgtttctcttagaatgattatgactagaaaattaaaggctaatttgtgaacaaaaatcaggatggtttttagaggtactcagatgatatatggagcattgtatactcaggtttatagcttcatcagcttattttattaacttttcacatcctgcttggtcatttcccctgttgtcttgagtataccactattaaataataggacacaaactacattaaccagtattttaatgctttttaaaatgtatttaatagggaatttgtcccattataaaaattatttttatatggctttgcaaaatggatatattttccaaattatgagagtatttatatatgcaatatttatcaagggctataaaaaacatcatttttttcatccattatttccagttttgggaatgtattttaaggaaatcattttaaagaaggaaaagctgtgcatacatagttatttatggcagtattatcttcattagtgctacagcaaaatagaacaacttagaaaatgcagtggagaagaaaaccctacataaatgtgaacacagtcatgtaaaaatatgtgtgtaatgtaaacaaaaatgaattttaaaaaagattatccatgtaaaagtacgaggaccagaagggggaacatggagaagtacaatagtcatggttggttaagactatgggtggaaaactttcttataattttctttttttttttttaataataaaattcctaaaagagggttggaaaactgatgttgggtttggaatttgatattttgtgaattattatatggttgactgaggaagcaaaattcttttgtgtgaagaggatttaatgatcagttatcatgtaccacagtatacaagggtgattccctgaagccacaaacctgtattttccggttctcaaataaatttacagtgtcaactctttatccattcttgttttggatatcatgtcattttcaggacaaagaaaccaaaagaaatgaatccaaagaaaaatatcagaaaaggcatgattctgacaaggaagaaaaaggcagaaaagagccaaaaggattaaagagtgagtgtaaatattaacgttttgccatttacgttgctatcttttatacaaataaccagttacctaaatttattatataaaaatttatataattttttttccttattttcaccttgtttttcctttttaatatgatgagggatctgattagaattactgagactggaaattagttgtggcagaaaaataaatgtgtttttatagcaagatgctaaattttaaaaaaccttttaatatattcattatatgtaactctgtgtcatttgtgtaaatataatattgaatacgcattttggatcacttcaagatagaccataatagaaaatccattatatatataaatattggaacaaatactttatatttcttgaaaacaaacaaaaaaacaccattacagtgtttgaataaaccctagcagataaatatttagtttctgtagcaaaagtacttggaacacatgttttctggcaaacagtggttctaagagatggatgcttttccttaggttttcttactgaaagctgtatgtaactgaagtaatattaaaagtaagtttttttctaagcctaggctggttttggcagtagaagcaggtgaatgaagtggcaggagcagtggctgtttcagtgggtcacacataaagtggctgtaagactgttgttcaaagcaaaacaaaaatcttaaatgccttctattcttcaaagaatgactagaggttcaaaatactgtaaaactggacctggccttgttaaccttttttcctcctagtatcttgtatgtcagtttcagatacatttttactgtgaacatacagccttaaatggaactactgtttgtcccattcataagggtactcactagagtccagttttcaatattccctgataataaaacctgtctgctgtgtacccagagtttataatagaattcatcctaattctcttctttttggggttatttcttatgtcaggtctagtacctgccagttttcttcccactttcttctttagttaaaagctggtagcgtcaggtacagttttaccaggtacacaggcagtgctctggcaccctgctgtttccctcacttgccaccagaagccattttggtacaagcttcaacatccagctatagacagtctggtgtctttagctgtgggaaaggtgctggtgtgacttggatcactctgagactcactgccttcagtaggcctttgtcacaactgcaggtgagtagttcagaacatctgcttaacagccattcacactggacatcctttctgaatattgagcagccagtagaaagaccagctgaaacgattttgtggctttgacagtaaatcagaccaggctttataagcaaggtagatgttagtaaaaattaagaaaatatcttgttgctttaacactaagttagattttcttttgaatgtaacagaaatttgtgactcatacttaaccatctattttaattttttcgttagcacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcaggtgagtttggaatcattttgcagaatttttcaaggtagtgcaccatattattttactgtactcttctctgtatttctgatctcaacgatcaaaaaataatggagtcgaagagtttatttggatctcctgaataaataacattttatattgaagacgggtcattctgtgacttctcaatggatcaaacaatttttctgagttcctataatgttctcagcacgtatagaaattaaaagatttctgattttctaccttacctactcttacctggcagccccattttatatcttactatttaatagatttctttcaggaaattatcaaatataaacttatttgtattttacccttttaatgttgtagcaagtaacactaaataagattatattataaatgctgtcctgaggacattggagctggtcaagaagaagaatacagactacagtagtggtggggaggaggagtgctaaaaagtgtacatacatgtttataactaggacctaataaatcagagaggttagtctaataaaactttgtataatttgtgaatcttgagaaacagttgagaattgaaaaattcggaatatatgacagactagatcgcctgggaaacccttatactacaaaaatgactatatcttggataccgagggaaaatgtgcttttggatatattgctgagcttgcaggaaattagggtaatttctggtaccagtgggcaaggaggaagaggtatgtcgcccagagggcagatgccaaatagtaacactgctgttgagataccaggcagtaaaaaacagatacagtaggggaacatcagtaaagccagaagtggattcctggttttctataaaataagcctctgacacagtttgttgagaacaaaagaaacacatgaaaaagaggtacgattacaggttgtgtacagatttaaaagatgaaagaattctatgagcaatttcttaccagttgatttgaaaactagctaggcggccaggcacagtggcctgtagtcccagcactttgggaggttgaggcaggtggattgcctgagctcaggagttggagaccagcctgggcgacacagtgaaaccccatctctactaaaatacaaaaacttagctgggcgtggcagtgtgcacctgtattcccagctactcaggaggctgaggcaggagaattgcttgaacctgggaggcggaggttgcagtgagctgaaatcacaccacagcactccagcttgggtgacacagtgagactccacctccaaaaaaaaaaaaaagaaaactggctaggcatggtggcatgtgcctatagtcacagctactctggaggcgaggcaggaggatcaataagcccaggagtttgaggctatattatgctaagattgtacctgtgaatagccactgtactccatcctggtcaacatagcaagacttcatctctaaaattgaaaaagaggtttgaaaactgaatgacatgggaaaattccttgggaaaaaaataatgagactgatccaaaaaagactgaatagtcacaactgttaaagaacatgagggctgggcacggcggctcacacctgtaatcccagcactttgggaggccgaggcaggcagatcacaaggtcaggagtccgagaccagcctggacaacatgctgaaaccctgtctctactaaaaatacaaaaaaaaattcgctgggcatggtggtgcgtgcctgcagtcccagccacttgggaggctgaggcaggagaatcgcttgaacccaggaggcagaggttgtggtgagccaagatcacgtcactgcaccccagcctgggcaacagtgcgagtctccatctcaaaataaaaaaagaacatgaaatacgggattgctggcaagatggccgaataggaacagctccgttccgcaattctcagcgagattgacacagaaagcaggtgatttctgcatttccaactgaggtacccggttcatctcattgggactggttggacagtgggtgcagcccacggagggtgagccaaagcagggtcgggcgttgcctcacctgggaaatgcagggggtcggggaactccctcccctagccaagggaatctctgagggactgtgccatgaggaacggtgcactctggcccagatactgtgcttttcccatggtcttcgcaactcacagaccaggagattccctctggtggctatgccgccagggccctggatttgaaacacaaaactgggtggctgtttgggccgacactgagctagctgcagaagttttttttccataccccagtggcacctggaacgccagcgagacaaaaccgttcattcctctggaaagggggctgaagccagggagccaagtggtctggcttggcgggtcccacccccacagagttcagcaagctaagatccactggcttgaaattctcgctgccagcacagcagtctgagatcaatctgggccacttgagcttggtgggaggaggggtgtccgccattgctgaggctcgagtaggtcgttttaccctcatagtgtaagcaaagcctccgggatgttcgaactgggaggagcgcaccgtagctcagcaaggctgctgtggccagactgcctctagattcctcctctctgggcagggcatctctggaaaaaaggcggcagccacagtcagggtcttgtagataaaacccccatctccctgggacagagcaactcggggaaggggcggctgtgggcgcagcttcagcagacttaaacgtccctgcctcacggctctgaagagagcagtggatctcccagcacagcatttgagctctgctaagggtcagactgcctcctcaagtgggtccctgacccccatgtctcctgactgggagatacctcccagtaggggccaacagacgcctcatacaggagagctccggctggcatctggcgggtgcccctctgggacgaagcttccagaggaaggaacaggcagcaatctttgctgttctgcagcttccgctggtgatacccaggcaaacagagtctggagtgagcctccagcaaacctgcagcagaggtgcctgttagaaggaaaactaacaaacagaaaggaatagcatcaacattaacaaaaaggatgtccactcacaccccatctgaaagtcaccaacatcaaagaccaaaggtagataactccacaaagatggggagaaaccagtgcaaaaagtctgaaaattgcaaaaaccagaacacctcttctccaaaggatcacaactcctcgccaagggaacaaaactgggcggagaatgagtttgacgaattgacagaagtaggcttcagaaggtgggtaataaactcctctgagctaaaagagcatgttctaacccaatgcaaggaagctaagaaccttgagaaaaggttagaggaattgctgactagaataacaagtttagggaagaacagaaatgacctgatggagctgaaaacacagcacgagaacttcatgaagcatacacaagtatcaataacgaaatcggtaagcagaagaaaggatatcagagattgaagatcaacttaatgaaataaagcaagaagacaagattagaggaaaaagaatgaaaaggaatgaacaaagcctccaagaaatatggaactatgtgcaaagaccaaatctacgtttaattagtgtacgtgaaagtgacgaggaggatggaaccaagttggaaaacactcttcaaagtattatccaggagaacctccccaacctagcaagacaggccaacattcaaattcaggaaatacagagagcagcattaagatactcctcaagaagagcatccccaagacgtaatcatcagattcaccaaggttgaaatgagggaaaaaatgttaagggcagtcagagagaaaagtcgggttacccacaaagggaagcctgtcagactaacatcattctcagcaaactaacacaagaacagaaaactaaacacacactacatgttctcactcataagtggtagttgaacaaggagaacacatggacccagggaggggaacatcacacaccagggcctgtcagggggtaggggctccgggagggatagcattaggagaaacacctgatgtagatgacaggatgaggggtgcagcaaactgccatggcacgtgtatgcctgtgtaacagacctgcatgctctgcacatgtaccccagaacttatagtaataaaaaaaagaacgtggaataataaaaacagcctcataaatttaacgccaagtcagatgggtttctcaaaccaaaggctaccaaacttataaaagtcgctctaaaaatagacaaagaatgctaatgctaacttattctgggagaccatcataacttcagtaccaaaaccagacaaaaactatatataagaaaaggccgggcgcagtggctcatgcctgtattcccagcactttgggaggccgaggcgggtgaatcacctgaggtcgggagttcgagaccagccttaccaacatggaaaaaccctctctctactaaaaatacaaaattagctggatgtggtggcacatgcctgtaatcccagctactcaggaagttgaggcaggagaatcgcttgaacccaggaggcagaggtttcagtgagctgagatgaaaccattgcaatccagtctgggcaacaagaacgacacaccatctcaaaaaaaaaaagaaaaatgacaggccaagctcactaaacgaagtcacacgcaaaatcccccacaaaatattagcaaatttaatctggccctgttttaaaaaaaatctcatgatcacgttgggtttttcctacaaattgtaaaggagaaattgatttaatagcattcttgattaaaaagtaaaaacaaattatgaataaagggagctttctcgattgataaaggacattaaacctttagcaacataagccaggcatggtggctcacacctacaatcttaacactttgggagctgaaatgagaggatcacttgagcccaggagttcaagactagcctgggaaaacaagaccctgtctgtacaaaaaattaaaaaagctgggtgtggtactatttgcctatagcctcagctacttggatggctgagacaggaggaccacttgagcccggaagttcgaggatgcagtgagccatgataacaccactgtactccagcctgggtaacagagtgagactctgtctcaaaaacaccaccaccaccaccaccaccaccaaaaaaccctttagcagcatgagttataatggtgtaacattagaaacattgatttgatttgattttttatagagatgggtttcaccatgtttcccaggctggtcttgaactcctgggttccagtgatccacttgcctcagcctcccagtgtgctgggactacaggcatgagccaccatgactggccagaaacattgattttaaaccaggaataatacaaggatgccttctgtcaacacttttattcaacattatactaaggtctactcagtacagtaagacaaagaaataaaaaagccataggcattggaaaggaacggggaggggaaatagctgtcacccaggcgggatgcctcccacctataatcccagtgctttgagaggccaagcagatcgcttgagctcagaagttttgagaccagcctgggcaacatggtgaaactccacttctacaaaaaatacaaaattaggcgcatgcctgtaatcccagctatttgggaggctgaagcaggataatcgcttaaatccgggaaggtggaggttacagtgagacgagatcgcgccattgtactccagcctgggcaacaagagcaaaactccgtctcaacaacaacgtaataaaataaaataaaataaaccaggcaggatggcacatacctgtagtcccagctactcaggaagctaaggtaggaggaccatttgagcccaggaggcagagattgtagtgagctaaaatcgtgccactgcacttcagcctggacgacagagcaagactgttgtcaaaaaaaaaaaaaaaaaaaaaaactgtcgtcatcagattcatattaaaaacctaaaatctacaaataaattattagaagtattaaaaatgtagcaaggtgactggatataagatcagtgacaaaagccaattttcttttttaaacctatatacatttctacataaataataaatgtattttttaaaagatacagttttcaggccgggcgcggtggctcacacctataatcccagcaccttgggaggccgaggcgggtggctcatttgaggtcaggattttgagaccagcctggccaacatggtgaaaccccgtctctactaaaaatacaaaaattagctaggcgtggtggcacatgtctgtaatcccagctactcgggaggctgaggcaggagaatcgcttcaaccgggaaggcggaggttgcagtgagctgagatcgtgccatcgcactccagcctgggggacaagagtgagactttctttcaaaaataaaaaataaaaacatacagttttcaatagcaacacattaaaagatttaaaagattgcttagaatattgttcataaaagatgggccaggcacggtggctcacgcctgtaatcctgggagactgtggagggtggatcacttgaggtcaggagttcgaggccagcctggccaacatggtgaaaccccgtctctactaaaaatacaaaaattagccagttgtggtggcatacgcctgtggtcccagctactcaggaggctgaggcaggagaattgcttgaacccaggaggtggaggttgcagtgagctgagatagtgccactgcactccagcctgggcaacagcacaaaactctgtctcaaaaaaaaaaaaaaaaaaaaaggcctgtatggagaaaattttaaagatttcttgattgcttgaaagttactaaaatgtatatatgccatttttattagaaaacagttttagggtccaggcacggtggttcacgcctgtaatcctagcagtttgggaggctgaggcaggcagatcatttgaggtcagaagttcgagaccagcctggctaacatggtgaaaccccatctctactacaaaatacaaaaattagccaggcagaattttttttgcatgagcaaaaaaatagcttttttttttttgcgcttgagcaaaacatagctcatgcaatttcagctactcaggaggccaaggcacagaaatcacatgaacctgggaggtggaggttgcagtgagccgagatggcgccactgcactccagcctggggacagagcaagactccgtctcaaaaaaaaaagaaaagaaaatcaagcatatcaggtccagaggcaagacccacacttgtcaggaatgaacatgggttttgaaccagtttgctttgttagagaccacaatctgagctgcagctcagcctttccagtggttctggtctaggcatgctctctgttcttacagcagtcctgtgagtttggtggtattatctcagttcataaagacctcatctgttctgcttccacaatctttccacattgcttcctcagtggtgggatgggtcatggggcatagcaggtgggggcttcatgggggactcagacacctgaataagaagactggctctgccactcactgctgtgtgtctctgagcaaaccctggagcctctcccagcctctctcatctgtaacatgtctccccttacaggttattgtgtatggaggaaataaatccattcatgtaaataagttaacatgtcttatgattgctagtggctttcactattaccattgctgatagacctgggatgctgcaccaggatggacagcccagaggctgtgctgtttctctgctgtcagctctcagagttagcagaagtgttagtttgagttgagggctttggaaaagttcttcatttattgcatatgttttacaaactttttttctgtggccaggccatctgcctaacatcatctatatagtttgaggaactggtttcaggtgaaaatcctttaactctaccatcaagtagttctgtttttcacttgtaaaaaaagcacaaaaccattgtgaattactcccaaatgacctgcactgaagtctgtgtgattgattgcagtggtgataaaggctgaacacatgcgtcctcagtgttcccgtgcctgtaggtcctgtcggggaagactctagcaatacctcacgggggtgggtgtgggccagggcactgggagcaggaggcttccagatgtaggggcctgtgggagtctggaaggatccataagcagtgcctttgactcacatgctgggatagctcacatgctgagaatggctttatctgtacatggttggaagcagtgtatgtccaagaagaatggtgtaagggagaagagtcacattagaattgcatttcctcttaccagatccccgatccctccttcctttgagctacttagtcttaaaattcctcctttgctattttacaatgacagcttacctatttatctttatgccttcagagtaccatggcttctaaatgtggatcgttcatattacttcccaaagaaaattggggattttatcaattaaaagaccccattatacaatgacttgtgttaaaagtgtacataaagctttggttaagacaccacaaatttcataaacaacattgtgggttttttatacttcagacaaatgtatgttaacaaggctattgtgtgttccagatggcaggcagcagattctgagtttgggcatggacctgcagttggaatggatgaagttggaagatttccaaaagcaccttgatgggaaagatgagaattttgctgcaacagatgcaattccaagtagtgagtagttttggaaatattgaaatccctttcacaaatctagatttataaaatctaacttattttttctttcattttagatgtgttaagggatgctgtgaaaaatggggattatattactgtaaaagttgcacttaattcaaatgaagaatataacctggaccaagaggtaatatgtcgttgaaaaatctcatgaaaggaaaatggaaagtaacacttgaaagaattcagtttaacttttcatttattttaattacaaaaggctgggcgtggtggtgcacacctgtaatcccagcactttgggaggccgaggcaggaggattgcttgagcccaggaattcaagaccagcctgggctccatggtgaaaccccaactctacaaaaaatacaaaaattagctggacatggtggtgtacacctttggtcccagttacttgggtggctgaggtgacaggatcacctgagcctgggaggtcaaggctgtggtaagtggagatcacaccactgcaccccagcctgggcaacagagcaagactcccatctcaaaaaaaaaaaaaataatgcacgttcactttgtaaaataaaaaaattgtagaaccctataaatgtacaattatagtccctttaattccaaccccctcccctctaaaagtgatggtttggtttggttatggtctacctgttttgtatgtggtttaccctctgccactcttgagagcgtagagtgagaccattttcctgtggtcatttgtgtttctttgatggttgtcccatttacaacaatggtccatctctcctgttgtagctggggatttttcatactgatatgtatggattttttttttttttttttttttttgagacagtgtctcgctctgttgcccaggctggagtgcagtggtgtgatctcagctcactgcaagctccgcctcccgggttcacgccattctcctgcctcagcctcccgagtagctggactacagttgcctgccacctcgcccggctaattttttgtatttttttttttttagtagagacggggtttcaccatgttagccaggatggtctcgatctcctgaccttgtgatctgcctgcctccgcctcccaaagtgctgggattacaggcgtgagccaccgcgcctggccacgtatggatttttttaatggaagcatattgaccctttctccctagattttaggtttgtgtttgagtcttgtattgcttgaagatttttagttttaggcaatcatatctgttgatcttttacatttatggcttttgggtatcttgtcttgcttagaaaatatttttatattctttagttttttagcttagctgtggattttttaggtttaatcctttgggattacaattcacaaaattattgggcttttgattaaaattgcatgaaataatatagattgagaattgacatttactttttgcatcttctgtctaggaacatggtaattctacattcactcagctcttcatttatatccttaagcaaagttctatgggttttttcattcatatagacgttgcacatttcctatagatgtatgcctatatgttttataatggtcattagagtcttttttcatttacattttgttttctaactggttattgcttgtcgatggtaaagctgtggatgtctttgtacacataagtgtgtgtaactccagtcatttaatgaaattcttatagtttttaagttacttgttttggattttctaggtagaaaatttgatcgtatgccccccaaaaattcactgttcattttgtatggtgcaaacttttcatgtgcctttaggatttaatacacaaaacaaaaagaagatacaaaaatgagagctgggcgtggtggcatgcacctgtaatcccatctacttgaggctgtggcaggaggaatgcttgagcccaggagtttgagaccagcctgggctgacatagcaacaccgtctcaataaaaaagaaagaaagaaaaacaacaccaacaaaaaaaattgaagcattccttggagatattgtgggtttggttccagactgttggaataaagcgagtcacacaaatttgttggtttcctggtgcatataaaatttaggtttacactatactgtagtctaaatgtgaatagcattacatcttttaaaaaacctatatatcttaatttacaacactttattgctaaaaaatgctgacacaacaacacaaaatgagcacatgctgtggggtaatgatgtgaataaacgtgcttgtggcagggttaccacaaaccttccctttgtaaaaaacacagtccctgtgaagtgcagtaaagcaaagctcagtgaaacaaggtaggcctatagaggaaagttgtaaaattttatgcaaacattcatatgtgaaaagatactctaaaagctagtagcttctgatggttgggatattttagtgaaaatcctaagtagatgcctaaatcagtgcctattagtgatttcacattgaaacatctcgagtgagaagacttggttctgaaattgttctgactaaagattaacacgttttttatttaacaaaccaacacaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaaggtttgtggcttcttatgcatcagtttcagagctttcatggtattcctgccgatggactgagaggatctctttggtagtgaaatatagcagtcacatggtcacatcgctttttttttttttttagacggagtctcgctctgtcgccgaggctggagtgcagtggcacgatctcagctcactgcaagctccacctcccgggttcactcctgcctcagcctcctgagtagctgggactacaggcaggtacctgccaccacacccggctaatttctttgtatttttagtagagatggggtttcaccatgttagccaggatggtctcgatctcctgacctcgtgatctgcctgccttggcctcccaaagtgctggtattacaggcgtgagccaccgcgcctggctgtcacacggtcccatagctttttaaaaatttatttttagaaataaggtctcactctgtcacacaggttggagtgcaggtggcaccatcataactcactgtagcttcaaactcctggactcaagcaatcctctcgcctcagcctcccaagtagctgggactaagtgtgtaccaccacacctggctaattttaaaaatttttgtaaagacatggtctcactgtgttgcccagcctgggctcaagtgatcctcctgcctcagttaaagtgctgggattacaggcatgagccaccgcacccagctggagtaactttttaattttgtttcagttgatctgtgacatgtaatgaatggatttatcatcagtagtacattgtaatcacatttcaaaatgtgatttatctcgttggaagtaatttatattaaaatactctgattaaagtactaatattttaatcttagataatttaatttttttgaataaatggtatttgtattccttttggttaataatttaattgaaatgtttccatatattatctttttaaaggatttatatgcagaggttcttaggttggagctagcggttccattcgcagttgctggcagcacagtgagtggccacgtttgggcctctgtggggcggggtgcacccccgtggccccacgggaatgctgcagcccgcaaccacttgtgatagaacctgctgggtatttttcctgatgactaaaaatttcaaaatatctgaaaactgtcttttaaataatttgggaaattaaatttgcctttttttcttttcatagaactttttaacaacagtggctattcttttggaagcaggagcttttgtaaatgtccagcaaagcaatggtgagactgcactgatgaaggtaaatccctcctgcaggtcatccctttcttcactacgttggcaggtgctcgtgttggcatctgccactgccaggcactgtgctggggactgagaacagagtgggtaccaagacagtcctagagtcagccgcttgcaggggagaaggagaagcgggctggcagggtagcagtgagagctcagtatgggcagtggtgtgatcagaacaggcacagagagccatgaggtcacagggaagtgctccgagctgggccctggggaccctgacaatccttagggtggatgaggcaggtgccacactgtgtcctaaatggcagtcaagtcagccgggagggagcactccggccgcagctggagcagcagggaggctgctggcctcgaaagtgcaggcctaggggtgggacggagttcctcgtgcactctgtgtgttcgtcattttatgttggtgaatttgttgcctcgggcttgttcctgtgttctggaacgtggtttgcagacaggttttgagagaaaggtcagcagtttggcatttgtcttagggggccctgccaggtctggttggttcctctgtggcagttgtgggttcctggcccaggatgctgttaggatatagcaggtccagacacccagccagtggtggccggctcagctccctgtggggacctgtcctctttccttcctgggatgcttggctccatgtaagccattgagccaagcgggggcctgcccacagcgcccattccagccgctgtccccagtaagcaaaagagcacagccaggccctgggtctgcagggcacctggcatcaagtctcactgtgaaccctcttctgatggcctggaccacctgtcccttgtcctcctgctgcatgaggcccataaacagtctccttctgtcgcccgggctggagtgcagtggcaccatcatgactcactgatgccttggcttccagagctcaagtgcctccctcagcctcccgagtagctgggactacaggtgcgagccaccacacccagccattttttttcttattagagacaaggtctcactgtgttgcccaggcttgtcttgaactcctggcctcaagcactttccttttggttcatggaaatgttcattttgtttgggagcctgaggtttgtctttgtttcccttcatttgtttctgtggttgtcttgtgtggagcagaggtggcctctgcaagcatcatcttagtgacagatgaccaggtgtaccctgaactgcagccacgcaggtgcatttagagcatgagagaggtgggtgggcacagaagcccccttcatgccaagccttagggagttcgtcctgagggcactggggagccacagcaaggttgaagctgaagaagggtagaatcggattagagggttttcatttgtgtattttaatgctgcttagtacagaaggggcatagattgagaagaagatagtttgcaaacttgtcaggagggtctccagattatgtgaaataacagaagtctgtacctcgggagtggcaggagggatggagtgggtgaggtgcccacttggtaagagcttggtaactggaggtgacgcctgggcatcccatttcctaagttggggcacggctggcagagctgggggagttgggcgttgggtcgtgtagatgtcacctctgtacatttcacaggggcatctaggctcaggagagaggtgtgggctggagattcaggtttgttgctgtccagctctgcaacagtgaccgtagccataggttgagagtggggtcatccatggggaattggaaaggagaaaagggccatagatggaaagagcctgcgtggggagaagcagaggaggaggaggaagtggtccacgggctggcagcacctcccccacacagcaggcagaaggcaggcgggagtgccccaggtcagcacctcagggctgtgtgccttgctgaggtacgtgtgttgagttggggagtggggtgcagaggggagatggctctggaagtgggttggggagggcgtggcgtttcttccctgagcggacatgtagcacttatttattttactgggtctgaattcagtagactgcctttatctgccatgaggtttatttaagtgtttgttcctgaaaagctgtattttaattgctttcaggatttagcatgttgaagtttgagttttagaatgagaagatgtaaacatagtgattttcagaaattaaaaacctttttatctgaggagaaagtgtgtaacattggtccttaccagagtgggcaggtgcagagggactgccctcgcctgtcactgcaggctctgttggtcccagaagggcctctcaccctccccgtggctgtaatgtgggccactcgctctgtcccgagcctgtcctggacggcgtccctaacctctgcactggatgcccagggtaacaaccagaaaggtctcaggcattgcccaggctcccctgatggcagagttccccctgccagaagcactggatgacaccgttgtcggggtagtgtggcggctcctcctagggctgcgggagtgccaccgctcctggaggctgctctgcaaagtgacgctgctgccccagcatctgcctcacagggtagggaggcacaggcacccttatcctcttttcgcaaatggaaacgtgccactcagaagaattaagggacttatctgaagtcacgtggctaataagtgacagagacaaggagacagtctgtcagctgtgccacagctccatcgtacatttgcaggttcagattcggatctgtgcttgggttgtctcctttaaagcggcagctggggacatttcgagggtgttttgtggtcctgagaggtgtttttgagattcctgagacaaagttgtctacagtgaaggccaggcttacgtatctctgcgcctcgctgaggggctggctcacgggggacagcgtggcatggacagagggcagcagcaggggactgcttagcaaggcctggtgtctgttctgtcttgggactgaagcatcctttttgaagttgcccatttcctgaaaactcagtgctaagatattaactgaatgtagcacacagatttttatgttggcccctgagtcaaagatactccccacttgcatttaagcaatgctgtgtgactcctaacgctgtggcctgacgggccccaaaagttctctatccttcttccatggcctgtgccctctcttcacagaaccgctaagcatgtatggagaagggaccagcacccatgccacagtttacagctaagtaattgttactcctttttacctgacgtaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacgtaagtgagaagcgactgtgccatagttaagtcacatatcatacatctgtttatgtagacatattataattggagtggcctgtgtgtaactgctcagaaaaacatccagcacaagtcctgatggttttgtttccagtagatcacagatttaataaatggcatatgaattatttttctgcaagttatttaactctcagaaaatttcaaacttaacactggcctatctgggagtattttccttaaatattaagtatgctcttaatttggttagcaaaggttttcttaaaaacatttaaacttggccgggcgcagtggctcacgcttgtaatcctagtactttgggaggccgaggcgggtggatcacttaaggtcaggagtttgagaccatcctggccaacatgatgaaaccctggctctactaaaaatacaaaaattagccgggcgtggtggtgggtacctgtaaccccagctactcaggatgctgaggcaggagaatcgcttgaacccgggaggcggaggttgcagtgacctgagatcacaccactgcactccagcctgggcgacagagcaacactctgtttccgccccccaccaccaaaaaaagaaagaaactttaaacatttgtctttctttttaatagactttattttttgcaacacttttaagcacagcaaagttgagcggagggtacagatttccaagcctccccaccgccatcctccccgactgtcgagatcccagtcacccacagtgggacatacagctggggaacctacagggacatggcataatcccctggagcgcagcattgacattagggctcactcgtagtgttacccattctatgaatttggacaaatacataatgacatccatccctcatcacagtgtcatacagaatagtttcactgccttaaaaagcctgtgttttccaccttttcatccctccctcccccagcccctgacaaccaccagtaatttaattccttcatattttgccctttccagaacaggtggaatcacacattatttggtctttgcaggttggcctctttcatttagcaataggcattcaagattccttccatgtcttgatagtgcatttctgtttagcactgactaatattctgttgttggttgtcaagatttactagtttattcaagttcattctttttcaaataaattctcaatcatattttattttattgcaggttcatacttataacacaatttagtatttctatcacttaagaactcttggcaacacatatcagaaacttgcatgtatcagacagtagcgaactcaaggcggtgtttatgtagcaggtctcgggtgggcctctgggaccgcgcctgttgaactcagtgctgctgatggctgcagtcccaactcctctggtcacacggggggtttgcatagatccagcaagtagagtgacccactttcctgatttgcccagtactgaggggttcccctttctgattttccactgattcattagacaactatgtattaagcatagactttgtgccaggcactgttctaaaggctggggagatggaaatggcagtggagggaagagacttgccttcttagaacttcaattccactgagatggacaacaagacagacacatgggtgtcaggtgcttggtggaagtagagctggaaagcggaggcaggcagagctgcaggtctttgtttggaaggttggcctgggaagccctcactggtattcgacaggcttgtggttcttttctacattaacgttaacacgtactatttttttttcttagactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggtaagccgatgcctcccttcacacttttctatgtgaagtgtgacactatattaacagatttttagacagaatcctttcttggaacaaaactttaaggaaattccattacgtgtaataattctgcagaccggttaacagtagagccactctggtggaagagacatccagctgacaccccatccctgttttaacacccatatagagcatggaagttaggtcttaataatcacactagttctcaatgagttttattaaaattcagcgtcaagattctaagcctagaatgttttttccctgaattttgttgtttgtaatagtctttgccctttgaaaaagaaaaaaatagtcttgctccatagtaaagctgagtggaaagagatggagaagccactttcctctctagcctctgctcgacagaccctctccaggcagggctgcggctggccctctctacacgtggcgccaggtagacgtggaggcagtgcagtctgccgaggggaggaagccgggctctggctttttttgcttagaaactcctgttccccattttgtaaatggtttgtattcattcctggaaaatgtatttaagaacatatagccctgcccctgaaagagccgtttgtaatatcttagtgttgagagaacttatcaggtggttgctgttgttttgagatggagtctccctgtgtcacccaggctgcagtgcatggcatgatcttggctcactgcaacctctgccttctggcttcaagtgatccgcctgcctcagcctcccaaagtgctgggattacaggcgtgagccaccgtgcgcgttcagtaatttatagttttgattattcgggtggaccatctgcattgccaggtatgagtaccagagaacgatgccctgagctggccctggtgaacctgagcccccactgacacctacaactgctgggcctgcagttttctcagcatgtgtacaatgtctgcatccaccaacttttttttttttttttcaggagtctcacactgttccccaggctggagtgcagtggtgcgatctcggctcactgcaacctccgcctcctgggttcaagcaattctcctgcctcaacctcccgagtagctggaattacaggtgcccaccatgatacccagctaaattttgtgttcttagtagagatgggggtttcaccatattggccaggctgatcttgaactcctggcctcaagtgatctgcctgcctctgcctcccaaagtgctgggattacagacatgagccaccatgcctggccaatttttggttatgtattaatcagaaaaattggaaggggcaaaagggtatgtggaagaaaatggaaaaccactcagacccacacccaaagatgcccaccacaggaatgtccctgggacgtgtgcacattcagcagcagtgtttaaataccagttaaataacttcagtgtagaaaatcatacgtaagtcttttccaggaactgtcagcagagattacttgggcaaaaggtaaaaagagttctgtggttgaaaaatgccaggtgacacgagctttgagagggccagcctcctctgagcctccaggcagagtgggtgatgcctgtctgaccaggcccagctcaggggcctgcttccatctggtgttgagtgttcctctggggactgaaggttgcctttgaagtaattcacacacatctcccattttcaggctctggcatcctgctgtttatcttccatgcaaactttttgggtaaagaagttattgctcggctctgtggaccgtgtagtgtacaagctgtagttctgaatgataaatttcagcttcctgtttttctggtaagatactctgtatttcactactgaaaagtacattcttctaatcaaaagcacagatgacttaattttaaattcctgtgtcttaataaaatataagcattcagaaaacgatccagtaatagtggttgggaatgaggcaatacccataaagtaaaattatcctaagttttgtcagtaggaatttttcctgcttattttttgccttaaattgtgctcaccatactgtcttagggccagcattgttctgaatataaatacttaatgatctcaaagattctttgtacataattactttgccactgttagaattatttccttggactgaattaagcaaaatttgctagatatagacattttaacacttgtactgtatattgctgggggcattctaatccagtttcccagattgattctgtcatttgtatatttttaataaatcaagggaaaaataaatcactttttttttttttttgaagacagggtctcgctctgttgtccaggctggagtgcagtggcgcggattacagctcactggagtcttgacttcccaggcacaagcaatcctcccacctcagcctcctaactacctgggactaaaaatgcacgccaccacatccggctaattttttgtattttttgtagagatggggtttcaccatgttggccaggctggtctcaaacttctgggctcaagcgattgtccgccttggcctcctccacaacatcttgacttatgaaataaaaaataaaacttatttatgattcttttacatcattggtgttttaagggcttctggtgtaagtttgaaaacactgactttttttttctctttccattgtaggacagtcattttgtttactcattcagccctgttgcaggtcccaataaactcttcataaggttgacagaagcaccctctgccaaggtgacagtcctttcttcacatttagtgtcactactcaagttgttgctccagattactttatcaacattagaaaaaaaattccaagaatcctggtgtacctgtcctagagacaggcactccctggggtagtgatgctaggtgcaccctctctcagtttacaatgtgttagacataataatgcggcaggaaaagaactaggttgcagctgagaaagatgcctctctagaggatggagccatctgaatcatgatctaggccttggtatggagttgccaaatgtatgtctttaggccggtccctaacctctcttgtatgaaaggaagctggacaaaatagtctctctaataaaacagtaatataaaattataagcacttggaattatttcttgaattaaaatggcaatgatctaacaatgtaaattgataagcaacttgaaaatattgccaaataatagaagcaaatcttggccatttgtgggttttttcttgtaagaaaggggaaatctggatctgtactgacacctgcgttcttttctttcaacaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcgctcttgttgcccaggctggagtgcaatggtgcgatctcggctcactgcaagctctgcctcctgggttcaagtgattctcctgcctcagcctcctgagtagctgggattacagacacccgccatggcacccagctaattttgtatttttagtagagatggggtttatccatgttggtcaggctggtcttgaactcctgacctcaggtgatccgcccgcctcggcctcccaaagtgcttggattacaggcatgagccaccgcacccagcaagagttattttcttaacttgaaattttctactagccctggtgaacttctgtgcttaaaaaaaaaaaaaaaaaaaggaaaaattcagctctaaaacatttgcttacagcaagggagccatgttatattcaagttacccaagcaccaaataaagtgtgggtttgctgcccttgaaagggttgggaggcctgatctttttctagtagacagttgccacacattccccaagcacaaaaggtggagatggcagtcactttgtaaatatgctgtagtcacttatcatcttttcaaagggtaacaagagaatctaagatgtagtaagaatgtaaaccagtacactatgagacctaaaagagagtattaaatgtgaacttttagcagagcgtggtggctcacacctataatcccagcgctttggaggctgaggttggaggattgcttaagtccaggagttcaagaccagcctgggtaacatggggtggaacaagcctgtagtcccagatactcaggaggctgaggtgaaaggattgcttgagccagggaggtcaaggctgcagtgagccgtgaaaggccactgcactccagcctgagtgacagaatgagaccttgtctcaaaaaaaaaaaaaagtttcttggaacctatacggtttttttttgttttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttatatctcaagtctcaaaactttaaaagacagtagatatttgtggttttctagctaaatgagggccaagattggactttttcaactaaattgaatcatgtagtatatctgatttcatagctttctgggggaaaagggaggatttgaattagcagcagtgcaggtcaggagcagtaaagaagacagtaggaggagtccaactatagatgtgaatgaacagcctcagaggaacacatgagaaggtgacctgctgtttatcaggaaggcggggctttctctctaagatacaaaccaaataggaatcgtcaaatagttcaaattatccgggggaaaaagcctgagcaatgatccctctggaaaacaaagcagttctcaggcagcaccttaccaaaaggtttattataacatttagaagtacaggtcaaggcccagggcaatgttgtgtagtgcagttcaagtgtacgcagcacagcttatgtgactgaggacacagacctagtcatgtccggatctcctagtcttttcccctggaaagctacgaagtcagatgatatggtactagtacatgattcagttcgtggcctaggacataggtgatctcaggactaagatcaccacagatgggatgcatggctgtggccagactcgcatcatggcctctgccattattcctttccactgtctacttgggtaaggacaacataacttggctattcaattaacttaccagcggcagcactcaaatctagttgactgtaatggctgtagcagaaagtacattccacgtccttttgtctgttctgccaaaataaatagggattctgataatgttgaataactacaattagatatgaggagtttggtttcagtccagaaatagaaaaactattccatttttatacactatcctcgcaagtaaatcctgtattgattcttaaatgtggagaatcttactcagtagaatgatcaggagagtctatttgaagctcaggtgctacttctgagtgagttccgcttgtactgcattgtatgcattatactgggtagctttgaaagtgaagcaccctcccaaacgaagctgactgtttgtttgttaatgagaatatactagtgctggccaggcttataaggcactcagcatgtgaaccaggggcctgatgaagcacacaccatgaaaggctggattggatgcccagaatgaaaacagtggagctcaaggaggatgattagcaaaacaaggaaaagcaggagacatagagcagactatgaaaaacctgggtcacaaaatgacaaaggctaaagaagttcgaaatgtttaatatttcatgcagttaacatgcttcaaagctttaagtctgaagttttagacttatcccaaatccttgctaagaagtcaagaccactatggaattcacactgctttctatagacttccactgacttgcagctaatggtccttacacagcaaagttgggatttctagacgtctccttccaggttcggaaaagcctcactaggcaagtggcaagactgtgaagacaatgaaggttcagaattcagtcaaatggaaacaagatcaggaaacaagatcaaggactcatctgtccgcctggcaccactttagttttgaaggtgacgccaccacgcatccccgcagcacacactccttcctgtgccgactcccgctatttgcttgcctgagccagttcatgtttcagtaagaacgatttttctcccaacagtgccagttttcttattcccaattttgagagttgacccaaaattgtgggctatgagggatggtttttaaaactcctctaatggttcccaggcacagagcgttgaaaaggagggatttcttggctattctgaatttgtgcattgctgccatactacttcccaacacgaaccagcaagaccaccacaccaaggagtgggtaacatcttgatttaatttacaaataaaaagccaaaaccctcaatgcaaaggaaaactgcagtttacacttattctggagatcatttttaaccacagaaaatgtgcccctgtagcatgtttttaaatggcaagtgctatgattgcccagacatccataaactgcttgtatggagtaagaaattcataaatgaagaaagatttgttttctgtcttgtttctcctaggtcacgaacaggatatttcccacaaaatgttttgacctggaaaagagacagagtcttcactagtaaacaggatctaatctccatagtatatttttctaaagaaacaagagctttcagtcctaaagtaatttgctagactagaatcactgaccagcagacctaaattcaagcttcaatattaagattgttgatggaggaaactgtcatggaaatggcaatttcttaactctttataataaaagcagattcaatgtcacaagaattaaatatttggccttttaataattttactttctttacatgtttctggagtgaacctcggttacttttcactgactttgttagaaagcaaaatctataaaaggagttactttaactgaagtaacagtattcacatattttaaccaaaattttaaaatcctaaagttccaatgacaaatctacctgataagcttatagaatctctctccccttctctctttgaaggccacagaatgccacaggcttgatctatgccacagacagcttatgtacacaattttttttcctttcccatatatttccttacccatatatgagattcgttctttggattttcagatacctacataatacagcaatttaaaagtttaacttcaataaaatctccatagactagaaaattattctctagtttccatcctcaaaatttctgttgcataggctgagggtgtggcttgagaatgtgcattctgaagctcccagatggcgatgctgctggtctaggcctgagaaccaaagcctgagatttaactttctagagctgggtacagtatgcaaaacagctgtcacatttttgtgctgcatgaggtgtcagatactttgaaaaggtataatttctcaaaactacagaatacatcagtgcatctcaaaccaagtgcacacaaatcctagaaagaaacgtcttcattagtacacaggacctaatcttcacagttaaaacggactttttgacttgcaggactctgtgtcctgtgtgggagacacttcatttccaagaagctctcaggcaacactgtcactcctagtccccagaaccacttgtagcagcaagaataagacacaataatgtttagtatcaccagacaaaagctagaaaagacatacacttaatactttctggatctattaggatgacaatgtacccatgggaattttgtcataaagactgcattaatgtttcaataatattttaagagtgacataacaaaagaaccgaaaaattgtgacccctctccgaaaaagtaaaaagcagaggaggaggaatggatccatttttaagattacatattttctggccgggcacagtggctcacgcctctaatcccagcactttgggaggccgaggcgggtggatcacaaagtcaggagatcgagaccatcctggctaacacagtgaaaccccgtctctactaaaaatacaaaaattagccgggcatggtggcaggcgcctgtggtcccagctactcgggaggctgaggcaggagaatggcatgaacccgggaggcagagcttgcagtgagccaagatcgtgccactgcactccagcctgggcgacagagcaagactccgtctcaaaaaaaaaaaaaaaaaagagattacatattttccaaaggaacacaagtttaaaattctaggtttggaggtcattaaaaatcaacaggaaatttttttacaaagaccttttttttctctctcctcactccaagacctctatgtcatttcccctcttagtcatttcccctcttagtccagttttacctgaagacaaattaatatacgcattacaccagtgaggaaagaggagggcaaggcgaagctgagagtcccctctagccttgctgagatatgatgccagggtttcctacgaagacaggccaagctatagaggcttcagcttcacctataaactgttcataaatattctactgactcaaaacactgggaccattacatatcttcattacagtccacagaatcagaatcaggaagaattgactagaaaaaactaggaagaaacgaatactcaaggatctgttagaaaataatgagcagatacggactgacctgaaaggaagtatgattccagtacttctggtcttaactcttctgaattacactgcaagctgaacttcgggtaacttcagccacattttcttttatcaccctagaaatacaatgaaatcagattcagcctttttaagaactgatttcaataaacaatgagaaaaatcagagttaactcatttagtaaattcataacagtaattgaggtttcgataccatgtagtgctgcgtgctgattatttccattcagtaaggattttctttttaattcaaaatactctccatttcctcaaagaacatcaactgaattaaaatcagcttcattttatcttctacagtaaacagtattaagtcctaaataccaaataattttcagatctgctaataatttattaagaatttaattggctaagtccctccttatttccacaggccctcttgtacagattgttgatacctcagcacaacacagcttgaaaccttgtattgcaaaatcccacaaaggatcctcactcccactgtgtctgcaaaaccgtattccacttgtaccaaggcagggaataccaatgtgtgtgtcgtgctccatcagaaaaagactcttaccctagtaagaccttgatcaatgttcttcaaagagcacatacccaaaacatttcaatagaggacaggtttatgtgtacagttatccttatatatgttttataatatgcctgaaatattcatacagtcatacacaattgcattttgggacacataaacatacagctgtgtgctcaattttcaactgttgggggtccatgatccaaaaatattggaaatcattaccctagatcagtgttgttaaaacccatttgggactcaatttgcctgagaattggatgaagcccaaaactgtccccccagaaagtatatgtgaaatatgtatgcagaaactgtagacaagactgcctgcaagtaaaggggatccacagataccctaatgcaccccagtaacccaagaggacccatggggtccctataatcaaatctttggagtttttgtttttgttttgagagagggtctcactttgtcacccaggctagagtgcagtggcgtgaatacagatcactgcagcctcatcttcccaggctcaagcaatcctcctgtctcagtctcccaggtagctgagactacaggtgcgcaccaccacacccagctagttgtattttttgtagagatgtgattttgccatgttgtccaagctcgtatggaactcctgagcgcaggcaatcctccagccttggcttcccaaagtgctaggaatacaggtgtgagccaacatgcctgtcctgtaagtattttttaaaacaaggcatggcataaatgaacaaaaaattattttttatatatttccaccagcaattggcattctatctactcttgtatgcaagctctgaatttatagactctgtatccttatattcaccatggattgaaaatgcagttagaagccaggtgcagtggctcacgcctgtaatcccagcactttgagaggctgaggtgggcagatcactttagtccaggagtttgagaagagcctagacaacatggcaaagtcccgtctctacaaaaaaatacaaaaattagccacacgtggtggtacatgcctgtagtcccaactaattggcaggctgaagcagaaggatcgtttgagcccacgatgtggaggttgaagtgagctgagatcacaccactgtgctccagcctgggctacagagcaagaccctttctcaaaaaaaaaggaagaaaagaaaatgtagttaggccccgagtggttgtgtctatactgaacatgtatagacttttttccttgtcattattccctaaacaatatagctccatagcatttacactgtatgaggtattataagcaacatataatttaaagtatacaggaggatgtacatgggatatgtgaaatactacagcattttatatcaggaacttcaggatctgcagattttgatattcatgggggcagaagcaacctcccaggaaatggaggaacaactgtttatgcctttggtacagtaaaggctgacaataaaaataaacagaaccataaaccaaactggacaacagtgtcacttaatccttctcaataacatcaggattactaaaaactttaagcattctcagcttctcaaatatgtgaatactcaatttataaaccattactaaaacctagaaaagtaatttccagaatttagccaagttttagttgtcaatatttaatttcaatttttaaatttttatgtatttatttattgaggtggagtctcactctgtcacccaggctacaatacagtggggtgttctcgactcactgcaaccttcacctcccaggttcaaatgatcctcctgcctcagctgcccaagtagccgggactacaggcgcacactaccgcgcccagctaatttttgtatttttagtagagatagggtttcaccatgttggccaggctgctctcgaactcctgaccccaggtgatccaccagcctcagcctcccaaagtgctgggattataggtgtgagccaccatgcccggcccaatatttaatttttaaaagggtcattttttcttattacttctattcaatatttgaaaaattactagagttctgtttaaactggtcttacaaaaaaagtgacaaggctgattgtacattgcattgtaatcaaccctaataaaaccatcacaatgagctactacacatctattcaatgatactcataatttggatttcaaaatatgcgaagtcctagaaagctaagacaaagacagcacttaatacttcctcattctgaagaacagcatctccatcaaagtgatactgcctaatatgaaaaaaaaaccaataatcaaattaaaagaaaaggtctcccttaagtgaaatcctaaaagtataactgtaacaactatatgacaccatcttgaacacaggtggtctgtctttaatttcagaataaaattgggtcactaagaactacccacacattaacgggggattttatcctcatgccaaaacatttaaacaaaagcgagtgaaaaaggcccctctaaccaccccctaagattgaatggagacatttttcacatagtcagaaatgtaaacagtcaataccacacatacttttctatgacttaaagaataaaacattaaaatacaaggccgggcacggtggctcatgcctgtaatcccagcactttgggaagctgacacaggaggactgcttgaggtcaagagtttgagaccagcgtgggcaacatagcaagatgactctacaaaaaatgtaaaaattagctgagtgcggtggcacacacaggtcgtcctggctacttgggaggctgagatgggagaatcacttgagcccaggagctcaaggctgcagtgagctatgatcaagccactgcactccagcctgggtgacagagtgacactctatctctaaaaaagaataaaataaaatgtaaagatatttttaaatacagaagccccattcttttgagaatggtaaactatgtgataatggatgtaacattctcccagcctttgagtaaaagaagatactcttttccctgaagacacaagatctactattattcatgtattacatgttatatattatgtaatatataaattatatataatagaagtaagtcctaaggaatgaatgtataaaatacacataatatatgatctaatgagcatggaagctgagctgttcaaattacaacatacgaattgtaaaacttgaagaaacaggattttaacaatggcatatgttgaaagatgcctaaaaggcaaggatttcctgtgaggcagacacctgttgtgctgagccacagggaccagcattcttttaaccagatgttcactgttcaacagcagggtttcctttcggagaaaggtatgctctgaagtctgcagattttggtggggtagggatttccatgttatctaacataaccaccagagaaatcttataccgaggagtgtttacaactgaatatgatcctttgccttcatgacaaaggcacagaccacaacactggctgctacagcaataaagaaactaaatgctattacaagcaattcatagctgtcaaaatatacaggattacctttcaccaaagctgctctattctactgttaactgtaagattctctttaagcaacaaagaatgtattttcaacagacagtataaagaaatagtgaagactcagtgaatgatatagcaaaagaataaggcaaaaaattcaaaagccaacattttccaagaaaacttgagaaaatgactatgaaagcaacaaacatgaaagaacttgacaacagatccacaaggtcaaactaattttgatgtaatataacctcaatagatgaacaaattatttaacatattaaaatataatttcagttaattggacaactagatgatgttttaataaaaaagttgtatctttcagctgatattttgtaagaagcaaaaatctgtaatatgaacattcaattctggattcccaatatcatctggcttttcagaattctaataaagctatctatgtttaaactcatttttacattcacagattatacataggtcaatgagttttaacatcaaatggcaatgaaaccacagaagctagttaaatagcaatatgggtgtacggtgatcaaagaaaaagcaggagtactttacaaagcaggtggctgaatggcaaaaaaaaaaaaaaaaaaaagcagtatataaagggtactcaacatcagaagttatcggaaaatgttcacaacgtcaggctcactaaaaaaagttatgaggaaaagcaaattaaaaccacaatgagatatattcactaaaatggctaaaattaacatgactgacagtatggagtgttgtcaaggatgcggaggaacggaaatcttatacattgttcatgggaaaagaaaacaggacaggcactttagaaaattacttggcagtttctaagaaacatattaatagaacctgccctagactgacagtatggctcacaggtataatcccagcattctggaaggccgaggtgggagaatcacttgagcccaggagttcaagaccaacctgggtaacatagtgagagaccctgtctctcactaaaaaaaaaaaataaattagccagatgcagtggcacatgcctgtattcccagctactcgggaggctgagactggaggatggtttatgcccagaagctcaaggctgcagtgagctatgatcgcactactatactccagcctgggtgacagagtgagatcctgtctcaaaagaaaaaaagaaaaagaaagaaagaaagaaactgccctatactctaagagtttctaagaaacataagctactctatacttagcaatactgatcctaggaattttccccaagaggaatgaatgcataatgacttgtacaagagtgttcatagtagctttattcacaatagccccaaaaataaaaactgccccaagagcatatcaatagaaaactagacagacaaaatgtgacatattcatttaaagatatgtcattgagcagaatgagaaccacgtactgataaatgcagcaacacagatgaatttcaaaaacattatgtgaagtggaagaagccggagagaaaaaagagtacatattgtaccattccatttctatgaaattcaaaaacagatttatcaacggtgatcaatacacaacagtgacgtcctctgacgcaggatggactgactacaaaggagctcataagaccttacgtttatgaaaacagtcaaactgaacaaaatccaaaacgtttgaataactgacagggtaaccctaaattctaaaacgcaaaattttacattttcttaaagaagggaaaattatttgtaagttcatgtagcaactcaacgttgagaaataaatacctaaaataaaaccatgttcagatataggaatcatttataaatattaaaaataacactgaagtttagataaatattaaagaaatattaaacattccagttagaatcttaactttttcaggaaaaaaatatatatgtatatatgccatcttttcctcttaagattatatggtaatgtttcctgtaagttatcaaagaaatgtgaagttcagcaaagactcatagttgaataaagtacaatatgatgactttatcaaacataattaatgacctcaaaggaaaaattaactccatttcaagtgcccagacctgaaaaataccaaattctagagaaaagcttggaatggatcttagaatatctgtctgctttatctgcaaggcaactgtagtgaggcaagcgctcgttaggaagtgagacatgtcactgaaaattttcaaccttaattttgtccccaaatccctacaaaggcatctcgaaaacaaaatccagaattatcttcttgtgatcacatgaatttctcaaacataatagaaaaaacaaaacaaaaacagtcaagaaaaaaactaccattgatcactgcataatcaaggtaagttttttaaaccatgatggactacggtaacaataaattgcattttttagttcaagaaattattatgaacttacctgaacagcctccactattttctttaaaagttcaatatttcaagtaaattactgccacagccaagaatcccactgttacttatttaatgtatcaatcatgttcatatatcatgaaaagccactggaaacaaattgtcaaataatattcaatagtttattttacaccacacacgtaaaaccatttaaaaaatagcaccttactgttacttattttgaagataacatgtaaatcaaattaggaaaaatatttcttgcagaatccattacatattcatgtgcattaaataataccaaaatgttgtactgggggtaattactcaaatatcactgcagtgttatgtgctgatcatctgtttaaatgcagggggaaaacaggtgctaagccgaatcagtgatgaggtctgatgaccaacctcagtcaggatcctttcttctgctgccccatttggcatgaactcctcactggggaacactacttctgaattagaagtgtatccagtaactgtatttacatgaaaatacattaggatcattacatgttttaatggtttgctttaacatagaatgacaacacatcttctaaaaagagactaaagtctaaaaacagaagacaagtttaaaagatatctgtcacattttgtaaatgtacaaaacttcatttattggttgccacaaagtttgagaaatttagactatatagaccaggttaataggtaacagaaaaacaaagtataaggaaagccgtaacatgtagttgtaaatctaccatctcaaacttttcctgcctccacatcatttgtaaatgcagaagcttcccatcagcaaagctgcatggcactgcgccacatcagagcccagcccaacctttggcccttggtaaggcattaacagcatatccgtaagtgccatgtgaacctcagaattcccggcagtccctttgttagaacacatactatttcccactttcagtcataatcagggctcattaaaagcactcccaataattttgcagtgattatttcaggaaaaactatgtggtataaagaaatcctattttgattcggctaataacttgtttatcttagacaaatggcctgttcactaattcaacaaaagcacaggaagcacctctatgagggtattcacaacttaagaaggtctcccttaacatctcagaaggtctgaagattgtgtattaggtaagaataattcagtctgacagaaagagcactgaaattcaactccagatgttcatatgctagtgcacaatcaccactagtgcagcagcaagagtagagcaagcaggcaatgagcagattctccaatcaagaggagactggaataagagggtgaaataaatatggaattttgaccattctagtttccttttgtgatcatctatttatatacccaaatccctaacaaaaaaaacttacaatgacctcaaggttaaaaatcagacttgagtttctcatttcccaaagtttcctttactacagctgtgggttccacagacaacctccctttacatgtcttcagaggcattgtatccagagcttttgtcattaatatacatagacatgctttatttttggccattactgctatatgcatcttattgtctctcctcttacatatttatctgccaacagtgatctttgcagaccaagccaccatcacctctctcaactctcctgactgatctaagtgctttgattctcgctctcctccactcaattctctattaagtagctaacgtaattcctttctaaaaaataagctacatcctatcatgacctaggcaaagtctctccgctgaattcccattttattcagggaaaaaaaattcccaactactgaccacggcattgctccacatcttgcattctcaacagagcaatctccgtcccaagggggagaaaattacctgggggagggagaggacaaaaatcgtactctttctatgtatgcagcacagatttaacagatagacttacaaccatccacagttatccaggttgtcaacatttcagtagcagggggtcaattaggaaaagaaggtctaaaaggccttctgtggaggaagtgatcacaaaaaaaaattgagaaatgcggatgtattaagaatatatacatctatgaatacagaaacttctggaaggatacaccagaaattagtaacagcggctgcccctggatagagaagttggatggctgttagatgatactgagaaatttactatcactctgcatcactttgtatcttgatttctgtgtaccaggtacacattattgttcataaaattcaaaaatatagtttatgtataaatagtatttgaaggctgttgatttttattaggtattctttctaaagtgcaacagtgtaataaagattatttctagatctcaaggaggatctgaatgatggctataatgaagggcctatttaggtaacttttaagtttgaggaataagagaatggggttagtccacttagggtttccgtatttcctcatgttggccactgaccaagtatgaatatagccatctttaggggtgggcgcggtggctcatgcctgtaatccctgcactttgggaggccaaggtgggcggatcatctgaggtcgggagttcgagaccagcctggctaacatggtgaaaccccatctctactaaaaataaaaataaaaaattagctgggcatagtggtgcatgcctgtaatccagctactcaggaaactgagacaggagaatcacttgaatccgggaggcggaggttgtggtgagctgaaatcgcgccactgcactccagcctgggcaacagagtaagactccatctcaaaaaattaaaattaatattaaaaaataaagccatctttagtatatgttcatttctttgggatgtgcatttctgtaactcatcaatgcaactgcagtgttctatggagcttcaatggtttccacgtattccagtacaagactcaaactcaccaagccctgcaggggacacccaaatcactctgtggatgtacagagggtatctcagccccctaacctatatacatttgacactggcaaacttttgtgtctcatattttcatttgtcaattgttgcttactctactgacaattctctagccaagatcttttccccgagcatcaggatttcctgtgctgaacccactttctagatggcacagggccccaacccttccatctgccctttctcctctttttagcagcaccaaaatacctatcatttggttttttaaaacctgtcacccttgccttctttcttccacataaatcccagtcgtgaccatatcataatcactccacgtcttgatttctgcccttcttctccatcccactatcccacatatcaagtgctctcacttcctgcagttaaggccattcaaatgcatcccactgccaatccctaggtatatagtgactgcaatctgactactgtcattctcttgccaaaaatctcctaacgatttttggagattttttcaatgggtctttatcacagaataagattttagatttgttttccagtcttgttttgggttcctaccagctttctacacagtatcaactgtcagcctttgctcacggtgggcccactctgatcgtatctactccccgaaacagatatagctcatttgaagttgatacctaggtatttctacctccccaaatctctggacacactcactaagatagatactacttccccttttgttctgaatggtcgtctaatgctcccacctccaaacaagagcattctatgaaaatccttcccaactattgtatcttatatgcatttctctttgccgaactccctgtaacacacttatgttgggcaacaggtttcatgtgtaatccgtcaaggtaccaaagtatacctagcactactactgaactgtacacatagcaggtgattcttacagataatactagataacctcctgtcacacgatgctcccaaaactgataacaagatgtatgctttattgagaacaagattccaacacttattttgtattgtgtattcttgaatttttccttccgtctgcctctcaattcatgcatatgtaagtaaagtccaagttgactgctgaaaggtgctcctaccattattgatgtttgtcatcctttctttctcccttaagatcttttctgcattgtttcataattaatgtgctgtcttctaacatgtatcagttgtctggagttgctggaagacaggagcacctcatatctaccccacgctggctgcgtttatcttcgatggagcaaatccttgctggacggagcttatattccatgccacccagacctactgtagaatcaattattcctaatctatgactcgagcgtctactaactcagctcaagcaatctaggcccttcacaaatataacaatgacataatctcttgcaattaatttatggaccctatagattgtttagaaaccattcattttgttgaccaaatacagtgttcgcttattagtttatatggcatcaaagacacattcacattaaattagcattttaatacataagttacttttaatggtgtgataaactcttaaaaaaaaaaaaaaaggaaactcattgtagtattcctacactagcacccaggctattttatgtgtcagtgtgtgcactagccaaaggaaaataactattaaaggacaaacagaaaacttatagtcaactgtcgacatgagctgtcaggtgttcaattaatgataatccagccaagagcacatccaacccagagaagcactgaggtctgaagggtacagttctgctccggctgctctagacagcagccagttcagactagagcaggaaaaggcaggcctccagagggaagcctagagtgaagacaaaagcaaaataaaaacaggatgataacgaggatgcaaaattaaggaaatggcaaagacactgaacactgggaaaacacacatgaaaattttatgtaaccaaatacatatttcatactatagattagctatatagaaaaaaatgagttttggcaaactagagttgattccatttatttatgctccaaaagtacttaagactatatatactactataatgtgattattaaccaaaattatatcataatgtcaacttgaacattttaaaaaccctttgcatacgctgaattatacatttaatcccaagttttcatcatctcttgtcaagaagagaagaaaaaaacaatgcttcttgcagaggtcaggtccccagacttggtggcattcccattcttcctaacttgtacttactataaaacagagagcccaggatgctgaaaagaatataactgacatatttcacaaacggagactaaaaccaaaatgcaggaactgagtaatgtctaccatataactaagaaaaatgttaatctggtctattcttagaaaacatttgaaatcaccatttgtaaaagcaatccaaaaaagcaatgtcgattttacaggtaatgttttaaattcctataacccatccaactgaacagtaatatatatgaggtcaaggaccatgataaaagaagcaagcaactgaaaaaaaggatagggcagagggaaactggtaactcttaagaactcctcagagtatctgagtaactatccactcataaacagggactcttaacatgaaagaccaagtctcaaactattaattacatgctttttctcctcccagtatttgtaaaagagtttttcaatctatgtcagtacaatatatccaatgtatcaaaacctgagaggattaggtagtccccttcatcacatataatttttactgaattatttctcctgcaaatcttagccacactgtcatcttaaagttcaattactggaagaattaactggaccatcaatgtctgaagaagtatatatagtgatcacctatagaaactatatatggataatcacatcaacaatgagttctagttgctacattttgctagaagacccttctgagcatttcctgacgagttgctcctagcagtgaacctctcccatttgtgttggttctggttttctcttcaatgtataacaaaggaagaaaaggtgtgagagaaaaacaaatacagaaacttataaaaccagtagccttcatttaaaactcaattagaaaaagcctactttcctggagaaacctcaggtaggcgttttaaacttacttccacgtcctctggtcttcttactgcttggggttccaccaagaccaaacgccattgtatttggtatagccaatcaatacaaagaacatacaccgtgattttagttctaaattttatattgatcgttgaaccaagtcttctcccattccgccaacctcattccactctctggtcccacacagcaggatatcttaactcctatctatccattccaactttcttctctttcctctttagacagggtacatattctaccaacgtctattaagagctggactatttactcgtcctccctgctggctattcttactctgaccctttagtgtaatggagttgtctaagaatttctttatgcactttcttttcccaatttttcttttgccacttactagacttcaaactcaaagaaggtagggacagtgtctattttcttcactattatatgcacagactgagacaaaaatgttcaataaaaatttattgaatgaataaacaatctgcaatactcatccaaacactttaattggtactaaaaactctactcctaaatccataccatgactccatttttcctcctgaaaattttctcagatcagttcaataccaaatgtcaaacactgtgtgaacattgataaagatggggaaaaaaagtaggcattgctgggcacagtggctcacacgtgtgatcccagcactttgggaggccaaggcgggaggatcatttgagacaaggagtttgagaccagcctgggagcctgggcaacacagtgagaccctgtttctataactttttttttaaaaagtagctaggcatggtggcatgcacctgtggtccctactactgaggtgggatgatcacttgggcctaggagtttgaggctgcggtgagctatgatacaccactgcactccagcctgagtgacagagtgagaccttgtctcgaaaaaagacaaagtaggcacaacgagcaaataaatatactgataaaattgacatgaatgaaaagacttgatgggaaactgttctgaaaaaggcacttataagagatttacaaaggccgggcgtggtgagtcattgcctgtaatcctagcactttgggaggccgaggtaggcggatcacttgaggtcaggagttcaagaccagcctggccaacatggtgaaacctcatccctacaaaaacacaaatatcagccggggatggtggcaggtgcctgtagttccagcttctcagaaggctgaggcaggacaatcacttgaacctgggaggtggatgttgcagtgagcagagattgcaccactgtaccctagactgagtgacagagcgagaccccatctcaaaaaagagagacctacaaaaatatctgggagacggaggaaccaccttagagtttagtgagcaagcggggagggatggaggtagatgaggttggaaaggcggaccaaatcagataaagtcctgtggtctaccatgtagttgtgatttaattcagatgggaaactactgtttgaaaagaaaaggaagcagaatctgagtcatgttttgtgtatttatttatttttgagacaaagtctcactctattgcccaggctggagtgcagtggtgtgatctcagctcgctgcaacctccgcctcccaggttcaagcgattctcctgcctcagcctcccgagtagctggaaccacaggtttgcgtcaccatgcccggctactcttttagtagagatggggttttgccatcttgcccaggctagtctcaacttgtgagctcaagtgatccacccaccttgacctcccaaagtgctcagattacagcatgtcactgcgcccacccggccaagtcttgttttagaatgatgcattttgtggagaataagttgcaagagcaaaagtaaaaacaggacgagttaggaatgtatcatagtcatctttggtgacagatggtaggtcctgtgagataatatatttaccaggcggattttccaaagttttaaaaatcccaaccaaccacctaaaagcactcaaaaccaaaacattcaaaaatcaaatggattatgccctcctctccctctagcagctacatcaatcacctcaccatcgaccctgaacacacttacctttggcgtctctgttcatagtatcctcaacccatcattcaaaccagaaacccctaggacactttgcatctccctcctccgccctcccaatacattagaaacagctgaattcactatacctctgaattactcttatctggaatctgaacaatcctgacactaaagatcctttcaaattcaatgtagggaggctggggctggatccctgatctatgtggtctctctgctccagaacattgtttccagtccagtcactcttacatttaacataattattttaagttgtaataatggggcttatccttactcgcagtcacctaaaaggtaaataaaggtctaaactccttaacagtgatcaattataatcttatctcaactttacttctcttctctgctaccaaccagtcttagcgtcctccccttagacggcttagtgcctcaccaggcctgtgaccacatcatgttgccaccccacaatgctccttaccctctcgtgcaaaaagcctacaactatcaagtatctactcaccttcaggacctgctcaaacgctatcatcttagtgaaatcttcccagtctccgcaaagtaaatgaactatttgcgtctgggttttcaaagaactttctatgccctttattacaacaacttggtcagtttccttacaactctacatatacccattaaactacaaaaggaccatattttgttcattttggtatcctcatttgtaaacactgtgtctgttctacagttggtgtcattcattcaccaagcaaatatctaacaaggacttgctaggaaattaagatgaattactaaatgacggatattctagaaggaataaaataaataaataaataaacaagataacctcacacaaatgttttaagagaaatcttgtatgtacgaccaaaccttttcaggacttaaaacatatgcttaaaaatgttatggatagtatcaaggtgatagcaaacacaaaaggaaagtaacaaagtgaaaggggtgtaaaacttgatgtgtacgatttctttcctgagaacttcgtgctccaactccttccctgcaggacagcaaacaccaagtaattaagctcaggaaattaatctcacactgacacttaactatgaatatatacttaaacttggccaggcgcggtggctcacgcctgtaatccaagcactttgggaggccgagatgggcggatcacgaggtcaggagatcgagaccatgctggctaacacggtgaaaccccatctctactaaaaatacaaaaaattagccgggtgtggtggcgggcgcctgtagtcccagctacttgggaggctgaggcaggagaatggcgtgaacccgggaggcggagcctgcagtgagccgagatcgcaccactgcactccagcctgggtgacagagcgagactccatctcaaaaaaaaaaaaaaaaaaaaaaaaaaaaccatatatatatatatacatacacacatacacacacacacacactaaaactttaaatttcaaccttattcattttaaaaggaacaataaattacataattatagcctatgtaatgggattcagagattacaatcattgaaaggaaaaaattaaaatgtgactaaattattcttctaagatcagggccaagaaaaatatttcaaaccacatgtgaaatattaaacttcctagaagccacattaaaggagggaaaaaagcaacaggtgaaattagcttaattatatatattttattgaacccaatgtagtcaaaatattatcacttcggcatatgccacatttaaaagttgagaaattttacattcttttcttcgtaagtctgcaaatctaattcagatgcaaaattttcctcaaaaatacttaactgtatttagattacataaaatcaaagatacaaaagtagattaatataatcaagtcgttccaagtatgcttaatattctatcaataactgaatttaagtcaattacaataaaaactttagttcctcatctcactagtcccattccaaggactcaacagccaaatgccactactactaggatggttcagcttcaggcagaactgtggccgcttacttcagcacaactcaattcaatgagcacaaactaaataaaaatcattttctttcccctttgtctcctaagatagctattttctaggccccttaactaaaagagtagctgtcattttctctactgcctttatcgctacatggtaagatattatttgtcactctattacacaaatgctatcagggcaaaggatgggtccactgtgttcacacttcaaactgcaagaaactacagtctacatagcaaactgtaggaagtcagtatgtaactaagagggtttcaagcactgctaaattatttaacatgtgtatctatgctgtgtttatgacctacagaaaagaaatagaaactggctgtgataggttagtcttctatatcattcaagtaattccaaaataattcaaactatgagatctatattttcagccaacctagggaatatttcatccattcatatgtcaaaaagttcatgacatgaacccctagactttagttgactttaaggcctgtagcacaaacagcagaacataagttaagtacattctattgcaaagcagaatctaagaatgtaaacacacttttctacattgtacttcccagccctaaaacttggagcatgttattttccacaaactgcccatcttccactaattttttaaaaaaatttaatggcttcagataaagggcaatgtagcacaatacacagccaagaaacaaaagaagtagtcttatttttcccaattaatcatcatgcataaatctacatattagcaacagatcaaatataaagttctatggctgcccagtaaggtaatgctagagccgttaaatatgcatgctggtgggggagggaaccacattccaatcagaagacttcagtaatgtataagatgacacaaagtaaaaactcaaggcaggtccctttttaaatttttatcatttttttttctgtattcatgtaccaagaataaaagttaaacactgatttttgtagagatgtaactcattttggtgtcacaggagttaaaaataatcatttcttgactgaagacaattagtaatacataacaggaaaaactgtgaaaaagtctggtatcaacatattttttttagaagagataaaaaaaaaaagtcttactctcattaggctgcctgagaattcctcagttggaaaataggttaataagccaccatggggtagaagcagcctaatgtcgtagacctgggcctccacgaagcgaggaatctgactctgaacagaagaaatgggggaggggtgtggttggtgcaatgttaaaagataacactgattgcaccttctccaaaccaaacccatttatgttcacaaaaatctcaaaatggctgattcatgtggaaaactgagaagataccaaattctattttagggtagtttttgggaagcagagtcagagagtccccaggtgatatccggattacaattaagaaacaaatctctatacttatttcctacatatagatattcttaacatacacacatcaaagtcaatgttatagaatctactttctgggatattaaaggactgaaatcaggtgactgtttctttgcactggtacagtcacaattttttggaacaaacaactgtcaatacagcaaatagatgctctcattatgaaccaatttaattttttattgtgctgcataattttgagtaggcctttatcacacacacacgcacacacacacacacatacgcacacacacacacatatctgacgctacaaagaaaatattttaatatatatacttatggtcttgggaaatacacttatcaaatcttttatcttcaagctagaaaagcaaaacaagcttacaccaaagagaaagtcaggccatcattttaatccaccaaactatcattctattcatattcaccatgagggtaagtaaagacaggacagttttctagcaccttcatccagcagccagaagcatgtccaaacataccgatacaaaaacagttacattatttcatctcatactggtatgctgagaatctgctaagaggaaacttgtttcacaaaatcttcaaagtacacttctccacataccctcttcatttgaattaactaggttttaaaatcctagttcaaaaatgtatgataaatgaatttatgcattaaataacactcaatagctaatatgtttcctagtcagaaataatggacttttgcagtgcttatcaactggcaatagctgtaaatgtctgagggtgttttgattgtcagggatcttatccaatctacagtgtactgggacagtcaactacagcaacaacaaaaatcacaatcagaatagcctcttttgaggcacaatatctgaaaacagatgctcaaaggggttcttaccaacagtagcagcgtcatcacataggaacttactagaaatgaacgttctttggctccacctgaggcctacagaccactctggaataaagtccagagatctgtgttttaatgagcctcccaggtgattctaatgcatgctcaagtgtgagaaccactaacttcagaaggatgtctgtggctgctgtcccttaatttagaggacaagtttttttccactgttgtatcttaagccctagaaaactaaccaatacacagtaggtccccttgatacatgctgttacaatgaattaatggatatagtgaaattctgaatgacatggcacctcataaaatcttatatgactaagaaaagtttttgtagacaattactcccattaccattttcagttatctgaacttctcactccaaagttatcctaatgtgtaaagcattcaagtctgggaacatattttctaatcaactcaaagaattaacatacagtgattaacaactaagcaacttactattattgcctctaacaccaaaaaggtcagaaattactaaaagtcatacagaatgactatgtagaatttagtttactttttctcaatacataaaaacaccaggcaacatatttaaatctaaagaatgtctgaaacttaatactgatttacattatctaataatgtaaaaatatcctgaggaaaagttaaccacgaaaggtacactaagatgttttctcaattttcacgtaataaataatacaaataacttgcaaaaagtaaattatttaaataaccataaagataataatgtaaataacttgtattccaaacatggcaaagtgaacaggcacaggattatatatttacataattcttctaaacagtcacagaagcctggttgattgacaaacatataatgcccttttgcataaaagcagctagaacaggaaagaatgtatcagagatccagtcagagagaaaacataaaacatactgaatgaatgtggctacttaagttatgacactagcttatatacggtaattccttacatgagatgtacaatatataaataaaaatgtgaagctgtcttggtgtaataaagagctagaaaaaattttagataaaaatttagacaatgaaataaaaataaaaattaagataaaatttagattaaggtatctatttcaaagtcttcaacaccatcaacaaaacacttaaacaaagcatttaaaaaatataaggtccacttatattactatcaacacaatgtaggacctcgtatttaatgaataatttgtcttattgactaaatttatattaaaatatgaagaaaatctaaaatgaaatgtgttcaaactaagtacatttccacttgaacctacttaattctaattctattcttaattttgagactgaactacctcatgtgaaatttgagtgatttatattccacaagacagaactgaaattttatttatgtgtacaagcagaataccatctcttttaaagttcatctgattaaatgagaaaggcacatttaaaaagaacaattctgacaaacttcttttaaaaatacaggatctttcgcagaggagggaactgatagtgacaatggtaactgaagccataaaattttcttgaaaaagattttgtttaatgtgtatgtataaactctggctatataacattaagaatttcagtatcttcaatctggaaataacagacttctgttattcaaaaggaaaaaatgtcataaaatagaaaaaacacatacactgttaatttcatcaggtaaaaaaaagtgtaatcaaatagtaagtttcaacaaagaggaacccttagaggtatttatattctaaacggttttacagaaaaaaaggtcaaataaaatcagaaaacaagttttgtggtaagcctttaaacactgtcttacaagcttcaaatttcaatcattaatattgttattccataatcaaggaaacaaaaacaaattcaaaatattctcacaacacatagaagacactacttttgatatttatttttaaaatttttttattttttgtagagacgaggtctcactacaactgcccaggctcatctcagcttttggtatttaaaaaactccagattttaaacattagacactataaatttttttctgcatttttttttcattatttccccagagtaacagtccataaattaactgatggatactcacttaggaaatggcagacatacttcattttacaccaccagaaaaacatgtaaagtgaacagagaaaaatgattttaatttttaaacttcagtaatgaaagctgctggaaacaaaatgatcttgtaaagtataagactactcccaattcattgaattatatgatttgcttagaatgaaatgtttccatgctgggctacataagaggtggactcttcgatttcaagaaatgaatcttcatcagtatgaaattaacctaaaaatgttgtttttggaggcatgtgttgaaatatttaagggacaagtaacatcaagcctgctacttactttaaagtagtttgccatccccccaaaaagtccatgcctaaaaacatctatgaacacaggaaaacatgaataactgttgaattagaagatatgtatatggatatttactgccttattcttgaaaataagaagtctgactttttatatcactgctatcctctgacacctcagaaatatattttaacacattagatgttgtaacaaaactctgaacacctacagaaaacacttaaataataccttactccccaggaacttccttcattttttcaaaatgatgtggcccatttatttttcactaataccatctgacactaaatctcaaccctttttaaagcttttaccataatatgatcacatcctttcacaaaacttacttgatttcaatcatatatgtcctttttctcattcagaatctatgttgtaatgatcaacctaatccccatttactaattaatgactactaatcattcacattgctatttagcaattattagagactctacatataagtagcaagttactgaaatattcaacaagtatgtttctcaacaaactgtaaaggtattatttcaaatagtgtttgaaaaacaagagccaaagtttcagtcactgtccttgtttacaattcctatttttattaaatggcaattccagctaaaacagatattgttcccctaatattattgatatttcagggttaaaaatattcaatctctttcactaagtgctcagcactgatttcacacagaaaaataaaaaaaacctcaagaaagaatagcaaattgaattttgcaaaaacacaagtgaatcagttttttaaaatctgcatctgtcaagaaaaaaaatatgcatttatttacaaaatatacaaaaatgggggaaattccaacaacatagagtactagaataaaactattaggaaaacaggtgttcctttattttatacacactaattacaagtagcacatgaaacattaagtcctgaagactttaaactcagtacttcaaatcatcacacaaactatcataatattgttatatattaaaattgtttcatattactttttataaaaaaaagatagcatatatgacaacttcacacttacttagaaagctaacactactgaatttcctctttatttttgtatctaccacttttaagcagatgatattcaaaaatcttccttggtatactaatccacaagaaaaaaaaattgactgaaccagccacaaagtttaactatacaaaaacactaaaaacacggaataactgggagttcagagatgctccacttgactgtcactcagaagctgactgctcccagcgtaaacttggtaaagccggaacaaggattttcttgatgctgggaaaaagttgtgtagaactctgttcttggtgccagagttgagcctggacactaggatgttcaggagattaagacatctttttgtgcactggccttcgagtgttcttgaatgaatcatacagaatttcacagccttggccaaaggtaccttggtttaacatcaaaggatcaagtttctcccaatcatatttcagctttgaagtgaaatacaatgctaaaaattacctgagaattatatgaataaaatatagatgacgggaaaggtagatttaagtgcaatagatatcactgaaaaactgtaatcaatgttaaaactccccataccccaattaatgtcacaaattaaagcaaatcccactctccatcacctcatacttatgagaaacatgagaatagtctttgactattattttacaatctccaaatcatgttttcaaagaactgtcaaaaacaaaagcctatgaataccacaaattttggaaaatagttccatccacactgtgtatcaaaaaaatagcagaacatgaaagagtacgtatgaaaattttaattagtataaaagaatgcatcaattatgctttacaaccaactgcttttatgcaaaatttaaattgtttctttccaaactacaccttccagcaaaacagacaccactatttacatagtgtttattttaaaatagcatattatctttcagaaaggtgctgaaagcatgatatagcaaaccataatgatgttttatgagaaacagctatgctatgatcagtgtctgatgaattacatttgtggtatgagtcatatatgattccttaaatgtaattttaaataaacatgaccaacatacacatttttaaagagttatgactttgttttgcaataaacattataatgtgataaaatcagtttctccctagtattgaaaatcaaaataggtatttgatagtgaaaggagctaatcagattccaatgactctagccattctcaagtaattatctgctttttaaaatcacctcttgaactgtactccttggatgtctctcagcattatcttgaaaaacacaaacaaacaattaaaaagaaaaccactgccattccttggagacaaatggtcctaacccatcagacacgttttactggagaaatgtccaaattttagggaaatatttacaacactgcagagtcaagccatcttttaatacttctagaaacctacattctcaagaaatgcctaattcaccacaaatcacacagcaaatcctcacttcacagccaacccaacagtattgttttattttaaagaatgtttaacactaactgtacgataataatcgggtaaggtctagatattaaaaccaaataaataatggcagatatgtttaaaactagacattattttttataagcaaaagagatttgccttcaaacagtttttttcaagatgaaaaagatttatttggaaaaatcagcacaggacaaagatatccttaataatctgtctcagaatacctgaatattcagaagctatatgaaatgtagctggaaattccgatttcacagaacatcagtggtttatacaaattaaactcccataccctcccacccccacatatactactctatctaccccttattgacattagctttcattaattaagcttctatctttagtgctacttgcgcaaattaaaaagcaaaatcattttcatttttaatgataggattagttaaagcaaccaaagcattactgttacagcaaagtttagtaagaccgtaagagaataccactaataacagttttaaattatccaaaatgatttctttattgagattaactacatagatttcacagtactatggaatacttatatttagctaaagtcacaaacacatttcaacattcaaaatgatgagcatcattaccattctaatctacaaagctcatgaataaagaaaaatacaaaaacctcaagttttacaaaaaaaaaaaaacttttaagtctacatacattaacaataaaaccatttcttccagataacaggtaaaagtataaaggcataccactgacttttttttttctagatagccaggaatgaacgaatgtttaatatctacgacgcttattagggccttcaaagttgcccccttgacttcctctaccaaagccaccaggaccaccactcacaggacctacaccactcattggtgcttgaggggtttcagaacctgttctactccccataggtgaacccatctgagatggtggtccttgaggaaatctgtcattgtgctatgataccacacaataaggaatagaatatgaagtccatttggaacacgccaaatataagtgacaagaaaaattggcaaaatcccaagtggtggtgtcatgaagttcggcagaaagtccagcagaatcaggatcacacatagaaggaagaaaggagcaatttaattagttactatgttttttttaaaaaaatgcagcatctgaagatttacatattgctaatgctatgccccaatttaaagaacaaagaactgatttcgtgacagaagcaaatgtaatcttaagcctaaacaatattataataaatctctgattccttttttcaaaagtttatattgcatgaaactacgctatgtaagaaaaatacgttcttaaaaaaatcagagaaataaaactggggagcagcatcaattcggttttttaaaagtaaacattctaaaaaaaaatcttcacatcaattccttgaagatagaaagcactaatacaaacatacacaaagaattatgatttcagtatggaaacttctgagagtgttttccttgaaagattatcatgggaaaatagttttaaaaattaatgtaataacatgcactaataagcacatttaaacatctgaattaagtattttgaaaaacttcacaataatcatacatattaatctgaaaggttggatagaactccctgaagtgtagcagtaaaatgtcagtgcaaaacagaccaagggtgatatttaaataaagtttacaatttcagggagacaataaaaaaatgggacagttaatgttacttctatgtttctattgatgattatatgccacacaaaaacttaaccaaagtagtataagtttttactagctttcaaacatatcactataaaataaagcctctactgaaggaaataaatgcaatcactgtgttaagcgccatctgttcatagtagccgtgcactgcctcatctccctgtataaactatcattttaaaaaatccaactgccagcatgtccaatttctccaaattcttgaagcaaataaaataatgataaatgctgcattcaactctaagacatacaatgcattgcttttaacgtctctgatcacggtggatttacaactgatgacaggtctgagtctaacaggcagtgctttctttctttcttagcagcattggcgcctcaagatttcatacagtagtttcaaaactaaactgccttttcaaaatagataaccaaacaatttccctttcaaaatgttatttacaacaagcattaacaaacactaaatgagaaaacggtttgcctaaagtccgatttatatagtgacagactttaatagaaatgataaaaggtatcattcttgctactaatatatttaaatataataaaaattacaactgaaaaaccttgttttcatagtatttaatccacacaaagatatcttcacactctcagatcaagacaaaaaactgtctactttaaatttactaaatataatttaaaattctgtgaaaagaatgccacaatggtggtttggaaatacacaaaaactttaatgttaatttacagccaaattctttgcaataaatcatgacaggtaatatttttatcaaaaatatttactgaaaactgtgtgttcatacatattggacttttgtccccatcaaatataaggagtccacacaggaaaagaacactatcataaaatgcttgaacgttagaatgctggtaaaagatggaaacaaattaaaaagcacagaaaaatatctgtaattaacatatgcatttgctatatactgaggtaccacagcatgccacagacagtaatcctaattcttggactacttaaaaactatctcagctggacgcggtggctcacgcctgtaatcccagcactttgggaggccgaggcgggcggatcacgaggtcaggagtttgagaccagcctggccaacatagtgaaaccctgtctctactaaaaatacaaaaattagcctggcgtggtggcgcacgcctgtagccccaactactcgggaggctgaggcaggagaattgcttgaacctagaaggtggaggttgcagcaagccaagatcgtgccatgcacaccagcctcggcaatagtgcgagactctctgtctcaaaaaaaaaaaaaactatctgtaacacatcaacatatgatgtcacaaaattttcttcttcattggctgccaaaacaaatgataccaaattatattaagtgtgaagttatccttgatgcagaagtgtacattactgaatataatcaaaataatgtttatgatacattaccactgctccattatctggcatcattggagttcccatatttgcggctccttctggtcccatggcaggaccaggacccattggtgggccaggtatagttgctctgttgttcatattcatacccatcattggaggaggaccttggttaccagcaggggctgggctaaacgcatctatgtaaaacaatctatacttagagctgtcctatcttagtttagtaaacattaacaatttaacaatatttatgcaatctatataccaagaccattatcaaaattattttcgctccttaagaatgcgatatgcgttatctactctgtaatagggtattacctacactctagaattagaattttcatccccaagccaaacgtacataaaatcaaggaggaaactatcaatcattttagggcatttgagactaacagtttgcaagctttgagacatcactattattttgtaatagcaggcttttaaaccaaagaatccctaacaatggggactacattttaccagtttaaatgagtaacaaaggattagcacttacaaaaccacttaatttttttcaacccatggctaaaaatattagcagtaaattatgctaagttgtgagagaggaaatcatttcctgcaatatataaataaagatcattataactagcctctcatcttagttttttttttttcctccctgagtttatggaataccttgctaaattacataaggtactctttttttaactttttattttgaaatatggactctaaaccaaaaaattgaaatgacttataagaaaacttatttttaaaagcaaccgcaaccaaatacagataaaatattaatatagctatctggatctttctgacaagcttaaattccataaatggggacaacctgataatatttcaagttttttcattaaaaaaatccacctacctcattaacattaatagtgtttgcactgtaatactacatatatgatgatctcagatacaacacatttttaggcattttctttgaaaaattttttcccttttaagtgttagtacttatcattaaaaattcataacaaagccattctaatttagagttttcttctagtatttcattacataggtcaattttctgataataagaactcaatttctcaaatatacattataatgcagctgaaatctctatatggctgagtccttaccagcccctggcatcatacttctgctctttgaatccaatccccagaaacctagcaaattcataggaaggaattatttccttcatccccaaatgctcttgccgataaacagactttaaccaagaatatttccgctccctcagtatagccctaaatagctatttttaataatttctacaatctagacatgaagagaatataagaacagtatctaagaggcgtcttacctcaacaatcccccagaaaacaaactaagtttctttttcctctctttctctttaatggaatgtaattttacaatggtgggttcggaagttttctttttcctctctttctctttaatagaatgtaatttaacaatggtgggttcagaatataactatacaactatgggtataaaaaatcaaaaataatatttccaactaacagcagttaacttagagccttacttttagtattcacatcttccaccacatagctataaataaatttaaagatataaaaaatgttagcattatctgattactagaaaggtagcattataatgtaggtttcgtttggttatacacactagtgatacaccagaaaatctgctgccactttccatcaatgtaacttgatgagttatgacagttttaacttctcaacaacccaactggatgataatgattaatagctctacaaaaccattatgatgaagtctcacattgaatgaagactgaagagaaaattagataaactgggctttaggagagttaagtgctaaaatgtaagtaagtcctctggtgaataaaatgtcacaaaaattttaagttatcttcaattcctaactaaataaggactctaaaggcatattctgatatttcttctgataaaattgcagagtatctctgcaccatcagaaatggttttaagttttatactattttaaagtttagctctgatgttaatgtcattctaataatgataacagccttttaaactgcctataatctacaataaccttattcctaaaatccttaaaattacatggattatattaaatagcaccccagcatttactcttaaaaaaagacataaatattggaccacttggacatcattatactcaattatgcttcataatttagaacactcttggttcattaattatttcacgtatccactgcagtaatttcacaattaagttctttatgggcgagggccatgtttcttgcttcctgcatatatcagagatattcactaactacttgttggtaaaaagtgaccaagtaaaacagcaatatatgactctacattatctgattagtagtattgaaaaactggcaacagaagtttaagaaaaaaaagctgatcatggaaaatgttcattccacacatgacttaagtttcatttgatagactatatatgctgagaacacacttgattttgtaaatgggtgtgcatgttaagtacattgtttgccatggtagtgtaatctttgaaactatgtacttttaagttatataaagatttttagcttcataacaccttttgtgggacaatttaatgtgggacagcttttgtgggacaattaatttaataaaatttaattccttatccaacttttaaatgtatgacatttcaaatttcaaatttagtaaggcctacgatatgccacacttgcttttccttcaggttatttacttggcattatttcccttgcaacttggctatacgagcaaatccatactaaagttgctaatatgctttcttaaaagcttagtcaactctaaaacatgcattggcgacacacataattcccttgatgagttatagactacaaacactgagtgcacttctgtgcacaacactgtaggttaaaggaaaaaagttcaatattcattaaagtgaaggaaaacagcttcaaagttacacaaaaagctagtttaagatagaaatgtataaaacgctctccacctaaaaacacaactcagaaactatcaatttccaactcggaaactatcaatttccagtgttcaattaggacaggcgaggtggctcatgcctggaatatcagcactttgggaagctgatgggggtaaactgcttgagcccaggagttcgagaccatcctgggcaacaaagcgaaatcctgtctctactaaaaatacaaaaaataagccaggcgtggtggcacatgcctgtagtcccagctacttggtaagatggaaggaccacttgagcccaggaagtcgaggtttcagcaagccaagtttgtgccactgtactccagcctgggcaacagagtgaggtcctgcctcaaaaaaaaaaaaaaaaaaaaagccaaatagaaggcataaaatttgattttaaaactgcaaagacagagctgtattacacaatgcaatgactaaactaccttcaggctgtattgcaacctggtttatatgtttctttcattaagcctatgaatgtataacacatcttttagccttcaaacaaaaacaaaatgagaattttcttcccagacatatatttttaatataattgtattgtattccagtttaatggatgtaagagatttcacctttagaaatgttggttctgtattttagtttcttactgatatgtagataccacaaacagcataaacagtccccccaaaaatgataaattacaaaagccttttgcttcaaatccctacctcccatgtttattgctccacggggacccatatcacccattctcatttcctgttctctctgtaagtaaacatagttgtcacagtcaacctatcgatcttatgactttacatttcccatctaaaatcaaaaagaaaagagtgaattgggacatcatttttcattaaaaattttgaaaagtttccatcatcataaacttaataagaatgctgaaaagaaacttcagtctcccaggcttaatatactacaaatgcttaatgcatccagtttatattgcaagattagattactaatgaatcagattatataaaatatatcacaaattatttttaatgtttttattccaacagatgaaagacacatgcctagattccaagcaaaggaaaatctagtaatgataaccaccagagccaattattttctcctcccaggtcactgaagtcttaaaatagaaatgactgttaccaagttcatgttgaaatgtatttgaacatataacacaaatagctttagggaattatgctaaaaataaggttacaatcttcattgtctaaatattataattcattcatgtatttgtattcatctactcaagcattattccatccagggactatagatagcccacacaagcaattactgaaagctcgacataacattgctttcctttaactgcgcagtaattttatttgaaaacctgaatgaaagtattacacagttaactataaaacagaaatattcagaacatttgaaatttcattacagaaactgcttcctaaaagctgttcatttaccaacaatagtgacatagaattaacttcaatgaaatctctaagtgaaatttctcaagataacataggaaaattgcaattttcactttgacttgatgaccatttccaatcacagaaaactgttaaatgtagcaatcatgaaaaacattccattatgagacaaatgcagcaatgtttaaagaaagcataattactgtacttttgaaaagcaatcttattaaaatctaaatgttcatttaaagttccattttataatacgaaagactgttgaaaagcacctataaagctggaaataaaataaaagcctatgatggaaacgtaattgccattaagccacaagtggctccttaaaaaaactgcctaacttaaatggagatgtccaaaggtaatcctaatgaagctacggtacaatgaatgaagctacggtacaacaaaaacaccatcatgaagagataaaatgctttctcacattatttagaagatttaaataccaatctttctaaaaagcttaatttttttttttttcccagagatcctcgctctgttgccctggctgcagtgcagtggcgtcatgatagctcactgcagcctcgaactcctgggctcaagtgatcctcctgcctcagcttcccgaatagatgggatgacaagcatgcaccatcatgcctggtgaatttttgaatttttttttgtagagatagggtctcgctatgtcaaccaggctggtatctaactcctgggctcaagcaatcctcctgcctcacgctcgcaatgtgctgggattacaaacgtgaaccgcaatgcccagccctaaaagccatgttttaactttcctaaaaatttctcatcataaaatttgtgaccattaatggatactattgctgacctgcaaaaaaagctagactgaggcggggtgcagtggctcacgccagtaatcccaacactttgggaggctgaggcaggcagatcatctgaggtcaggagttcaagaccagcctggcaaacatggtgaaacctgtctctaggttgggcgcggtggctcacgcctgtaatcccagcactttgggaggccgagatgggcggatcatgaggtcaggagattgagaccatcctggctaacacggtgaaaccccgtttctactaaaaatacaaaaaaaattagccaggtgtggtggcaggcgcccgtagtcccaactattcgggaggctgaggcaggagaattgcgggaacccaggaggcagaggttgcagtgagccgagatcgcaccactgtactccagcctgggcaacaaagagagactccgtctcataaaaaaaaaaaaaaaaaaaaaagaaaccccatctctactaataatacaaaaaaattagctgggcagtagtggcacatgcctgtaatcctacctcctcaggaggctgcggtaggagaatcgcttgaacccaggaggcgggggttgcaatgaaccaagattgcactattgcactccagcctgggtaacaagagcaaaactctgtctcaaaaaaaaaaaaagctagactgtaatataaaattgctactcatcaagcattatatttagaaaactattttaaaataaagcttctgttatcactactttcaataaaccaaaccaaattgccatttccttatcactacttagaaactactgataggttcttagaacctactgataaaacttaagaatgcttcaaaacacccaaaatcttctagctataaaaataatatctatagtatctagataagtatctgtaacaagcaaatatagtagacatttcgttgttcagaagctggttacacaccagcaccatcgagtaaaatacatggatttcatagtcatgacttttggggaggacaggatttcaatttatatttttacttttgaatttgtcttcactatgaaaggttaggaattcaatatctaaccactaatatagggtaattgtttacagtctcactgcttgagatttcaattttcaactaccccttatataccctaataccttaactattggcctatgattcactggcaggaaaaaagggcataaacaatcttttttattgtctctttgtattttcagctctatgtatcactttctagaataactttctagaatagtgcaagctttattattcacaaagtaccttcttttattattaaatccattgtcattaagaaaatttcacgggaaatgtatcaatgtaccaaaaatatctatggttttaagttaactattaaacatgaacattccccttctggtggtatattataaattggtacaagttctaaaatacctttctctaaatgagataatcagaatatcttagaatactccatgctaccatagcatattactgtattaaaataccaattcatgaggcacattacagcatttttcactaaatatatatatatatacttgtacttagtaatgttgacaatatcttaaagatgattactgaatactattttacacagctttgctcttaagaaaaaagagtataatttgatggcatcattttgtaactatcttagaaggggcaaaagaaattttcagcttcctagtcatgtcttcaggctgttactttctagaaaaccaccgctacaaacttctagtaaaatgcaaaagaggtagagattaggatgattttgtaaaatgaaatacagcattcttcactaacactaaatctatcaaatattaataagaatcacttgaggaaattcacaactgtgtgcccacccaacaagcaatacacaaaacccttacttccctctatgaatgacttttaataacacttcaaattagaatttaagttagaaccagtgcgtatacgtgatatttttacaaattttaataatgctttattacattacaaaaaattaagagttgttgtttaagccaaaacaacttatttgtaaccaacatctcaaaagactgcagtgcgctaaaataaacctatgatgaaaactcagttttacattattgattcaactctatgaagtaggcctactgttacctcattttagacataatgaaactgaggcacaaagctgttgaataacttagtcaaggtcatatggatagtaagtggctgagctaacctatacgattctactgaaatggagttcacaaaatttttgacgttcacgagatactttcattcttcaaaaattccaacatatctccatgtcccagacagccaaaaaaaaaaaaaaaaaaaagaattccaacagtcgaagcctaacaaaaggcaagattttaacttatctttgcggtatttataagattgtatgcctttccatggaaagaattatacatatgtattcctgaaagcttcgaattcaagtgtacttaaattaacagatgaccaaaaaaggaggcaaagtatgactaattcccagaaccacatgtcaaaagagcattccatcattgcagcggttcttaacgtgtaggtcatggagtacactaagagtccccaaaactcaggaagtgcacagtcacaactatttcatgttttcccagcactaagatacagttagttatagtactatcatcagacttttctctgtatcaacattcactacatttaatggtgcgaaagtaatggctaggaaaagtcccagcactatagcacaagccaagagacttgggcccaatttttactagtaaccactgcatttgtcacatggataaaactgtagtttaaaattttaaactatgaatacctggaggaagcagtcaaagttaattttattaaatctctatccatgggtacatgcttttttcatgttcttcacaataaaacaggatttgtccacaaagtacatctgctgcattctgaagtaggatggttattttaagaaaaagcattcataattgaggtgcatgttgaatgaaatacttttttcacagaacaaggtttttataagagacactataattattggcttgagtatttggcggatattttctatgagatcaatatgaagacatgtaacttctttttaattttgtaaaataaatacattagcattttggataatctgcttaggccaatgcatcagtatttttcttctgattggtacataacactaaaaaatcatgcatgggtaaaaaatccattcaaaattcaaagcagcccagcggatttctttttttttttttttttcctttgtcagtctcactctgttgcccaggctggggtgcaatggcgtgatctcaactcatgcagcctctgactcccagattcaagcaatcctcctgcctcagcctcaagggtagctggaactataggcagataccatcacgcccagataatttttgtgttttttgtagaaatggggttttaccatgttacttgggatggtcttgaactcctgagctcaagtgatccacctgcctcaaccccccaaagtgctgtgattacaggtgtgagccaccatgcccagccaacccaattaatttcgatgtaagagtacttttaagttttacagtagtatcaaaaaaatccacaattatctttaaaggttattaacatactcctcccttatcacttctccgtataaagtcaggtcttctttgatgcgttttaattaaaaagctttctgcaatagatggactgcaaaagcaaacgtgggaagccaaccattttttatagagcaaaacaaatttacaaaacataaaacaacaccattcttcccactacactaaagggaacattaaaagacatttgcaaaaatgtacaagaaagcgactcttaactctgtaacgttttctttaaaacctcgctttggcttataatatggtaaatattgatataatcctttagcaggactttggcaccctcaataatttttaatagtgatatggaaaattaaagaaatatggaagccaaaaggtttgagaagcaatatttttaaaatcgcagtcagttttctttcatgaaaatatagaacaggaagcttgcactaagtaaggtaaattaacctaacaaatattttccaaagtggcatggtaaacatgccactactggcacatggcactttttgtgcagaacatggatatttttcctttaatatttagtacttgggctatcatgaaacaaggttagcataaccatccaaaaccccaagtgctccaaaatccaaaactttttaaacaccaacacgatgcccaaagtggaagattccatacttgacctcatgtgatgggtctaagtcaaaatgtaggcaaaactttcacgcacaaaattacttaaaatattctactgagccaggcatagtggttcatgcctataatcccagcactttgggaggctgagatgccaattgctcgagcccaggaattcaagacaagcctgtgtcacacagtgagacactgtctcttaaaaaaaattttttttggacagacacataatcccagcactttgggaggctgaggcggatggatcacgaggtcaagagatcaagaccatcctagctaacacggtgaaaccccgtctctactaaaaatacaaaaaaattagctgggcatggtggagggcacctgtagtcccagctactcgggaggctgaggcaggagaatggcatgaacccgggaggcggagcttgcagtgagccaagatcacgccactgcactccagactgggcgatacagcaagactccgtctcaaaaaaataaaaaataaaaaataaaaaaattaaattctatgaagttaccttcaggctatgtatataagacatatatgaaacataagtgaatttcatatttggatctgggtcccatccccaagatatctcattacataatacacaaatgtttcaaaattcaaaaaaatccaaattccaatacacttctagtcccaaacattttagataagggatactcaacacgtatattttgtgggtgtatatgtgtgtgtgtattaccaataacctaatttaaaggaatgacttaacacagtactcaggtaaagctaaagtgtagtatgaccacctaaacttggggatacactcactgaactaaataaaaactgctttaactgtgtcaactggaacaccatttaatgatcaatgacgagaggtattcatctaacactttatcaatataactcttgtttgagtgaatgcaatcttaatgggcacaatcaatactcttttttaggtcacagtcaaaattctttattgataaagacctctcatgtttatctcaaaaaaagctttaagaattgtccaggaatcaccacatgctatttaggttctatgtctcaaaaaacgaaaatgctaaaataatgtagaacatttaaatccactaaaaaatatataattctagagaaaaatatagtaagttctgacaacaggattcagcctttttaatcaattaggaatatctaaatattcctaaaaataaattccctaaaaaaaactatatttagcaattgaaaatattttagtgtgagcaaactatattctattaccttttccttcactaaagaaggttacataacagaacaataaggttataaccaattaaactttcatgagaaagattaaataagaactgttggccaggcgcggtggctcactcctgtaacctcagcactttggggggctgaggcaggcagatcacctgaggtcaggggatcgagaccagcctggccatgatggtgaaaccccatctctatgaaaagcttggcgacacagcaagactgcatctcaaaaaaaacaaaaaagaaaatcgttaggagccagaaatattagataacaaattgtagacacaaagaatgaagcaaaaatcacttacatgaaatattcatgggtatttttaaaaacctcaagatattaggcctctttgccaagaaagtattaactcatgaaaaaagtattaagatactgaacaatatacatcagcaaatgaatcttttctaataaaagtaaactgggccggacatggtggctcacacttgtaatcccagcactatgggaggctgaggcaggcagatcacttgaggtcaggagttagggaccagcctggccaacatggtgaaaccccataaatactaaaaatacaaaagaaattaaggccaagcacggtggctcaagcctgtaatccaagcagtttgggaggccgaagcgggcagatcacctgaggtcaggagtttgagaccagcctggtcaacatggtgaaacccatctctattaaaaacacaaaaaatcagccaggtgtggtggtgggcacctgtagtcccagctactcgggaggctgaggcaggaaaatcgcttgaaaccagaaggtggaggctgcaatgagccatgataacaccactgctctctagcctgggcaacagagaaagactctgtctcaaaaaaaaaaaaaaaaaaaaaaagttagccgggcatggtggtgcacccctgtatcccagctacttagaaggctgagacaggagaatcacttgatcaggagacagagtttgcagtgagctgagatcgtgccactgcactccagcgtgggcgacagagggagactccactttaaaaaaaaaaaagtaaataagggtcaggcatggtgtccagtgcctgtaatctcagggttttgggggaccaacgcaggaggatcccttgaggtcaggaattagaggtatggtgacctatgattgcgtcactgcactccagcctgggtgacagaatgagacctcactccaaaaaaatttttaaacgttttaaaatgaaaaggaaaaaaatatacgtttctattgatacaactcaatagcatgtaaactttccaacctaatcaatagtgaatgcttggaaaacttaacatttgaaattcaggcaattaaaaacaacaatttccaatatatgttattcgctgctagttagtgaggggtagtttaaaaaatataagacaatctctttatatatatatacccaagttttctcccctcaatacatgcattcctaaatatcttcacccatgaatatctgggaaaatattcttcagatatatgattgttaaaatgaaactttacatcgtatgccattgatagaattgcaaattacattgacggaactgcaaattaaaatgagacagcactacaaaacctactagaatggtgacaatccgaaacactgacaaaaacaaatgctggccaagatgcgatgcaacaagaacttcaacgtattgctgaagggaatacaaacaggtgtaaccattttgcaagacagtctggcagtttctgataaaattaaacatactcttaccatctgatacagcaatatcactctttgcattttaccccaaggaggtgcaaacttatgtctacacaaaaacctacacatgaatgtttatagcagcttgattcataattgctaaaacctggaagcaactaagatgtcctttagtatatgaatgggtgaactgtggtacaaccaaaatattattcagtgctaaaaagaaatgagctatcaacccatgaaaagacatagaggaaatttaaatgcacattgccaggtgactagaagccaatctgaagaggctgtatactgtatgattccaactatatgacattctggaaaaaactaaactatggagacgatagaaggatcagtggttgccaagggttaggtggaagggatagagaagcagagcacagatttttaaggaggtgaaaatactctgtatgatgctataatcataggttcatgtcatagatttgtcaaaaccctcagaatgtacacccagagcaaatctaaaggtaaacgatagactttggttgataagcacgtgtcaatgtagcttcagcaattgttataagtgtatcattctggtaaaacactttgatagcaggagaagctgtaggcatgtggcacggggtagacgggaaatctctgtaccttccacataatcttgctgtggacctaaagctcttttgaaaaaggctactaaaatattgaaactttaaaatgaatccttttgaataatcaattacattaaaaataataataataaatcaagatgagtctcactatgttgcccaggctggacttatactcactgggctcaacggatcctcctgcctcaggctccctagtagctggaactacagtcatgccaccgcacccagctaattacatcttaatttatactgcaaggtttagtcacgaaacaaaaagtagttgttacttgttaaatactaaatcagaaatggaggcaacgacaaatagaagtagggaaacttactgtgttcattaacttgacatgtgcctcttaaaccaaatacattcaacaatgtattttgaaagcctcggtcaggtaattgagtgaatagattgctctgatattactgtcaaattcaactgaatgtgtagcaaaattaatggctgttttttaatacatagggtggctttctaaccgaagatcaattaaatgtaaacacaatctagcacacatcaagggacagaaggaaataagtattttacataaattaattgttaaagaagcttctatttggctgagattttaagagacgggcctctcactatgttgcccgagctggccttgaattcctgagctcaattgatcctcccacctcagcctcccaagtagctgggactacaaggcacacaacactgctcctaagaattttatttgtaatgcatacacctgagagcattttcaagattaccagtttcaattgtcaggtgtaaactcactctgaagaggtgcttttaaaacctaaaattgattaatagtatttaattattcttcaaatttagttattttacccagaactcctaaaaaaaacaatgagcaaggataccagctgtaagacaaacaatactagcaataaaatcttaccaaagttcacataatactggtgactggtttgcacttcttgatccaaaacctctttcttatccagtgcatttccttaccaaagtaaaaccatcataactggccaggtcaaggtatgaaaggtgaaagaaaagaacaaatataaactgcacaagcagcagttccaaattggtcccgtcaacagaaaaaagcagaaaagaggaaaacaaggcatagatggccaacgtatgagttaagtacacattttatacaggagagtatccatttctgtttgtgatagtcggcattagataaatcatcttaataatttaccagaggccttgaaattgtgatgttagtacatattttcttctaagtaactaactcaaagctacaggtttaaatacatagtcattttttacacatttaagtggtaccaaaataaaaatcaaagttatttaaaatttgccattataaaacaaactactgtaacaatcatatcaattggttaaaatcatatatagaaaaaacaagaataaatcaaatgaagaagttatcttaagaaaactatggtaaaacaaccagaaaagccagggtttgacacatagtgcacaatatagtataagataccattaagaaaagaaacaaacttacccataaactttcagttactttgaattgtaaaagtctttgaaagtttgtaattataattatcaatctaactcaaataagtaaaagcctttgaaagtttataattataataattaccaatctaactcataactgcatctcatcagatgcttacaaaccagagttcctacagcctacatctcactagttgttacttaatactgaacatagacattataattttttagttttagtacaaaattctaacattttagatgatactacagagatactatcctcaatatgaagtatagaagatcttagatactgactagcctaaaatataatttaccgtcactatgtagaacaagcactgtaaggtggctccaaatacattaaacaagtcacaaagcagaagtaacaagttaaatttttatgccttctgaggatcttctgttactaattcaaactaataattaaaattattattagttatattatacactagacaatgcacaagatatgtttacattagttaaccatgtctatttgccggtcttgactctcctcttctccgattgctcaaaaaagagttaacattagctaaaaaatcttaccattctgaaccaaaaattattagaacttaccatttcaaatgaaaagacatgaggtatacctacaacacagcaggaataataaacaaatcacatcattttataaacacagacatatacacacacaaaagtaccaagactatttaatgacactctcagtagagaatttcattttctaaattctcagaacgtttgagctgtttcttttaacattactctgtataagtactcagcacctaaagtcctctaacatcctctgtatcctccacagtgctcagcactatgttttgaatacaggaaacagtgaacaaatttttcttccaaaatggaaacctcccagacgacctgtaagtctaatactctgaagtaaaaagttaggtgtgttgaaaaccaagcaaaaaaaaattgtttctttggctgcttttaaaaatactcttcattacttaatcacgtatgaagtctataaaaatgtatcagcagttgtacctcaatgccacctatgttttccaaagtgccaaatgtgtaatatctgaggcattaatattcaataaatgccaaggtctagtgatccatacagactgaaaaccataactgagctgcattggcatttgaaaaacaagacttcaaacagctacttaattctctcagtttacatctaagtaactataatatgacaaacataaaattcgtgacctcgaaaaattcagagaacacaattagtagacaacaaagtcagaaaaaaattagaatacaacttggtaaatataaagaataaactatattgaacataaaaaggaccaggtgcagtggctcacacctgtaatcccagcactttgggaggcagaggcaggaggattgctttagcccaggagtttgagatcaacctagggaacacagtgagactccaactctacaaaaaaaatgtttttaattaggaggggctggtgtcacacacctgcagtcccaactacatgggaggctgaggcaggaggatcacttaagctgaggagttcaaggtcacagggcgctatgatcgtgccactgaactccagtctgggtgacacagcgagagcctgtcttaaaaaaattttcggccaggtgtagtggctcactcctgtaatcccaacactttgggaggctgaggtaggtggatcacctgaggacaggggttcgagaccagcctggccaacacggtgaaaccccgtctctaccaaaaatacaaaaattagctgggcatggtggcgggtgcctgtcatcccagctactcgggagggtgaagcagaagaatcacttgaacctgggaggcggaggttgccatgagctgagatcgcgccactgtactccagcctggatgacaagagcaaaacaccgcctcaagaaaacaaaaacaaaaacaaaaaaattttctggccaggcacagtgactcatgcctgtaatcccagcactttgggaggccaaggcaggtggatcacttgaggtaaagagttcaagagcagcctggccaacatggtgaaaccccatctctactaaaaaatacaaaaattagccggatgtagtggcgagcacctgtaatctcagctacttggaaggctgaggcacaagaatcacttgaacccaggaggcagaggttgcagtgagtcaagatcacgccactgcactccagcctgggcaacagagcaagactccctccttaaaaccaatttttaattttaaattattttaatgaaaaagatgacagctggggtgaggaatcagaagaaacacatgacctgagtctgaacagatattctccaaaaggaaaaaagaaaacatgataatttttctggattatgaacctctctgaaactctaacagaaggtaagatcaaaaaaatgttaatcaatacaattaagtgtcctctgatgaagtgtgtacacagtatgagattcagtcatcatttccaagtagtcattcaaaaaagatttacaaatatgaatgataaaacacagaaaaccattactaataatcatagcatatgattaggctaactatacctcctggttcacctaagaaagcccattttatgcctattgtaggaagtattttaatagtatgcatgttcatttgtcccagtttgtatgaaaaattctacggtttcccacacatcattagatattattgaaactattaaataatctttggaggagtgatcaaataactcaacacctggttaaaactgacacataccttcaaccaattatcccaaatcagcaaaatcctacaaatcaattctaagaatatgtgtaaacattacaaacttatatatatgtttgtttttatttgatcacaaaagtctaagttaagttacaattatgtaccgtgccaaatattgagaaaaatccttggcttgtaataaattattttaatgaataagtaaaaacattaacaaccgaaactagtcacaactagaacattacatatgagaccattgcaatgtctgttattatccattttgattttcaccaacatgtccaaaccactgggactaggccatcattataccataaataagcctaccagtccagcaggtcacacttaaatctgacatcaaatccttcagcaaataattctttagttatttccataacttaatgaagaggccataaaaatcccttgtaaaatgtgtcttttgtttgaatgcttcagaagtttagacttcaaaaaacaaatcttcttaagcaacataaattcctcattagagctttaaaaactgtagaaaaagagggacagccatgtggaaaccacaaaactgtaacttctgctctggaatcttcacaaaccatttcagaaaataaatttgtatctattcattagtaaataacaacaggatcactcttctctgacagcataaattaatggaatttttttttttaccagatagagtttctgtttttcagttttacacgtgccacatcagggaaagttaggttatgattaaagcaagagatgatagatgaacaaacaaagaaacaacaacaaaaagcccatgcaagaggcaggaaaagaggctgactggttaaagaacaggccagattggacaatactgatcaagaggggttcacatttgaaagaacagtgctttattcctctactgactagaactaaagggattttggccgggtacggtggctcacacctgtaatcccaacactctgggaagccaaggtgggcgggtcacgaggtcaggagttcgagaccagcctgaccaacatggtgaaaccccatctctaccaaaaatacaaaaactttgccgagcgtgggccgggcgtggtggctcatacatgtaatcccaccactttgggaggccgagcgggcggatcacctgaggtcaagagatcgagaccatcctggccaacatggtgaaaccacatctctactaaaaatacaaaaattacccaggcgtggtggcgcacgcctgtagtcccagctatttgggaggctgaggcaggagaatcacttgaacctgggaggcgggggttggagtgggccgaaatcatgtcactgcactccagcctggcgagacagcaagactccgtctcaaaaataaaaataaaaataaaaataaaaaattagccaatcgtggtggcgcgtgcctgtaatcccagatactcggaaggctgaggcaggagaaacacttgcacctgggaggcagaggttgcagtgagccaagatcacgccactgaactccagcctaagcgacagagcaagactccatctcaaaaacgaaaaaaagattttaaaatcccaggtgtcagctgcaatgcagtgactctttaccatttcttcccattaacttttgctctggtttataaccatgactaccaatgaaccttctggatactaatttggattcctcaggaatccttggatctggaatatgaggtactgtgctcagtgagccttctaaaaacactggaaaagaatatataaatgaatagatttgcattattcttcacaagctctacgagtttggtaatatgagccacttttatagattcccttcaactctcggattcagaggtcagcaaacatttcaggtaaagggtcaggtgtaaatattttttaggcttggcaggccatgtagtctcaatacagtctcacatagttgtgtcacaactactcaaatcagtttttgtagggcaaaataaacaaaacaaaacaaaacaaacaaaaaaaagtgttacaaaaataggcagcatgtgaactgagcctggtctgttctagtctgtcaacccctcgactggatgagacaattaaaattattagaactatgcacgcaaaattaatgcatagtttgagataatatgtcctgcacatatagtctgaaagcccaaatcaaggttgccacacccaaattctgcagggtactattcacgtagaatgtcatactgtttgaaccgtgttctaaagatggatatataaccatatgcagtggtaggcaactgtagtcccactattcaggagactgagacaggaggatagcttcaggaggtcaagaccagcctgggtaacacagggagacccaatcaaaagaaagaaaaaaatgaagaaagatgggtacagcagcatgcctactctcccagctacttgggaggctgaggcaggaagattcacttaagcccaggagtttgaggctgtagtgtgctataatcacacttgtcaatagccactgcactccagcctgggcaacacagcaagataccatcaataaataaataaattgcatcctatataaatcttacaccatgttgaaccacatcaagcatgccttccactaacactcccaggatccatgaaaaattcaactattttcatttcagtatgtctcatttcaatacaaggccagtagttttgaatcttcgctaccaaaaagaaataagcaaggtgtagagttttctttaacacgtatatctcctggtaccaacctagacacactgaatcaaaatacttggaggactgaatctcaggcatttttccttaagttccacaaatatattgcaaggttgaaaactactggatttagcaaaaaaatgtgatcaaagatcaatgtattacaatctacctggatcacaaaacaaatcaattattagtagtatgatctaagaacccacattttttaaaagctccttgagtgtttattacgtacattggaaaaacactgttctgctgggcacagtggcatgtgcttgttgtctcagccactcaggaggatgaggaaagaggactgcttgagcccagcctgggcaacatatcaagaccccatctctaaaagaaaaaaaatgttttacattgtccttggaagaagcactacactgctagcctctgccaacattcccttaatcattctggcctcacagtccctcgggtgctacaatggaatgcctctgacaagcaaagaaatacaactgagtcaaactgttgccttagcatacaacatacctttattctcaagtttattatgtgtgttgaataaactgtgttgaaacacctagggctattcccaactactcaaatgggactaataagctttaatagtaagtcaggtatatatttagttcaatgcaggaaacctgaaaagggtatgaagaattattcttttctttattgaaaaggcaaacattaatatgtaccatacaagaaaaagaaacttctcagctgggtgtggtggctcatgcctgtaatcccagcattttgggaagccaaggcgggcagatcacctgaggtcaggagttcgagactatcctggccaacatggtgaaaccccatctctaccaaaaatacaaaaattagctgggcatggtggcaggcacctgtaatcccagctactcgggaggctaaggcaggagagtcgcttgaacccaggaggcagaggttgcagtgagctgagatcatcccattgcactccagcctgaacgacaagagtgaaactctgcctcaataaataaataaaaaaaaaaagaaacttctcaaattttaaaaccaagtaacatacaatttaaacatcaccccaattttcctaacccaaatatttcataactacatgatacaataactaaagctaaaataagatggacgtttggatatttttatgacattaacattttcccaagaagcaatgtttactccaagaaactgcatcaaccaaatgctagaactaaaatctgtcatttagtccaatgcagatttttcccataaagactggtaagtactgaagtgtttaaactacttaatctacagttggtggagtaacctaatatgaaaacaatcacaagacaattataaaaaacaatctcataaaattctcattgcttccagaataatagcttttaatgtgtccaaaaattgtgataagtagaaaatttccacttagtaaatactgcctggaaaaaaattgaatacactctatattatggtaaagacaaacctaaatgcaattaagacatattattaaaatgtatacattcttaaggcagttgaatgttatcctaaatgagtaaaaaatgttgtttaatttatagttacaacagtaattatcaaaaagtttgtcttctaaggaaaaatcaagtattaaataaaactgacaactgatattgatgaagtactggcttacatccttgaaactcttaaaaatatattcccatgtgtcataaaattatgatcaagttgaaggctgacaaacaaaaagatgaccagatatgacaagtgttttcactctttctttgttacatgaaattattatttaaaatgtgaaatatgtaaatcaatatttattttatacttaaaagtcccataactcttagttttgttggaatatttctattaggaaggcaagaagagagaggtggcatcttaaaattaacaaagaaaatcaactttactcattacttggacaagttgaacacttaccatttgattcctccctttaaactgaacagtgaaataaagagaaagcacataagagggcctaatttcaaagcttaaacacacacacacacacacacacacacacacacacacacacacacacagcattaaaattgtttaacaattttctccaaagacagttttcaaagtaaatgaagaacaactgccagaatggcctcaatgcattcttaatacaatgctttcctattaatatactcccattaacacaaaatatttgagataggtagagctttcattcatattgcttttagtgcttaagtttgcagtagtaagaggcactgtgaagcttggaaccaaataaaactgacaccaaaataatgaaaaacttgtgtagattcatatcacttctaatcacaaataaacttatagaacactagtcagtgttacacaattatcatacctcatttacatactatttgaaatacggatatcccaaaaagttaagagcatagtaactttgtggtctatctaccataaatactaattttaaaattttttaaaaaacataaatattccagcccaggtttccacagacactataaaaaggtcagaaaaaaatattttaagttattgcgagtcacaaatcatttctaatattcttctttcttttgcaataaccctttaaaaacagaagcaccatcagtatctctgtggtggagtaataaaaaccaggcagtagtcccaggctagagcttgccaacttacactctagccaaattaattttatcatgatgcttcaagtatgcgatacatactttaagtaactactagaaaagaaggtatattgtcacctaatgcttttctataagcataatcttatgaaacaatagatgatctattttagaaatgtcggctgggcatggtggctgacacctgtaatcccagcacttttggaggctgaggtgggcagatcacttgaggtaaagagttcgacaccagcctggccaatatagtgaaaccccgtctctactaaaaatacaaaaattagccaggtgtggtggtgcgcacctgtaatcccagctacttgggagactgaggcaggagaatcgcttgaacctgggaggcagaggttgcagtgagctgagattgtgccactgcactccagcctggttgacagagcaagattccgtctcaaaaaaaaaaaaaaggttactaaaatattaaagacaggaagagaaaacctatagactaaaagaggctggatataacagtcaattcaaagaaaccaaatgtttaaaaaaaaaaaaattaagacctgtgcaaatctgggctttaattagttaagatgaaagagctgaccatttttaaaatatgataaagatttttttaaaaagtcctcatcttttagagatacatactgaaaataaaattatatgaaatcaggtatttcaaataacataaattgggaaataaagtggttatacttaaagatgtaaaagattggccatatgtttataagtgttcactacaattcttctgtacatgtctgaaatcttccaaaatagagatgtttcaatattagtatgtggtgaaaatcagtcaagtggaaatgatgtatatatcaagatttctaacttaatagcatatgtttttttaaagatcaaccaaaataataggaaaaaatataacatccacttcataaaacatagatatcttcagaaactaattttactttaccacctatgagaggttaagaaaatcactaatttatcaaacatgatgaatttagaaagattagaaaagactactgtataaaccaaaatctaaagcattctaaatatgcatcataaacctgaaaatataaaatcattttagttaactagtagtttacttacattttccatgtagtttggcttaaagccctcttgctgtcgcctcagttcctcctgttctctgtgtcggatcatttcttcctcacgccgccgatgctcctcttcatgtctgaaaatttttcaaataaaaatttcagcatcataacatgtgggctgccattggacattttacttcatgtaaaatgaaatcatttatgcaatcatattatgccaaacctgtaatcacgactgaccacggcatcctaaatttaccttccttctatgtcactccaagcctttaataaatcaaaaaagccaaagaaataaagtaacttagctaaggtaaaccagaaaaacaaagtaaaatcataactaggatagttatttgcgtatattcaagaaattgagagtcaaaaaaagctgaaacatgtactctcttactatagaaaggaaaaaatctcagccagccatggtggctcacacctgtaatcccagcactttgggaggttgaggcgagtacatcacctgaggtcgggaattcaagacctgcctggccaacatggtgaaaccctatctctactaaaaatacaaaaattagccaggtgtgttataatcccagctactcgagaggctgaggcaccagaataggttgaactcaggaggcagaggttgcagtgagcggagatcgcgcccctgcactccagactgggcaacagtgagaccctgtctcagaaaaaaaaaacaaaaaaacaaaaaaaaaaaaaacagaaaaagtctgagatctactgatctatcactggcactgcacagttcttaaagccactcagaacatatccagagataagccacctcaaaaaaccacaatgcctagacaaaaatcctatttccaaaaggaagccttaccaactcctccctccccatattcatcaacccactgaaagaaatcccctgaagcaggtgtcagtccacaatctgcttttagaaattacgtgttatagcataaacatttacattactgtctatggttacttttaagaggaaaaatctatatagtaatattgaagtaacagactcacattatattggcatttaaaccaatgcaaattcaaatatacacaggttgagtttccctaaaccaaaaatctgaaagcattcttgaatctttctaaacctgaaatgctccaaaatctggatttgttgttgttgttgttgttgttgagacagggtcttactctgtcacccatgctggagtgtcccaatctcagctcagctcactgcagccttgacctcccaggctcaagcaatcctccaatcttagcctcccaagtagctgggactacgggcacgtgccactatgtccagataatgttttgtacttttgtagagacagggtcttgccatgttgcccagactggtcttaaactcctgggctcaagtggtctgcctgcctcaatctcccaaagtgctgggattacaggcgtgagccccaacaccccggctggaacttcctgatagccaacatgatgtttaaaaaaatgctcactggggcatttcagatttaggatgctcacctggtaaacacaatgcaaatactgaaaatgtgaaaaaatccaaaatacttattctggtgttaaacatgtcccataatggatactcaaggtgtatgccctccaccaataaaactgcaaaagtaatttatatagtgaaggctatataaagctgatgccccattattaggtctcgttttccagattactcttataacgtacttttcctacatttagaattgcaaatcctcaaatttcaagataccttgttcttgtttgttgcacaacactcccgctaaatctgagtccactaattcaaagatatggtgatttcttctattaccagagaaaaaactcagaacttcatgtcagacaacatgaacaaaaatgttcctaagggatttcacgcaaaatctggactattttaagattgttgtcttactctctatacaactcttagtataatccttaaaaataatctttaagtaaactggttaatccatttcctggatattaacacatttcatatattttactgtgaagaaagtacttcacattcatgggtgtgggtggcgatgggaagatccaataaaggtcaaatgtgttgaaattcagtttttctcatttaaaaaagggtcaatatactcataatataccaatactacttataaaaagagtcaatatactaataatatacttatatgctcagtgggatctggggcagcaccccataatcaaccacattaatatttctgcagtaagataaaacattcacactctggaggtaataaaggtttcacataacaggagttcagatcaacttttgccatcaaatggattcacgtcagattgccacctgaatgaggatacatagaaaaacttttggcagggcgcggtggctcacgcctgtaatcccacactttgggagcctgaggcaggtgaatcacctgaggtcaggagttcaagactagcctgggcaacatggtaaaaccctgtctctactaaaaatacaaaaatttgctggacgcggtggcacgtgcatgtaatcccagctactcgggaggctgacgcaggagaatcgcttgagcccaggaggcggaggttgcagagagctgagactgcgccactgcactccagcttgcacaatacagcgagactccatctcaaaaaaaaaagaaaaagaaaaagaaaaaaaaaacaccaactttttagtctcaaagcttccgaattacaaagacaatacagtagacacagtgaccttgttgggggcccacttctaccacataattttaaatgaacaagcctatttccagtaaacagaaatgtacgcacaaatgtgcagggacatatgtatacacagatatatattgtggcattatttataaaagcaaaagatcaaggacacattaatcagttataaatgggagacaaggttcactgacaccttgggagacaagaaacacatctgttacagaggtggattactatctactggcatgaaagaatgtctgcgatgcaaatgtcaggaaaaagggcaagtaaaagaatggtattgctattactgcttttaaaaaccatttttatggccgaatttggtggctcacacctgtaatcccaggattactgggattactttgggaggtggaggcagaagcgaaggtgggaggatcacttgagtgacagcctctctccacgaaaaatagaaaatattagccacggccatgcacagtgactcatgtctgtaatcctagcactctgggaggccgagacgggcagatcacttgaggtcagcagttcaagaccagcctggtccacatggtaaaaccccatctctactaaaaatacaaaaaaattacccaggtgtgttggcgcacacctgtaatcccagctactcaggaggatgaggcaggagaatcgctggaacctgggaggcggaggttgcagtgagctgagatcatgccactgcactgcagcctgggtgacagagcaaggctccatttcaaaaacaagaaaaaagaaaaaaaaatatatatatatatatattaggcaggtatggtggcacacgcttgtagtccctgctactagggaggctaaggtgggaagatcacttgaaccccataaggtgagactgcggggagccgtgatcacaccactgcactccattctgggtgacagagtgagattctgtctaaaaaataaaataaaaatgatttttaaaaccatagaagagggtatgaaaaagtttatataccacattggaaatgattaggggaacaggagcattgcccttacgattataccacacagaagattctataatctaaatttaatgacagcatacagaaacattcctgttgtccatatatgtttgctttcaattatttctactccacaaatgctttaatgaccacctttataattatacaaattacctcttcaggtcaaggattgctttctaggttatattcacaaatggaactactaaggagaggagaactagtaattatgacaaattttaaaccttcacgttacatttaattgaaaactaataaaatttcaattttacaatttgttttattttgaggcccattaattatttacaggtctcaaatattcttgcaggattctgaaagacgcctactggatgaaacctccttgctgttattgttcagcactatggctccacatccaacacagagcccaagacagaagaagggctttataataattcgctaaatgacttaagaaaggaagtgggggccaggcgcactggctcacgcctgtaatcccagcactttgggaggccaaggccggcagatcacctgaggtcaggagttcgagacgagcctggccaacatggtgaaaccctgtctctactacaactacaaaaactagcctggcgtggtggcaggtgcctgtaatcccagttacttgggaggctaaggcagcagaatctcttgaacccgggaggcagaggttacagtgagtcaagattgcaccactgtactccagcctgggcgaaagagcaagattccttctcaaaaaaaaaataataagaatataaaaattagccgggcgtggtggcgtgcacttttaattccagctactcaggaggccgaggcaggagaatcacttgaacctgggaagtggaggttgccgtgagccgagatcacaccactgcattacagcctgagcgacagagcgagactccgtctcaaaaaatcaaacaaacaaacaaacaaaaaaaacaaagaaaggaaggaagtggggccgggtgcggtggctcatgcttgtaatcccagcgctttgggaggacaaggtgggctgatcatctgaggtcaagggtttgcgaccagcttggccaacatggtaaaaccacgtctcgactaaaaatacaaaaattagccaggcagggtggtgggcgcctataatcccagctactcgggaggctgaggcaggagaatcacttgaaccgaagaggcagaggttgcagcgaccgagatcgcgccaccgcactccagcctgggcgacaagaacgaaactctgtctcaaaaaacaaaccaaagaaacgaagtgggtaggtgagtaaatgggtggaaagagaaggaatgaaggaataagtgaacaaacaaaacaaaggaataactactaagtggtcaagtcacagactgaaccagttcatgtaagcccctcatcctggtcttcctttggtacctgccacaacctctgaagaattaagttacctatgaaaaactaaataatttatttatagcattgaaagtaaaaccagaaacttgtgtactccaaatacatttctcccaaaatgtactgtcctaggccagtttttctatcttccaactaaagtaaagcacaaaggcagaattcagactatttggcttgttaacaaataaagctatcttacttggcagcagcctcagccagataaatctcttcaatttaattgtgacaattttcttcatttgctccatcttgcaaatatatatgagttcccagacataatctttttttctttcctttatacatactgcaaaactactcaaaaaaaaaattttttttttgagacgcagtcccctctgtcacccaggctggagtgcagtggcgccatctctgctcactgcaagctacgcctcctgggttcaagccattctcctgcctcagactctgagtagctgggactacaggcgcccgccaccacgtccggctaattttttgtatttttagtaaagacagggtttcaccgtgttagctaggatggtctcgatctcctgaccttgtgatccgcctgcctcggcctcccaaagtgctgggattacaggcatgagccaccgcgcccggccaaaaactactcaattttaaggcaagttgttcacacttcttaaatcaagattcttacagctaatttcaaaagaaactccccagccaccaggaaaaactaagattgtaacagatttattactgcctgtatttactagaatttggtcaaacataaaggttacccgtcaaattatcaccttatattgagatattttcagttaattgaattttagattaaatctgatgcccctgtatactgagattacataataaaaaaaatcacgcaataaaaaattacatcttcaggccacgcacagtggctcaagcctgtaatcccagcactttgggaggccgaggcgggcggatcacaaggtcagcagatcgagaccatcctggctaacacagtgaaaccccatctctactaaaaatacaaaaaattagccaggtgtggtgacaggcgcctgtaatcctagctactccggaggctgaggcaggagaatggcatgaacctgggaggcagagcttgcagtgagccgagatcgcgccactgcactccagcctgggcgacagagtgagactccgtctcgaaaaaataaataaaataaaataaaaaattacatctgcaacaagtattccacatctcagcctatgattaaatcagcaacgtatcctctatgtgcctcacgagcttcccctaatattaaccccttgtataaccatagtacaaaattatgaaaaccaggaatgaatactggcacaatattataattaactatagacattactaaaatttcaccagtttcctcactaatctttttttaaagagatagggtcttcctatgttttttgtttgtttgcttgcttgtttatttgttttaagagacagggtcttgctatgtttctgaggctggagtgcagtggctattcacaggcgctatcccactactaatcagcacgggagtttttacctactccatttctgacttgggccagttcacccctccttaggtaacctggtagtcccctgctcccagaaggtcaccatattgatgccaaacttaatgcggacatccaatcgacatagtgcattacagcccagaactcctgggttcaagcaatccgcccacctcagcctcctaagtagctgggaccacaggcccactaacacctttcttctgttccaataccttatccagaatcccacattgcatttagtcgttatttctccttagtctccaacagtctgtaacagttcagtctttctatctttcatgaacctgacactattaaagagaactgattattttgtagaatgtccttgaatttgggtttgttttttctcataactggaatgattatgcatatctggtaagaatatcacagaaataatgttatatcccattcagtgaatcatatcaaggggctcctgatgttaactgtcttattacaggtgatatgaaatttagtgtttggttatggtggtgtctactgggtttctccctttaaatttaatattttttccttttgtatacaaatttgagactatgcaaaaaccctgtttctcaagttttgcccaccaactttggtatccatcaaaaaagcttgtctgtagcaattattattaaagatcgaggcaccagttatgttcattgttactgaagcttctagggcctctcagtagaaaaagccataaaatacagcatatggggcaggcatggtggcacatgcctgtaatatcagcgctttcggaggctgaggcaggaaagatcacttgaggccaggagtttgataccagcctaagcaacatagcataatcccatctctataaaaaaataaaaattaaaaaattagctgggtgtggtggtaaacacctatagtcccagctacttgggaggctaaggcaggattgtttgagctcaggagttcgaggttacagtcagctatgattgagacactgcacttcagcctgagtgacagggcaagaccttgtctcttaaataatttttttaaattaaaaataaaatacagtatatgtatacatattaacccatacataaacacacatctatatttctgcatgtatttgtcaatattaaacaccacagagttcatacctctgattcaaatcacactcacacaggattttaagtttagccgttcatctttctctaatgatgagaaatttgagtctcattatccacaatatacagtcataccttggtatgtgcaggggattggttccagaacctcccccagataccagaatccactgatgctcaactccctgacatatggtgtagtattcgcatataacctatgcacatcctcctacacacttaaaagcatctctacttataatacctaatacaatgtaaagactatgtaaacagcactgtttacagagaacgacaagtaacaaaaagtcctcctacacacttaaaagcatctctagattacttataatacctaacacaatataaaggctatgtaaatagttgttatactgcacggtttagagaatgacaagttagccgggtgcagtggctcacgcctgtaatcccagcactttgggaggctgaggcgggaggatcacaaggtcacgagttcgagaccatcctggctaacacggtgaaaccccgtctctactaaaaatacaaaaaaatagccaggcatggtggcacgcgtctatagtcccagctacttgggaggctgaggcaggagaatggcgtgaactcggaggcgaagcttgcagtgagccgagattgcgccactgcactccagcctgggcgacagagcgagactccatctcaaaaaaaaaaaaaaaagagaatgacaagtttaaaaagtctgttaatgttagtatatacacaatttttccccagatattatcaatccacagttggctgaatccatagatgtagaacccacagatacaaaagactgtaggtactaatctgttcatgtaacgtatacacacaaagtggtttcagaactactagcccatatgcctaactagcttacagaatttatgtatggttcttatcattagtattatgatatccagtcaacacactattttccagttatttaggttccttgttttcttccctaccccctttcaatgtgatgatgttattcatttgtaagacaattaggttaatttcttgtatttttgtatcctattttggaatccacccctcatattgtttggttttaatgatttattttttgcttacatgaggggtaggtataatttcaaaaagcctagctgtcatctctaagttttaagaggaaaaagctagattcaggtaagcctttatgttaggggagaggaggtttcgttgtctttgttaaaaatagaaaagatctggccgggcgtggtggctcacacctgtaatcccagcactttgggaggccgaggcaggtagatcacctgaggacgggagttcaagaccagcctggccaacatggtgaagccccatctctactaaaaatacaaaataaggtgggcatggtggcgcaagcctgtaatcccagctaggaagctgaggcaggagaatcactgggacctgggaggcagaggttacagtgagccaagatcgcaccattgcattcaagcctgggcagcaagagcgaaactccgtctccaaaataaaatttaaaaaaaaagtagaagagatttgaacatgtctatataaaaaggaaaaaagaaaagttttaaaaaaggttcctgaggaaggcacattcatgatgttgagagttgtttaaaaaaaaaaaaaaaaaaacagtagttctcaagctttcagatctatctgaatgctggaggattccaggtggctgggcctcaccactattgtttctcattcagtagttctgcagggaggcttgagactacattcctaacagttccctaggtgaaatgttaatgctgtctgtccagggaatatgatttaagaatgaattggggccgggcacggtggctcacgcctgtaatcccagcactttgggaggccgaggcaggcggatcacctgaggtccggagttcgagaccagcctgaccaacatggagaaaccccgtctctactaaaagtacaaaattagccgagcatggtggcacatgcctgtaatcccagctactcgggaggctgaggcaggagaatggcttgaacccgggaggcggaggttgctgtgagccgagatcgcgccattgcactccagcctgggcaacaagagcgaaactccctctcaaaaaaaaaaaagaatgaattgggtagagtaaaatcacatagaaatatttataaattgataaactcaggtacaaagtttgaagaaatacatcaaaatatacagaatatcacctatctgtagaccagagaagcttcaaatttgttcacggtttttcacttttttctttacttttacttccccatgaacaccttattttcttatcacaagcaccttacatttttaaagcaaatactattttcaaaaacagatttctacatttgctttaactatcatagctttgtttataatatttcctaactagtatgatttttgaacctttgaagagtaatgtttataccattatattttgcaattaaacaccacaggcacaaggtgagctatcaatgtgggtttatatatcttgaattaaccactctctcaaacatgcttacttaaacctaaaagatttcaagctgaccatcacgattgtctattatgtactgagattttaagtccccataaccccttttaacacggagtcaacttccagaaatcttttttttttttttgagatggagtctcactgtgtagcccaggctggagtgcagtggcaagatctcagatcactgcaacctccgcctcctggattcaagcgattctcctgcctcaacgccctgagtagctgggattacaggcgcgtgccaccacagccagctaattttttagttttagtagagacagggtttcaccatgttggccaagctggtctcgaactcctgacctcatgtgatctgcccacctcagcctcccaaagtgctggaattacaggcatgagctactgcccccagcctcagaaatcttgtttaaagattatcagaagcacaaagttacataaagatattcatagtagagttttacacataacaaaataaataagagcaacgcaaatatatccatctctggaaaaatggatattcacagcatattcttataataaattacatataataatacctaaaacccttgtttaacttcaaagtttagcattcaaagtgcccttaaccagctaaaaaccagcaaagaattatgctacattatgaagtaattcactgtatgtggttaaaatgggcaatttttctatttttcctgtgatactcaacttatacaacttgtaacaggttgtggggagtttttattaataagacatacaattcatgtttcttaaaatgatcttcttttaccttagttgtatttgcttccgtttttgcaactcttggtttctgagttcttccaagcgtctgagttcttcttgacgcctcattagatctataaaataatgactgcacattaatatttttagtttccctttccatatttttataccaataagcatagaagttctctatcactggcaatatattggtatattactcattttataataatgtaagctgggtaattaaataaatatcctttctgagcacgtttcttcacgtatataaaaaagagtattcaagttcattcttggccaggtgcggtggcccacgcctacaatcccagtaatttgggaggccaaggcaggcgtatcactcgaggccaggagtttgagaccagcctggccaacaaggcaaaaccccaactctaccaaaactacaaaaattagctgggcatggtggcgcgcgcctgtagtcccagctactcagaaggctgaggcaggagaatcacttgaacccgggaggtggaggatgcaatgagttgagattgtgccactgcactccagcctgaatgacagagcaagactccatctcaaaaacaagttcattgttaggggaaaaacacgtaataaactcatcttggctgggcgcggtggctcacgccttataatcccaacactttgggaagcccaggtgggcaacagagtgagatgactcaatctcaaaaaaaaaaaaaaaacaaacaaataaataaataaaaattcatctttacgtcaagaaattaaaataggtaggctggcttgtgcctgtaatcccagcactttgggaggccgaggcaggcggatcacttcggccgaggagttcgagaccagcctgagtaacacagtgaaaccctgtctacaaaaaatacaaaaatcagggccaggtgtggtgcctcacaggtggaatctcaacactttgggaggccaaggcaggcggatcacctgaggttgggagttcgagaccagcatggccaacatggcgcaaccccatctctactaaaaatacaaaaattagctgggtatggaggtgcacgcctgtaattccagctactcgggagattgagacaggagaatcacttgaatatgggaggcggaggttgcagtgagccaaaattgcgccactgcactccagcctgggttgcacagcagaactgtctctaaaataaaataacaaattgtaattgttttcagcagcaaatgcaaagccccaacacatgccttcagagacaccagcagagagcacttaagaaccagaccaaacaggaatcatgacataaaacccaaggaacctccctcgcaacacgattagcatgaaattcctccctaactaagccaatgtcttacgaagaagagtgaggagacaattcttcaaagaagaaagcaaagataaatgctgatataaacaagacttttcaacaacaaaaaagcatttccactatcaccaatccctgccatatcaagaatgggggggttccagagtaagataatgaaaagtacatttgtattgcacatctaagaagtagtgtataaactttccacgttaaaaatctccaaagctaaaaatctttgtgtgtgattttgtataaaattatgtatgtatatatgcatatattttaaaataataaaatgttaaaatactctggatggcacaattgctggttgcttttattttccttttctctttatatctgaaatgtctaaagtgaacaaattacctcaactgaatgtttcttaataaacacctgtactcaagagttgactcatataatactacagctaaagttaatctaaggtaccaataacccaaacttcataacaatagcaagacaggcatcataaccataacaaggtaaatattgttctccccattttacagattaaaaacagacatttataaattatgcaaaaaaaaaggattcagacagattataaagttgctccagctattacatgattcaactgggatgccaggccaaacctctccttattccaaagctctttcaaaaaagtatgccaaacctagttgatcagactcaattggaaaacttaaaaatatgcatttggggatgttgctaagaaaagtctgttttggtatatgagacagggcccaggtagttctcataataggcccatagagaaaacacttgattatctgaaaaatgttaaacatgaccgcaattatttcgaacctttataacataattctcaaccttaaatactcattagaattacttaaatacctgaccagtatttaagtaatggctcacacctgtaatcccagcactttgggaggctgaggcaggcggatcacctgaggtcgggagttggaggccagcctgaccaacatggagaaaccccgtctctactaaaaacacaaaaattagccaggcgtggtggcgcatgcctgtaatcagagctactcaggaggcttaggcaggagaatcacttgaacccgggaggcggaggctgcagtgggctgaggtcacaccattgcactccagcctgggcaacaagagcgaaactccatctcaaaaacaaaaaaattacttaaataccttttttgttttttctctcagagacagggtctcactctggcacccaggctggagtagagtggcatgatggtagctcactacagcctcaaaaacctgggctcaagagatcttcccacctcagtctccccaacagccaggactgacaggcttttaacctctcagatcttatcaccttacttgtaacactggtataattagctcaaaggctccaacaatgaaattatcaaataagcacaattacctaatacttaaaagaactataaacttaaaactaccattttatgttgactaaattatatattttttaaagttcctaatacccaaagttcctgatatttcactaaagcttatacatctgtacactgccatgataatatctttctaggggaaaaaactgtaaaaagtacataactagagatgtctttttttttcttttttttcttttttttgagacagagtctcgctttgttgcccaggctggaatgcaatggcgaggtctcggctcactgcaacctctgcctaccaggttcaagcaattctcctgcctcagcctcccaagtagctgggattataggcgcccacaaccgcgcccagctaatttttgtatttttagtagagatgaggtttcaccatcttggccaggctggtcttgaactcgtaaccttgtgatccacccgccttggccttccaaagtgctgggattaaaggcgtgagccaccgcgcccggcccaactagagatgtctttatcttttgatccaggaaattacactcaggaatttttcttaataaaataaagccatctacagtcatgaaggcatcatctaccgtattacttattacttactaaaccaaataacactttgaaatgctttcctggctgggcacagtggcttaccaaagtgggaggctgcctcggcctccgaaagtaatcccagcactttgggaggctgaggcgggtggatcacttgaggtcaggagtttgagacctgcctggccaacatggcaaaatactgtctctattaaaactacaaaaataagccgggcatggtggcacacgcctgtagtcccagctactcaaggaggatgaggcagaagaatcacttgaacctgggaggcacaggttgcagtgagcagagattatgccaacgcagtccagcctgggtgacacagcaagactgtctcaaattaattaattaattaaaatgctgtcctaacaaatttaatgataaaattacatgaaattatatgctataatttcaatgtatcataaatacaggtacagaaaaaaggaatataaacaaactaaaattttgatttgctagactgtaagacagtgttttctcaatttaaaattgcacaagtcatgaaaactgaatgtataacttctgatctaacaattttattttctaaaaatactagtctctttatttttctttcagtttttattttaccgctgatctgtccagatttatgacactgaattaatttttttttttttttttgagatgggagtctcgctctgtcgccctggctggagtgcagtggcgtgatctcggctcactgcaacctccacctcctgggttcaagcaattctcccgcctcagcctcccaagtagctgggactacaggcgcatgccaccaggcctggctaatttttcgtatttccaatagagatggggtttcaccatgttagccaggatggtctcgatctcctgtcggcattaatgttctttaatcataaacctcacatgtatttaaatcctaatatctcaagtaggttcaggcatgactgttctgttcttcacttatgtgatgtttatcctctgttgatttctttaagaagggctcacagcaacatatttgttttgttttttgtttttttttttttttgagacggagtctcgctctgtcgccaggctggagtgcggtggtgcgatcttggctcactgcaacctccgactccctagttcaagcaattctcctgcctcagctacccgagcagctcacacctataatcctagcactttgggaggctgaggtgggcggatcacgaggtcaggagttcaagatcagcctgaccaacatggtgaaaccccatctctactactaatacaaaaattagccgactgtggtggcatgcacctgtaatccaggctactcaagaggctgaggcaggagaatcacttgaaacacagaggcagaggttgcagcaagccgagattgcgccactgcactccagcctgggcaacagagcgagactccgtctctaaataaataaataaatgttaaaaaaaaataaatgtaatggagccaggcgcagtggctcacgcctgtaatcctgacactttgggaggctgaggcgggcagatcacttgaggccaggagtttgaggccagcctggccaacatggcaaagccctgtctctaccaaaaatacaaaaattagccgggtatggtggctcatgcctgagggaggagaatcacttgaacccgggaaccggaggttgtagtgagctgagattgtgccactgaacaccagcctgggcaacagagtgagactccatctcaaaaaaaaatttttttttaatgtaatgggagttgaatctagaaaggactaaataattatcagtaaagtataaatcaaacaattattattgtaaggtacccatgtgttcaataagaatcaacatttacggctgggtgtggtggctcacgcctgtaaccccaacaccttgggaggctgaggcggatggatcacttgaggtcaggagttcgagaccagcctgaccaacatggagaaaccccatctctactaaaatacaaaattagccaggcgtggtggcgcatgcctgtaatcccagctactcaagaggctgaggcaggagactcgcttgaacccaggaggtggaggttgcagtatgccgagatggcgccatttcactccagcctgggcaacaagagtgaaactccgtctcaaaaaaataaaaaaaaatcaacatttacaaaaattttctgatacatgcatatatattctttgcagcactgcttttaaaaacaaactgaaaagagaaattgttatcgaaagaggatgaactaaactaattgtacccatataaaagaatatcatacaaccattaaaaatataaggcggatatttacatatatattcatgtagaaagtaaaaaaggtacagaaaaggtaaacagcttttttttagagacagagtctcgttctgtcatccaggctggagtacagtggcataattacagctcactacagcctcaagctcccaggctcaagtgatcctcccacctaagccttcccaagtagctgcaactacagacacatgccaccatgcccagctaatttctgtacttttggtagagacggggtctcactgtgttactgaggttagtcttgaactgctggactcaagcaatcctcccacctcagcttcccagtgctagaattacaggcatgagccactacacccagccagtttgttttgttgttacgatttttgggttttttgcttacaaatacacaaaaacatctaatgacatatgcaaattttttttcattaaagaatacaaaagagacttaaaatacaaaaagtgattcctacaaaaaagcagaaggtagtaaatagggggacaatttttctgtattgtttgagatttctccttccatgatatgtcatgatacatgtttctgcggaaccacacaactaagattaattacagtctctcctcaacctgaatacatccttagaaatgctggatgaaatacaaaattgtaggccgggtacagtggcttatgcctgtaatcccagcactgtgggaggtcaaggcaggtagatcacttgaggtcaggagttcgaaaccagcttgaccaacatgatgaaaccccatctctactaaaaatacaaaattagctgggcgtggtggtgtacacctgtaatcctagctacttgggatgctgaggcaggagaatcgcttgaactcagaaggcaagaggtaggtctacaatgagctgaagttgcaccactgcactccagcttgggcgaagagcaagagtctgtctcaaaaaaagaaaaaaaaaaagaaatacaaaattgtagaacaaatgggagaaagttgtaactttttaaatttttaaacaaactacaactgaaatttaccaattgcagactttggatcaaataagtacaagtacttcggcacaagtgaacccagaagcagggagtaggattcaacaagcaatgtgattttctaatattataaactaagatattgttaacagaggctttaaatgaacacacacgataaacaacaaaaaaactcatgggaaataactgcaaaattactctacttcaaacatcaaaataccttcaggcaaagttttctaagagctcaagaaaaaactgaagtctaaggaaatgttctttgccatcaatatatcctcagtacctcagacatgtctcccataactgacattaaagatgtgctaaattagtgaatgttataccactgttcgtagcatcaacacaaatctttagtacagatgcttccacatctaatcaacattgttatctaactagggcacaactgtaggtaggtgggaaacaaaatggcagagaagtgcctagcaggctaagagaaaacaattcatattgaacagaagggctagggtaaccacagagcccaggaaacgaaatttcaaaaatttccaagatgattctaatgggtaataaaatttcaaaaccactggactggacaaactttaagatctcttggctgggcacggtggctcatatctgtaatcccagcactatgggaggccaaggtgggtagatcactcgaggctaggagttcaagaccagcttggccaacatggagaaatcccatctctactaaaaatacaaaaaaactggccaggcacagtggctcatgcctgcaatcccagcactttgggaggccgaggcgggcggatcacctgaggtcaggagttcaagagcagcctggccaacatggtaaaaccccatctctactaaaaatacaaaaaattagccgagtgtagaggcatacacttgtaatcccagccacttaggaggcggaggcaggaggattacttgaacccccgaggtggaggttgcagtgagctaagatcacaccaatgcactccagcctgggcgacaacagtgagactccatctcaaattttaaaaaagcaaaaaaattagctgggcgtggtagcacgcacctgtagtcccagggagggtgtactagggagggtgaggcacgagaattgcctcaacatgggaggcggaagttgcagtgtgccgagatcatgccactgcactccaggctgggcgacagagtgagattctgtctcaaaaaaaaaaaaaaaaatctctcttccagatctaacagctaatgaatgattcagtacctttatctcaaataacaacttgcacattttccacaaaataaaagacagtttatctttttttttttttttgaaatggagtctcgctctgtctgtcgcccaggctggagtgcagtggcgtgatctcggcttaccgcaacctccacctcctgggttcaagtaattccctgcctcccaagtagctgggattacaggcgcccgccaccacatctggctaatgacagtttacctttaaatctactctaagatataaatgaattcaattttgttagaaaagtgaacttatagaactaccaagcttagggtccaaattaaaccaaaacacctaactagtttctatggtttgctgggctcgattttgttttaacgtatgtggcatcagcacagttactcaatgacttcatcataagtgctcaataaacatttactgaatagtgatgtacgaaatactagaacacacataacaaaaaaacctacacttcattctaaagcaagtgagaatttacccaaaaggatttagagaagaatgatcaaaatttcacctgctaagaaaaatactgaatctagtacacagaacggtttaaagaaagccaagattagatggcagaaacgttcagcaggaatgctactgcagaaattcagacaggcagctgtggtaccttgatctctggggacagccaagagaaggtaaatacaaaaaaactagccggacattgtggtgtgtgcctgtaatcccagctactcgggaggctgaggcaggagaattgcttgaacccaggtggtggaggctgcagggagacaatatggcgccactgcactccagcctgggcaacagagcaagactccatctcaaaaaaaacaaaaaacaaacaaacaaaaatatatatatatatatacacttaccaattactaacttttcctaaatccccatatcaatgtgtacaaatgaatctttttcatctctaccagattatccatctgtactctttcaaacatgtaataataatcttaaatagccagcatttgtccaaattcttctcatcaaacaaaaaatcctgtatgtgccatgtctacctaccaaaatttgcctgctatgtttctgtttgccaagagaatcatgtatttgatactggcacaatttaatacccgcaaattacctccaacactactgcttgcataagtaaaactaactttttaattttttttttgagacagttttgctcttgttgcccaggctggagcacaatgatgcgatctcagctcacagcaacctctacctcccgggttcaagcaattctcctgcctcagcctcccaactagctgggattacaggtgcgcaccaccacggctggctaattttgtatttttagtagagatggggtttctccaggttggtcaggcaggtctcgaactcccgacctcaggtgatccatctgccttggccccccaaagtgctgggattacaggcgtgagccaccgcgcccgtcaagtaaaactaacttttagtaagttgtgttcttttttttaagggaagttatctgggaaaagggagattttcacacctaatatgttgagttccaactttacctctaaactcctaaatggcactttacacagtagtacatgaatggtacacacacttaagggaaaaaaaaaatcataccacatgtacatgaaaatccatatttaccttgcctcattagcattaattggtgttcatgcctagctgcttccatttctgcctccagtttctctttggcttctctgatgtttctatcaacctgctcacgctgctgcttttccatttcatcaagagccttccatcgagatgcatactcaaattcaaatgtcccaggttgagcaaaacgtggtggttgttctctttccctaaattaacattaaaacatacagaaatgtatgcttaaaaggtaaaacaacaacaaatgagaacaacaagcacttacaatgtccaagacaccgtgtgagacaccgtgtctacatgaattacctcgtgacaatattgtgattacaggcctgagtttaagaactgcccaagaatgttcaactaataatggaacaataattcaaacttacacaatctgatgccacaacctgcattctcctaattattacctgcaaaatttctgcttttggaggtttcattttctggttttcagtcaacaaaatactttacaggccgggcgcagtggctcatgcctgtaatcccagcgcttcgggaggccgaggcgggcagatcacgaggtcaggatatcaagaccatcctggctaacgttgtgaaatcccgtctctactaaaaatacaaaaaaattagccgggcgtggtggcaggcacctgtagtcccagctactcgggaggctgaggcaggagaatggcatgaacccaggaggcagagcttatagtgagctgagatcctgccactgcactcctgcctgggtgacagagcgagactccgtcccaaaaaaaagaaatattttacaaaggaaagtctggaacacatgaatatgaattaactgtctggatcagatgtttttctagtaaaaccagctagattttactgagcgttatgtgccaattaattgggtaggccccaaaaatcaaggcctaacttactaccattgtagttaattatttattacctctttctcttgatagactttaaactcaattgacgacatcaaatgtggctgttaaatgctgtaccaccacctcaagtacctagagtgcagtatatacatttaatatacatttcttgaataaattaacgaattaccaaataaagggctatgaatatatttgaaagtcttcatttttttcatatatacatatatatgtaaatatttattttagagacatataaaaaatatgactgatctcaaactcctggcctcaagtaatactcattcctcagcctccaaaagtgcaaaattacaggtacaagacaccacacctggtccccagtcaatttttttttcacttttttatttatttatttatttatttttgagacacagtctcacagtattgcccaggctggagtgcaatggtataatctcagctcactgcaaccttcgcctcccgggttcgcaccattctcccgcctcagcttcccgagtagctcggattacaggcgtccgccaccatgcttggcttattttttgtaatttttagtagagacggggtttcactatgttggccaggctggtcttgaactcctgaccctgtgatccacccatctcggtctcccaaagttctgggattacaggcgtgagccaccgtgcccagcctttcttttcacttttaagaatttttgttgttggaggtgttgctttgggtttttctgagatagggtcttgctcagtttcacaggagtgtagtggcacaattaagactcactgccgagactgggcacggtaggtcacacttgtaatcccagccctttgggaggctgagacaggcggatcacaacaccaggagttcaagaccagcctggccaacatggcgaaaccgcccctctctactaaaattacaaaaatcagccaggcgtggtggcgggtgcctgcgatcccagctactcaggaggctaaggcaggagaatcgcttgaactcgggagacggaggttacagtgagccgagattgtgccactgcactccagcctgggcaacaagagcaagactccatctcaaaaaaaaaaaaaaaaaaaaggctcacttgccaaatcaacctcccaggctcaagcagtcctcccacctgaggctacagagcacctagaactacagaggcatgccaccatgaccagctaatttttgtattttttgtagagatgaggtaccactacgtttgttgcccaggctggtctcaaactcctggaagcaatgcttctgcctcccaaagtgctgggattacaggtgggagccaccacacccagccaactttcaagaaatttctgcataaatatcttcaattagtctcgcctataacagcctgtatttaaaagtactcatgggaaaacaattcccactccatgaataaaagcatagataccttgctataaatgtaaattttaacttttattttggggtagggaggtgaggaggggtgggtatgacaaatctaggagagaagaaggctgtcacagagggaaagatgtaataacaagagagggaaagatattcagaagcatgtgaagaaaaatcaaagacagccatgatcctagggactctatatctgaaaaccctacttggatttttttctttttaaagcactgactggaaagtgggaaagattgggagaatctaccaaccactaatttttctaaaagaattgtttactggtcagcagttccaaagtcaaagactgactatatttttaaattatttattttctttcaaaggaaaaaaaaaccactgaaataacatgattttttgaaggtgcaagtgaatttgaattttggcttttttgctttgtgagcattttctttttctttctttcttttttttttcctgaaacagtttcattcttgtagcccaggctggaatgcaatggcgccatcttggctcactgcaacctccgcctcctgggttcaagcgattctcctgcctcagcctcccaaatagctgggattacaggctcctgccaccacacccagctaattttttgtagttttagtagagacggggtttcaccatgttggccaggctggtctccaactcctgatctcaggtgatccacccactttggcctcccaaagtgcagggattacaggtgtgaggcactgcgcccagccttgtgagcattttcttctgtgaataaatctaaatctttagtaataaaagtgggaatataactaactcctttttttttttttttttgagacagtctcgctctgtcacccaggctggagtgcagtggcacaatctccactccacctcccggattcaagcgattctcctgcctcagcctcccgaatagctgggattacaggtgcacgccaccacgtctggctaatttttgtatttttagtagagacagggtttcaccatgttggccaggctggtctcgaactcctgacctcaggtgatccacccacctcggcctcccaaagtgctgggattacaggcgtgagccaccacgcccagccataactagctcttaagttttgctgatatcattaactatataaacaaatattgcctataaagtctattcttgttaacaaccttgtacttctagttctctaactcccaaatccaaacgtatgctttatttcaaatttgtaatggtgacctataacaaggaaaaagttaagtgaagaggaaatcacaggaaccctttaaaaaaaatggcattgtggccaggtgcagtgcctcacacctgtaaacccaacactttgagaggccaatgcaggcagatcgcttgagcccaggagttcgagaccacgctgagcaacatgacaaaactctgtctttacaaaataattaaaaaatgagacgggcatggtggcccacatctgtagtcccagctacttggggggtgctgaggtggaaggatcacttgagaccaggaggtagaggctgcagtgagccatgaccatgccattgcactgcagtctgggcaacagggccagaccctgtctcaaaaaaaaaaagaaaagaaaagaaaagaaagagaaatagcattgcaaaggaaataagaatagatattaattaggctgggcatggtggctcacgcctgtaatcccagcactttgggaggctgacgcaggcagatcacaaggtcgggagttcgagaccaacctggccaacatagtgaaactccatctctactaaaaatacaacaattagctgagcatggttatgtgcgcctgtagtctcagctacttgggaggctgaggcaggagaatcacttgaacctgggaggcggaggttgtggtgagccaagatcgcgccactgcactccagcctaggcaataagagagaaactccatctcaaaaaaaaaaaaaacaatagatatgaattataatcaacgctaatgctaatgcttcctccctgaaatactctcctcccttgcttccaggacacagtctgatggttcttccccctattccaatgaatgaatgctcccttctcagtcgttattgattccttctgatcttcccaatctctacacactgaagaactccaaggttcaaggtttggtcctttgactttaaaatatcatgttcataaatccagccaggacagttgctctaaatcctagttataaatccaactacctgcttgactacactgctagcacctagaacagtggctaacacaaaggcactccaagttttatttatctaataaacaagtgggccgggcgcagtggctcacatctgtaatcccagcaccttgggaggccaaggtgggtggatcacccaaggtcaggagttcgagtccagcctggccattatggtaaaaccccgtctctactaaaaatacaaaaattagctgggtgtggtggtgcacgcctgtaatcccagctactcagggagggtgagggacaagaatcacttgaactcgggaggtggaggttgcagtgagctgagactgcaccactgcactccagcctggatgacaaagtgagactgtctcaaaaaataaataagtaggcctttgagcccctatgctcaggcccactcccagactgtggagtggtactttcattttcaataaaacccttcgctccttccttgctttgagcattttgtccaattctttgttcaagacgccaagaacttggatactctccaccgttaacatattttggtgagccagccaggaggaagagtcaagcaggttcactacggccactcagggagcgagaactcagaagcctggcatgctggcaaaagggtaaagaaaacctttttttttttgagacggagtctcactgtcatccaggctggagtgtggtggcgcgatcttggctcaccacaacctccgcctcctgggttcaagcaattctcccgcctcagcctcctgagtagctagaattacagatgcgtgccaccacacccggctgatttttgtaattttagtagagacgggggtttcaccatgttaggctggtctcaaactcctgacctcgtgatctgcccgcctcggcctcccaaagtgctaggattacacgtgtaagccactgtgcccggccctaagaaagcgttttatggtttgaatcttctggaaacgtcaaagacagtcagtcgccgggcatggtggctcacgcctgtaatcccagcactctgggaggccaaggcaggcggatcacaaggtcaggaaatcgagaccatcctggctaacacggtgaaaccccgtctctactaaaaatacaaaaaaattagccgggcatggtggcacgtgcctacagtcccagctacttgggatgctgaggcaggcgaattgcttgaacctgggaggcgggggttgcagtgagctgagatcgtgccactgcactccagcctgggcaatggagtgagactccgtctcaaaaaaaaaaaaaaaaaagaaagaaagactgtccttgccatccacaccacaacaaagctttgggaccttgaactttgggttcatggtctcacaactgagaagggtccctccacacttttggaactgtgcacccactggaacccttgacagaccatcaagcttcagatgaccatgcaacaaaggctccagccagttccaggcaaagacaccacccctagccatcaagaaactaccctgcctccattagatagagcagggcgagagttccgtgatccccaataggtagagactatgccccaagtcagcatgaagcagttacagaaaaaaagaccatcggtccctctgcctcccataaagatttatgaggatcacatctctaagtggagagatgaggcaggaaaatacagtctggaagcagggaacagaagaccaattcacaattcagctataacaggaaatatcctctccataggacatacaccgagtaaatgacttgtaactttacctcatcctcttcatttacataaggcataccccaagtagagggtatttaaactcacaaaaactctgtaacagggcctttgagcccctatgctcaggcccacactgcagagtgtactttcattttcaataaaacccttcattcctcccctgcaaaaaaataaataagtaagtgactggtttttaaaaatataataagctctgcaaaagtaattggagaggaaagggaggtgggacaggcagagaacagaactggaggcagtccatctagggaatgggactgtgaggccatacttgtgaaacatctggactgctattctaggacttttatttgatgtgttcgttgcacagctgtttgaaatgtttaataaagctttataaacttaaaaaaaaaatgcactcggctgggtgcggtggctcacgcctgtaatcccagcactttgggaggccgaggtgggtggatcacgaggtcaggagatcgagaccatcctggctaacatggtgaaaccccgtctctactaaaatacaaaaaactagccaggcatggtggtgggcgcctgtggtcccagctactcgggaggctgaggcaggagaatggtgtgaacccgggagatggagcttgcagtgagccgagatcgtgccactgcactccagcctgggcaacagagtgagactccgtctcaaaaaaaaaaaagtgcactcatataggcaatttatgtaaatatacttgtattattctaagtgaaaagggaaaataaacatacattttgaaaatgagctattttttgcaacctctaagagtttttccgctgtgccaggttatttaactaggaataccctgctctaccctggcacaccaaaaatctccttttaacctacaatagacttgaagcacaaaataaaacttaagaagtatttccagctgggcgtggtggctcacacctgtaatcctagcactttgggaggcctaggcgggtagatcacctgagatcaggagtttgagaccagcctggccaacatggcgaaaccccatctctactgaaaacacaaaaaaattagtcgggcgtggtggcgcacacctgtaatcccagctactcgggaggctgaggaaggagaattgcttgaacctgggaggtggaggttgcagtgagccgagttcacgccactgcactccagcctgtgctacaggagtaagactccatctcaaaaacaaaaaaaaaaaaagtattttcatgttatctagatttcatcgtttttctggcatgaatattattgacagtgtcctcctagtaccctccctgccccagttataaaagtagacatttctaaaaaaaattagtatgttttacccatataaaaaaagaaaactattagctgggcatggtggtgcgtgcctgtaatcccagctactcaggagtctgaggcacgagaatcacttgaacgtgggaggtagagattacagggagccaagatcacaccactgcactccagcctgggcgacagagcaagatactatctcaaaaaaaacaaaaagaaagaaagaaaagaaaactagcattccatgtagactagaccactctattacccagattatataaataaacagaacacctcataatccaatatttgaaaacaaatgtaatgaacacccttaatagtacagacacaaattatctattaataaaatcttacttatgatattgttgagttttctgcatcagcttctctggcaagccatcttcatcatcaaactgctccatgggttccacaatgactggacgaggggtcctggataggtataaaagcattcataaaaattaacacagtgccaagaattaataccgtcttaaaagaaatgttttataataataaagatatatacttagaaaatgtctcacttgagaaaaatgtctcagaagtatcatttgtactcataaaaatcagtcaacagccgaagcagtggctcacgcctgtaatcccagtactttgggaggccaaggagggcacatcatttgaggtcaggagttcaagaccatccaggccaacatggtgaaattccatctctagtaaaaatacaaaaaattagccgggcattgtggtgtgtgcctgtaatcccagctactgaggacgctgaggcaggagaactgcttgaaccccagaggcagaggttgaagtgagtcaagatcgcatcactgcactccagcctgggcaacacagcaagactccatcacaaaaaaaaaaaaaaatcagtcaataaacatttactgagtcagagagaggtgaatgtcaaaagccacaaaaagatgagtaaataaagcaacaattatgaaccagcataacggttatagttaacatttagaaagtataatgaaaacgaatttgtacctaacccatgttttatatgtgtggtcatcatcacagccactgcttcagctattgattgatttttatgagtacaaatgatacttctgagacatttttctcaagtgagacattttctaaatatatatctttatcatcaacatgtcccaccacctcaacccacccatctgtacccaccacccagtttccctgtatctatcagtattgttcagaaagttcttaaaaatgttggccagcaggaacagtggctcacacctgtaatcccagcactttggaaggccaaggcaggcggactacctcaggtcaagagtttgagaccaacatggccaacgtggtgaaaccccgtttctactaaaactacaaaatttagccaggcgtggtggcacacgcctgtagtcccagctactcaggaggctgaggtatgagaatcgcctgaactcaggaggcagaggttgcagtgagtggcgatcgcaccactgtactccagcctgggcgacagagtgagactctgtcaccaaaaaaaaaaaaaaagttaaagctgaaaatccgacctaaaacatttcggcgaagtggctcaaacctgtaattctagagctttgggaagcagaggcggggaagatggcttgagcccagaaattcaagatcagcctgggaaagatgacgagatcctgtctctataaaaaattttaaaattagccgggcacagtggctcacgcctgtaatcccagcactttggtaggctgaggcgggtggatcacaagatcaggagtttgagaccagcctgaccaacatggtgaaacctcgtctctactaaaaatacaaaaaattagccgggcgtggtggtgcacgcctgtaatcccagctacttaggaggctgaggcaggagaatcgcttgaatccgggagacggaggttgcagtgagccaagatcacgccactgcactccagcccaggcgacagagtgaaactccgtctcaaattaaaaaaaaaaaaaatttaaaattagccaggtagcatacactactcaggaggctgaggtgggaagatcacttgagcccaggaatttgaggctgcagtgagctatgatagagccactgcactctaacctgggcaataaggcaagatgtcatctctaaataaaaataaaaataaaagatgttagccagacaaaaagggaaaaagggaaggcagaagacaccagacattcaaggagaaaagctgggataaggaaatgacaagagtgggtaatgaaagatatgactagaggccctccttctttactgttttcttcagtaaaataggagaaaaggagagttcatggaggggaagaggaataagcagaatggatggcacactgatattaaaatttcctttgagatcggctcttcaccatgcaaggggcattaaaatctatttatactaccttcaaaacagtgatgcttcagagagaaaaaactaagctagagagatgaagggtttttggactccaaaagcttctcttacacataataccagagattaacacagactttagatcctaaatgtaagaaaagatacaaaataacttttcaaaattattactgagttagtgaagacattttaaggaaacagttaaagcaggtatggaatatcatggagtggtggaatgagattatagaaacctcagataaactgaataggaacccaaaggtaaagagacttaagatgtggtacttctaaaagtacccaaaaaggcccagggccaaaatgaagatgatgcattttatggaccattcatccgctggaagctatggcagggccacaaacatagaacagtaacagaatcagataaaaggtgcacctgagcagaggccaacaaagaaacaagcaaacccctccagtaacacaagaccatcccccttcagagaaacttcagaaacagaattaagagggaaaaatgaactaagcagatgatatgtcattcatcagaaatgacaaaagtatatgaagccaagggaaaccgtaatcagaattaagggaaaactctgacatctctgtactctcaaatatgttagagattttaacaaattgtaaacttttcacatgtaagtttggaccactagacaactcttacacagtgcgggagaggagaagtacagatttctaagagggaacttaatcgatacaaacaagtttataaagtctccctctaccactctatatatcatcttgctcctacaattccacttctgaagaaacataaaccagtgagcaaagatcaatcaggctgggcgtggtggctcacgcctgtaaccccagcactttgggaggccgaggtgcgtggatcacgaggtcaggagtttgagaccagtctggccaatatagtgaaatgccatctctactaaaaaaaataacaaaaattagccaggcgtggtggcacacgcctgtagtcccagctactcgggaggctgaggcagtagaatcgctggaacctgggaggcagaggttgcagtgagccgagatcgtgccattgcactccagccaggatgatacaacgagactccgtctcagaaaaaaagatcaatcacaaccacattcatctaattacacaacataaaaagaccaaggaacatgggtacgtattgtgtacaagggaattacttaagggactgtgtcttatttttatttattggaacacatgctaaaatgtgtttctatctatggtttcattgtacatacaccactccctatagaagctccctttgtccattttctgactcatcttgtttatttcactttcatctttaggtataaccaaaatttgttaaactcaacctaaggccgggcacggtggctcacagctgtaatcccagcactttgggaggccaaggcaggtggatcactcaggagtttgagaccagcctgaccaacatggtgaaaccccgtctctactaaatacaaaaaattagctgggtatggtggtacatgcctgtagtcccagctacttgggaggctgaggcaggataatcacttgaacccaggaagcagaggttgcagtgagctgagaccgcggcattgcactctagcctaggcaacaagagcaaaactgtttccaaaaaaaaaaaaactcaacttaaattctgtttaccataggtataataactacatttattcttttttcttgagacagtgtctcactctgttgtctaggctggagtgcagtggggcgatcacagctcactgcagcctcaacctcctgggctcaagatatcctctcgcttcagcctcccaaagtgctgggattataggcatgagtgactacgtctgtccaggttactctttttgcaaatataagtatataataagtacaaaacagatcaaaaagaaacaaatcaaagtgttcaaccataatgttaaatctgaagttactgcttgggtttttgtttttctccccattttaccaccaagtcaatcattagtttggttataaacttgaaggactgagagagagaggcttcgggactgaggccctggggtttacagcaggttatgagctgcatagcctttggctaggaggttcctgcgctagctgaagttttctctgaagttttctcatcggtaaaatgggatatcagtgcatcatagggttgttatgataacgaaagaagaaaggtagggcacttagcacagttcttggtaaagagagttcattaaatcaaagtgaactcggccaggcgtggtggctcacgttggtaatctcaacgccttgggaggccaaggcaagtgtatcacctgaagttaggagtttgagaccagcctggccaacatggtaaaaccccatctctactaatacaaaaaattggccgggcatggtggccgggcagcggctgtggtcccaactactcaggagactgaggaacgagaattgcttgaatccaggaggtggaagttgcagtgagcagagatcacaccactgcactccagcctgggcagcagactgaaaccctgtctcggaaaaaaagaaactgaaggtttttttcagggggtaagagagagaaaaagtatttcagtgttctttcaggcttgaaaatactaaaatttaaagtgttaatttatttacaaaaaaacttgaaaaatgtttcattgtgaaaaaacttaaatagcaagtattgcagaagaaacaaggcccctgaaatcctaacatatggagaggagctctgatcacatttttgtgaaaaccacttaagacttgcctttctgttggatatatgcataagtttacataaaatgaattacctatacatgctttttttcagatatccaatgtactcaatgtaaaatggcaccattttacgcactgcatgcatgcacaataatttttttaaccataccaactggtatacatctggggttttcatgttttctgtaattatatataacatcaactacgtatttgtgactgatctttcctcattgtggctgatcttttcttagaactgtggaaacaaggtaaaatatacagtactaaaaaaaacatggtgacttaagggctgggcaaggtggcttttgcctgtaatcccagcactctggcagactgaagtgggaggatcatttgaggccaggaattccaggttacaatgagctatgatcgtgccactgcactccaacctgggtaagagcagaacttgccttaaaaaaaaaaaaaaaaaaaggtggcttaaaagataatgcaatattttgcacatgtaatttcttttttttgagacagggtcttgttctattgcccaggctgccatgcagtggcatgatcactgctcattgcagcctcgacctacaaggctcaagtgatcctcccacctcagcctcccacgtacctgggactacaagtgtgcaccaccatgcttagctaatttttttatttttcttttgtagagatagggttttgccatgttgcccaagctacacataatttttaaaacgaagaatgtgtaatgatgatgacaatttatttctgcactgaatcacccttatagacatgtaccattttgtgatggtttttcattttagctcagttgcatatttataagcatggttgagaatagttgaatagtaatgataaaataattatcaggatgcagccacgacaaacatggtgaaaccctgtctccagtaaaaattcaaaagttagctgggtgtggtggtgcgcacctgtaatcacagctactcaggaggttgaggcacaggaatcacttgaacccagaaggcagaggttgcagtgagccaagatcatgccatgcactccaccctgggtgacagaatgagagcccatctcaaaaataataataataataataattattattattattattattaccaggatgacgatattaataaaatattttatgatggagaaaaaataaaatcactaggatctgataatgatatcttagatttacaaaatgacacaatagatccatgtggtaattttaagaaaagggatctaatttttttttttttttttttgagagacgggtctcacgacgttgctcaggctagtctcgaactcccgggctcaagcaaacctcagccttcagagtagctgggactacaggtgcctactactacactcagcttgttttaatttttttaatttttctttttgttcttttgaagacctctaagaaataaggaagtatcagtctttacaaataactacaaataacaaataaggaaatatcaatctttacaaaaaaaagaaagcaaaaaactaaaactggatccaattagcactgatagtatatcaagggttaatgttgctttcctaaaaagttaagtagcaatttatacttatcagcaggttttcctagataactcattattttcaacaggcaatggaaatattataatgtttttcttaaagaattttttttgtctaaaagtaatctcatttaatggaaagatatgataaagcaaataaaatgttggaaaaagtaatccctttcaaatataaatataaaataggaaaagtacaaaattatttttgtactcttctgcacaggaaaagtgtgcagaaaagagttttaaaaagcaagcctgcagctgggcgcagtggctcacgcctgtaatcccaggactttgggaggctgaggcaggcggatgacttatggtcaggagttcgagaccagcctggtcaacatagtgaaaccccgtctctactaaaaatacaaaaattagccaggtgtggtggtgaacatctgtaatcccagctattcaggcagctgaggcacatgaatcgcttgaatccaagaggcagaggttgcagtgagccaagaacatgccacagaactgcaccctgagtgacagagtgagaccctgtctcaaatcaatctatcaatcaatcaatcaatcaatcctaccagccaagagcggtggcttgtgtctgtaatcctagcactttgggaggccaaaacgagcagatcacttgagcccaagagttcaaggccagcctgggccacatggcgaaaatacaaaaagtaaaaaaattagccaagtctggtggcacatgcctgtggtcccagctactcggaaggctgaggtgggaggatcatgtgagcctgaggaggctgagggcatagtgacctatgatcgcattcagcctgggtgagagtaagaccttatctccaaaaaaaagctatcaataagaaatcgttagttaactgggtgtggtggtgcatgcctatagtcccagcagcttgggagcctgaggtgggaggatgacttgagcctagcaggttgaggctgcaacgagctgtgataatgccactgcgctccagcctgggaggcacactgagacattgcctcgaggaaaaaaaaagaaaaaaaaaaaggacaagaacaatggctcacacacttgtaatcccagcactctgggaggctgaggccagctgagacaggtggattgcttgagctcaggagttgaagaccagcctggacaaaatgacaaaatccacctctacaaaaaatacaaaaagtaggcctggagtagtggctcatgtctgtaatcccagcactctaggaggctgaggcaggcacatcacctaaggccaagagttcaagaccagcctagccaacatggtgaaaccccagctctattaaaaatacgaaaaaaaataaaaaattaaaaaataaaaataaaatggaaaagcaagatctatgacaatctgaagaaagagcattctctaaggaaagagaataagagcacaatctctgacaagattgtgttgtaaaacagcagatatagcacgaatttcagttttagtatcaatgcttaatagtcgaaagtaagttttaaaatgcttacaaatcagcaactaagttccatagagccaggaaacaaaattttttaaattttagggatcaattccctaaaccctaaattccctaaaccctaaaacatctgaatgatcccaaccaatagctgacagcaccatacaataagcaaatacaaagaacctaaatagccaaaaaaatttttgaaaaaataaaattggatgattatactacctgatttcaaagcttagggtaaatatggtaattaagcaagtacaattttggaactgacaaactggtcaatgaaacaaaaaagtacagattttttttttcctggtaacaaaggggaaatcataaattttttcaattaatggtgctggaacaactggagacctgcacggtaacaaggatttttacgtcacactcaaaatgtataaatgtaaaagctataaaatttctcaagaaaacatgagaaaagctctgcaatcttaagcaaagatcatacaaggacacaaaaagaacaaaccatacaagaaaaaaattgatgaaatttggacttcataaaatataaaaacatctgctctttgagggtcactgttaaagttaaaaaactttacagatgcaatggctcacacctgtaattccagcactttgggaggccaagacaggaggatagtttaagctcaggagttagggaccagcctgggtgacatagcaagacctcatatctactttaaaaaaaaattcaaaaaattagccaggcatggtggcacatgcctgtagtcctagctactcagcaggctgaggaaggagaatcatttgagcccaggaggtcaaggctgcagtgagccgagatcactccactgcactttggcctgagtgacagagcaagaccgtgtccccccccaaaaaaataaataaataaaaataaaagaaaatttaaaaacaagccacagactggcaggaagatttataatacagacttatctagatttcataattcagtaagaagacaatctgcccaattaaaaataacaagcaggggacgggcgtggtggctcacgcctgtaatcccagcactttgggaggctgaggcgggcggatcacaaggtcaggatatcgagaccatcctggctaacatgtgaaaccctgtctctactaaaaatacaaaaaaaattagccggacatggtggctggcgcctgtagtctcagctactcaggaggttgaggcaggagaatggcgtgaacccgggaggcagagcttgcagtgagccgagatcacgccactgcactccaggctgggcaacagagcaagactctgtctcaaataaaagaaaagaaaaaaaaatgaataagggggacatctaaaaaaatggacaaaaaattttagatatttcaggaaagatatataattggccaaaaagcacatgaaaagatgctcatcattagtcatcaggaaaataaaatttaaatcacaatgagattgcgctaaactaactagaatatctaagtctaaaaacaccaagtggcaactgggcacagtggctcacacctgtaatcccagcgcttagggaaaccgaagcaggtggatcacttgaggccaggagttcctgaccagcctagccaacgtggcgaaaccccatctctactgcaaaaaaaaaaaaaaaattagccaggcatagtggtgcatgcctgtagtcccagctactcaggaggctgaggcacaataatcacttgaactcgggaggcagaggttgtagcagccgacatggaaccactgcactccagcctgggtgacacattaagactctgcctcaaaaagcaaattaacaaaaaattaataataggctgggcgcggtggctcacgcctgtaatctcagcactttgggaggccaaactgaggtctggagttagagaccaccctcaccaacacgtagaaaccccgtctaacggccgggcgcagtggctcacgcctgtaatcccagcactttgggaggccgaggcaggtggatcacgaggtcaggagatcaagaccatcctggctaacacagtgaaaccccgtctctactaaaaatacaaaaaattagccgggcgtggcggcatgagcctgtagtcccagctactcgggaggctgaggcaggagaatggtgaacccaggaggcggagcttgaagtgagctgagatcgcgccactgcactccggcctgggggacagagcgagactccgtctcaaaaaaaaaccccgtcttactaaaaacacaaaattagctgggcatggtggcgcatgcctgtaatcccagctatctgggaggctgagccaggagaatcgcttgaacccgggaggcagacgttgcagcgagctgagatcgcgccattgcactccagcctgggcaacaagagcgaaaactccgtctcaaaaaataataataaaataaaataaaaataataaaaataaaaaataaaaacaccaagtgtgggtaaaatgtggagtaactagaagtcactcactcattgctggtaggaatgtaaaatgatacaaccaccacggaaaagaacttggtagtttcttatacaattaaacatacagcaatttacccctaaatatttacctaagccacatgaaagcctaatattcacaagaagccttgtaaacaaatactcatagtagctttattcacaatggccagtagttgtaagcaactcaaatatccatccatatgtcacggacaaaacatagttatgtccataccatggaatatgactcagccataaaaaggaacaaaatactatacacacaaagatatgaatgaaatctcataaacatatgctgagcaagagaagccagacacagaagaatacatactatatgatttcacttaatattagaaaacacaaaacttatttataaataagaaatagctatctaaggcaggtagagtgcagaataactgtaaaagggcacaagggaacttctgtggggtaacggaagtgttctgtatttttattatggcagtgtgttacatgagtacatatgtttgttaaaactcactgagctcagccgggtgaagtggctcacacctgtaatcccagcactttgggaggctcaggcaggtggattacttgaggtcaggagttcgagaccagcctggccaacatggtgaaaccccgtctctacaaaaatacgggccaggcatggtggctcatgcatgtaatcccagcactttgggaggccaaggtgggtggatcacctgaggtcagcagttccagaccagcctgcccaacatggtgaaaccccatctctactaaaaatataaaaattagccggacacagtggttcacgcttgtaatcccaactactcgggaggctgaggcaggagaatcacttgaacccagcaagactccatctcaaaagaaaaaaatacaaaagattagccaggcatggtggtgcacacctgtaatcccagctgctcaagtggctgaggaaggagaattgcttgaacctgggaggcagaggttacagtgagtcaagatcgccactgcactgcagcctgggcgacagagtgagactcgtctccaaaaaaaaaaacaaacaaaaaaaacacctcattgagctctacaacagaatgtcttttattattttattattatttttaattttctttttaaatagagacagggtctcactgcaactttgacctcctgagctcaagtgatcctcccatctcagcctcctgagtagctgggactacagcgcaaatagctgagactactgtgcactccaccacgctgcccccaagatgtttttatgttgttgttgtttttggttttgttttttaggcagagtctcgctctgtcgcccagtctggagtgcagtggcacaatctggactcactgcaacctccgccccccgggttcaaccgattctggtgactcaccctcccaagtagctgggattacaggcacgcagcaccaagcccggctaattcctcatatttttagtagagacagggtttcgccatttgcccaggctggtctcgaactcctgagctcaggcaatccacccgcctgggcctcccagagtgctgggattacaggcataagccaccgcgcctggcccaaggtactattttttttgagacaaggtcactcggtcacctaggctggagtagagtggcatgatctgggatcactgcaacctctgcctccagggttcaagcaattatcatgcctcagcctcctgagtaggtgggattacagggatgtgtcaccacgcccaattaatttttgtatttttagaagagatgaggttttgtttttttttttgagacagagtctgtcacccaggctggagtgcagtggcatgatctcggctcactgcaacctccgactcccggagtcaagtgattcttgagcctcagcctccccagtagctgggactacaggcatgcaccaccacgcccggctaatttttgtatttttagtagagatggggtttcatgccatgttggccaggctggtcatgaactcctgacctgaggtgatccgcgcactgaaagtctggggcttgagccactgcacccctgaggtgctttttattaatgtaaattaggtgtcaataaagctgattacaatttctgaaaggattaccttaagtttatagattttactttgtatatatgttcattaagttaaatgaaataatacaaaacactgcagagatttaaactctgaagtttgaagaaagtacatgactcttgactcctaccagtacacgaaaatttcttatttatattcactgaatatttactcaacacctacttaccatatgctagtatgaactgcaatgaaagacagaattccaaaacagagagaagcccatatgtaactggatagaagaaggacaagatatttaaaacttacgttgttagcaagaatgccccatcaccacatctttccagagcctttcgtgcaggaggttttgctgcaaactctacaaaaccttttcctgtagctctaccgcgatcatccacaaccacaacagctttctctactggaccaaactgagaaaatgcttgctctagcagctcattggaaacaactggagaaaggttcttgacagtcaaggctgctccatgtgtagcgaagcgaatccgtagaggtctgctcttgagaatggtgccgtccagctctgcttttgcaatttcagccagggttctggattcctttttaggaagaaaaaacatttttaaaagatgacagtaacagaaaaaattcaaaacagtgtttggcttctagggagaactaggtatctttagcaaatggctgacagggtcaatttgattttgtatcttttaactttggtatcacatggtttttaactattcaatgatcattttaaacattttaattaaaaggtcccaactccattgttttgttaaaagtaatcatttaaagattagctcttcataaggccagttaccaactattaaatattcaaagcaatatagttttaaaatctcctacatatattaagaacacatattaacaacttgactagaggctgggcacagtggttcacccctgtaatcccagcactttgagaggctgaggcgggcggatcacctgaggtcaggagtttgagaccagcctggccaacagggtgaaatcccacctctactaaaaatacaaaaattagctgggcgtggtggcgggtgccttaatcccaactacctgggaggcttaggcaagagatctcttgaacctaggaggcagaggttgcagtgagctgagatggcgctactgcactccagcctggtgaacagagcaagactctgtctcggaaaaaataaaaataaaaaaacaataataacttgactagaaactatcaacaaaggaataattctccataccctttatgtttttatctcattttttttttttttttttgagacagaatctggcactgtcacccgggctagagtacaatggcgtaatctcggctcactgtaacctctgcctcctgggttcaagagattctcctgccttggcttcccaagtagctgggattacaggtgcccgctaccacgcccagctaattttttgtatttttagtagagacggggtttcaccatgttggcctgaactcctgactccagatttgcccacctcagcttcccaaagtgctgggattacaggcgtgagccaccgcacccggcctgttttttatatcttaacaaaacatcccacctctctacagccagacaaatcaccttttctttttattttcatttctcttcaattttatatgtaaaaactgttagttcttgggtttttttttcaggggagggaggtgtctgagacagggtcttactctggtgcccaggctggagtacagtggcacaatcatagcttactgcagcctcaaactttggggctcaagggatcttcctgcctcccgagtagctgggtttccgggtgcatgccaccaagcatggctaattttttaattttctgtagagatgggggggtctcactatattccccatgctggtctctcgaactcctggcctcaaacagtcctctcgccttagcctcccaaagtgtaagattacaggtgtgagccatcttgccctagccaatgtcttcttaatgacttctcctgaaatactggcatgggttacacatttctcactattacatgaagagaaacaaaggcaacattcacgagctataatagttctcgccattatataaagtgtacatatacacttactataaactaaaaaatatgctcattgctgaaactacaaggtaagagaacttccttctactgggagaattcaaagttggtgtagaatatgggcagcacctaaaacaataaataaggaactggtaaatttaacagaagtatgtctttttcattgtgttatgggaactctccaaggacaactgaagaggctttatatgtatatgtaagaagaatacaaacatactgtcttatgaaaattgtcttaaggtcacaagagctctttattcaatccctaaaatgttcatgacagcttgaaattattgccctttattgcaaaaatctacctatagaattatttttacaaaaacaaatgaagttaccctttttagagatatagtcatccctctgtatccatggattcaaccaaaagtggatcaaaaatatttggggccaggcccaatggctcacacctgtaatcccagcactttgggaggctgaggcaggtagatcacttgaggtcaggagttcaagaccggcctcctggccaacatggcaaaacctagtctctatcaaaaaatacaaaaattagccggggcatggtggtaagcgcctgtagtcccagctacttgggggactgaggtgggagaatctcttgaacccagaaggcagaggttgcagtgagccaagatcacaccactgcactccagcctgggtgtcagggacagactctgtgtccaaaaaaaaaaaaacaaaaaaaaaaaagaaaaagaaaaagaaagaaagaaaagcaaacatttgggaaagaaacaatttaaaattgacaggcagggtaagggggctcacacctgtaatcccagcactttgggaagccaaaacaggaagaatccttgaggccaggagtttaagaccagcctaggcaacatagcaagacctcttctttattcctttaaaataaaaaaataaaatttaaataaaagaaactaaataggctgggcgcagtggctcatgcctgtaatcccagcactttaggaggccgaggcgggcagatcacgaggtcaggagttcgagaccagcctagccagcatagtgaaaccccgtctctactaaaaatacaaaaaaaaacaaaaacaaaaattagccaggcatgtggcacgggcctgtagtcccagctactcaggaggctgaggcaggagaattgcttgaacccgtgaggcagaggttgcagtgggctgagacagtgccactacactcacgcctgggtgacagagcgagactccgtctcaaaaaaataaatagacaaaaaaaaaaaataaaccaaataatacagcataacagctattcatacagcatttacattgtactaggtattacaagtaatctagagatgatttaaagtatacaggaggattgcatgggtaacatggaaaaacaatgccatttttacacagtataaggatttgagcatctacgaattttagtactggaggaggtcctagaatcaatcccccacagatactgagggataattgcattctaaacagtcgttttgtttattgcttttaactcactagtaacagtagtagcagcaagcacttaataaacacctaaaaagagatgggtactttcttacctaatacatcatataatccaacaactcttaagaggtagactttagaaacagttttgaaagtgagaatagggctgggcacagtggctcacgcctgtaatcccaacactttgggaggccgaggcaggagaatcacgaggtcaggagattgagaccatcctggctaacacagtgaaaccccgtctctactaaaagtacaaaaaaattagccggacgtggcagtgtgcgcctgtagtcccagctgctggggaggctgaggcaggagaatggtgtgaacacgggaggcggaacttgcagtgagccgcgatcgcaccactgcactccagcatgggtgacagagcaagactccatctcaaaaaaaaaataaaataaaatgagaataggaagaaatatgaagacatttaatggggtgataatatgtatattttgataggggtttgagttaaacagacatatacatttgtcaaaattcacaaaccagtggctaggcatggtggctcacacttgtcatcctaacactttgggaagctgaggaggagggatcatgtaagcccaggagtttgagacctgcctgggcaacataatgagagagaccttgtctctacaaaaaataaacaaaattagctgggtgtggtggtgtgtgcctgcggtcccagcaacctgaggggctgaggtgtgaggatcacttcagccccggaagtggaggctagagtgagccatgatcatgccactgcactctagtctgggcactctgtctcaagagaaaaaacaaaaatcaccaaccagtacacttaaaatgtgtaccctttactatatgcaaatttttttttttttgagatggagtctcactctgtcacccaggctggagtgcagctgcgcaatctcactgcaagctccgcctcctgggttcacgccattctcctgcctcagcctcccgggtagctgggactacaggtgcctgcaaccacaattggctaattttttgtatttttagtagagacgaggtttcactgtgttagccaggatggtctcgatctcctgacctcatgatacgcctgcctcggcctcccaaagttctgggattacaggcgtgagccaccgcgcccggcctactatatgtaaatttttaaaaccctaaaaaataatatgccgggcatggtggctcatgcctgtaatcccagcactttgggaggccgagacaggtggatcacctgaggtcaggagttcaagaccagcctggccaacatggtgaaaccctatctctactaaaaatacaaaaatcagcctgggctggtgtcatgcctgtaattccagctattcaggaggctgaggagtgagaatcgcttgaacctggggaggcaaggctgcagtgagcccagtgtgccactgcactccagcctgggtgacagcgaggctccatctaaaaaaaaaaaaaaaaaaagaggccaggcacagtggctcacacctgtacacctgtaatcccagcactttgggaggctgaggcgggtggatcacctgaggtcaggagttcgagaccagcctggccaacatggtgaaaccccatctctactaaaaatacaaaaattagccgggcatgaaggcgggcgcctgtaattccagctactccagaggctgaggtaggagaatcgctttagtccaggaggcgggggttgcagtgagccaagatcacaccgctgcactccagcctgggcgacacagcaagacctcagctcaaaaaaaaaaaaaaaaaaaaaagataacttttacataaaaattttcaccaaatggcgagctgtctctgatgtccaaaaaataaataaatgcatttataatgttcaaaatgtaatgattatttaacctgaattttaaggaaatttccatatttcattattattaatagtttgcgaat

SEQ ID NO: 156 - DNA, 93163 bp, Homo sapiens
taaattaggcattcagtaaaggtctctgtatttgttagacgtaaaccacaattttggccctcagctttttagcagtcaaaggaaataaaataatcatgattctctgcatttaaaagtataatcaccagccaaccaatggcttaggagaaatacaagttttcttggtactgaggccaaaaagatacatttttcattgttccatataatgttaataataacagtcaatttttataaggatcttagtatgtgtcaagagtgatgctaaatgctttcaataccttatgtcattcaattcccataattccatagggtgggtattatgagtatcacttttttttataaacaaggaaactgaaatacaagatgctaacttagtcattgaaggaaacacaattaattagtaaatgcctaatttgggatcctaacacagttctactgactccatagttattcttctaccacacagcttctaattataccttgatttactctcaaagtatctctgaatatctaacagaatccttcaatatccagtgtaaggtagtccccactattttctccctgccacatggttttgttttgtttttttcattgcacttagcactatccgaaattatcatgttcatttgtttacttgttttgttgtctttcttcgattagaatataaactacacagctgcaatgatcttgtttatcttgttccctattgtatccctagagtctgttgtactgcttagagttcagcagaaattaaataatttttttgaatgaatgaatgtttcaaggagcaagaattcagtgtccattcgaaatctttacacatctgagaagcccattgtccttgcttatttctagttccttacagatattacttacagattctcaagtctccatgacttatttatgctcctcaccagaatgtattgtttcctttaacttggctatttttaataatccagcttggcatagacttgattttatcaatttgattttttattttaaaagttatacttaacatatagatgacatcatcatttgtaatacatgaaaaaaaattttgtaattcattttcccacacacaatgactgctgattttttaaagcctatatccaaagaatttgcttagcagcccattcaagtagattttgctatacgctgcctaaaatttcctatttaaaaacagaccagcttcaaaaaaagaaacagaaatgaacttgatggctcaagtcacatagaaacaacatgtacttgttcaggttaaaaaccgtaattctagttgccatgttctcaggcaggaaaaataaacaaattcttaaataatgcagcttcactaggtcagcaataggagcatgaaataattaagggaaacttagcagtaagacagattcctcaccctggtcatcctaacacatattattctcagtattctctaagtccttcaggctgtcttggaatttttatcacctggctatcattttcagagaggagggcaaacatctctcacacatacacacacctcttcccacaattgtagaaattgtttgtgaacatttggcctatcccctcaaaaatgggcctttttattggaagttatttgctgctaacttattgtttcagtcaaaagcctaaaccatgtgaaaatgtaggccaaatggaaagatatctaaagttggtaatgttctcttgactttgctagactcaaagggtccaaatatgtcacctagtaaggaaagaaacaacttgagatatgaatattggctggattatattttcatccttcaaaaacaaaatttagaaaacgtcttaagtagaagattctgatcaatcttctttatgaaaggacaatgataaatagctatggtgacaacatgcgtgtttgtatttctgaagtcattctgacacaatgaatagattcaacagcgagaagaagcaaatatatttgaaatagttctcttaagataagcgtaaggaaaggatattttctttttaattaaagggtggagagttgaatatttcctatatttgttttctcttctaaagtattgggtgtttattgtgacactattgtgacacagcctttgcgttacgctgttggatttcttgtttagtttcataccgataactctattaccaatcttcttcaacctggttaaaggtttttattctgtcatcctgtgtctggaccactgaatcccctacatcaacatctttctttccaaactccaagaagcaaattgaaatctaatcctgcgcaagagaaagtgaagagatctccaaatctagaagctttgtcattaaatatttacactggcttagccctggaggtatttccttttggaactattcctttacttgttattgctgattccaagattctttgcaccccatcactagctatgatagataggaggagtgatggtcagaatctgtatcctaagtcactaccgtgactgctgcccaccccctggcttcccagaggatatagaacaccaagaacactctagactaaaacatcaccaggagacccacccttatcatactaaacactttggagaaaagtgaaaaacaagaaataagagtcaaggaggccagtccggcaagacgcaagagtttgcctctgtgtttacatttatttataaaaactttattctcccatagtgactgggaatatgatgattgagtaagacccattttttttttaatttgccaaaatcttcatctgaaacctattgctggtcttccttgacagacattttctaatgtttaggcttatattacttgttgccaacactgatccaaagaggcttcatatcctcaagtgtttgtaagctccagatcctcatctattccgctactggtttgagtcccagttatattaacgagttactttgatgtatactttgcctataaaatagcaataacatttctcttcctatagttactatttattgagtgttcactattcactaggtgacatgtaagagtattcaatgtgttttatcatttaatctatacacctctatgaagttggtaattttaatcctcccatttaaaagataatgaaggctgggcaaagtgactcatgcctgtaatcccagcactttgggagtctgaggctggtagcaggagtttaagaccagcctggccaacatagtgaaaccctgtttctactaaaaatacaaaaattagctgaacctggtggcaggtgcctgtaaacccagctacgggggaggctgaggcaggagaatcgcttgaacccagaaggtgaaggttgcagtgagctgagatctcaccattgcactccagcctgggtgacaagaacaaaactccatctcaaaaaacaacaataaaaaagataatgaaacacagacttaagtcacataaaaattagaggggaaacagcaaggatttgagccactgtattatgctatggctatttttgaattacttccaatgttttccccagtcttaccacttctctggtaagccgaatgattacctaagtgtgcataatatcttaacaataacaatatcttcacacagcttaagctaggaccttggcttattttgataatttctccacattcccccctagttctctcctttaacctgcagataatttctttctttttggtgcaagtatttaagaactgttgtgtgccaaggactatactaagttaaatgaaaagcttcgtgcttttcattttttgagtttttttaaatgtcagtagaaaccgtgttactttattaaaatactgagttttatttcacatgtcttaataatgtcacagccagatctggggtcttataccctcccaggaaaaaaaatgaaaggattagttaggaagcagactttgattgtcatgaaaatctaatatttggctgaaatcttttgagtggtcaagattgccagaagaatttatacaatgaagctcctacatttccatctgttccttctctgtgttggtcctctttccacttctgccacagtaatagcttattctattctattgtttccctctgtctgcattctctcacccactcaaacagtgttaacagccatgcatgggtctgtggatatctcccaggtctaaagctttggctgtgacctgtctgaactctagactcacattccaattgtagactagcactgggagttaagcttcttaactttgcccagggagagaaccttctagggacttttagcttttgtatttttcctaaaaaaagagaaagaaacacgttgcttctaccacctgagtcatagggatcacagtgagaaacctaagcattttgctaagtggtgccaatcccatcactcaggagcagggccaaatgccccgaaagcccagtataatcatccattagcagtgagatttttaactgaactattgaatagtaacaagatagtaagcatgatttacaggcacttatgattacagataaatagacaaagaaggaaagaaagaaaaggggacaaagtcattaacaaaaggcatacgggagaacagttcttaacaactggaaaaccaaaggcaattttagagagaactgaaagctccaagtaaatatttgctccagagaaaagatactatttttgtttatctgcagatccccctttttgacattattgtggaaattttggattaaaaatttttttgccaggcgcggtggctcacgcctgtaatcccagcactttggaaggccgaggcgggcggatcacgaggtcagtaaatcgagaccatcctggctaacacggtgaaaccccgtctctactaaaaaatacaaaaaaaaaattacccgggcgtagtggcgggcgcctgtagtcccagctactccggaggctgaggccagggaatggcgtgaacctgagaggcggagcttgcagtgagccgagatcgtgccactgcactccagtctgggcaacagagcaaaactctgtctcaaaaaaaaaaaaaaaaaaaaaaaaagttttgcaggctccaacataaagaggaacagcactgtccttcttcctcaaagataagttctgaaatagaatgttttgtatcttctaatcagaacattctctttttttgttctgtttactcctttggctattttaaatatttcactttacttaagatttaaggtctaagatctttgaaacgtacataatttgcccaaatgaaaaaaattagatcctatattacaattatatgaagaatttataaagaaagtagctttccctgagataagctcaccaaattctctcagtaatattaattgggcagttgcttagaaaataatactatattagatattgtcatcatttatttctccttctcaggatgagtggccttaaatcagtgactgtattgggaatataagtcaatatataaaatgtgaaagctactatacaatgaaatttttagcagctgttaaaagtgatgctgtacaatgatacttaacgacttggaaagccatccataatgtaaacataaaactaaaaaattacaaagcacatatatgcagatttcatacttttgtaaaaaatacatgcatacctgtacatagaaaagaatatatagagagagcaagattaccttagttatttaacagttaaggattttttttttttttttttgagacggagtcttgctctgttgcccaggctggagtgcagtggcacaatctcagctcactgcaagctctgcctcctgggttcatgccattctcctgcctcagcctcccgagtagctgggactataggcgcccaccaccatgcccggctaattttttgtatttttagtagagatggggtttcaccgttagccaggatgatctcgatctactgaccacgtgatccaccagccttggcctcccaaagtgttggaattacacgctgagccaccacgcctggctggttatggatggtttttatttccgcttttccttatctaaactttctaaatattctacaactgtatgaaaatgcataatttttggaattagaacaaaaatattactaagttattccctgctcattcactgcacctggagagcaaggcctaatgacaatcaattaaaccagctctcttaagacttgagtcatcctaatagtgaatgtgtatgatcccaaacaagcagatgcactgagtggtccagggttgtaacctcacacagacattgctgaggcttagcctctagcttttccagagtgcattccagcatcgtccttgctgctttaatagctagaaatggtgaaaagcaacagatggtgacagttatgactgtcaggatgccaagctcaagaacggaatttctacttcaggactattttgcaaggatacagtaatagctggggaaatctgagcataaagctttctgcaatgctagtctggcgattatataagaaggtgattatataagaagatcttataatttaataggaagcattaacattaagttaagagcagaacaaaagttcaaccaaacttctggagtagatcattgaatttctttttctaggctttcttaaaaataaaatctaactgaaagctgtattttattttttattagtatctgtgaaatggctattatggatcctttaagtcaactcaaatgattttgaatcctgggaatagattaagcaatcatcaatattcattgactagctattttgcatttgctattgaaaggttatagatacaaaacaagtatatttttaatggaatttctactctaggtggggagagaaaatgtaaaacgagatcatataatgggtaattaagtgttaaaattgcatattcaatcatattttcttgataatgagatgtactatttatttaattacaagcttttgaattgtgtttcttttggcatcaactcattctttcatcaaataaatagttatgagcccctatatcattgtggtcactggaaatacagcaggaacaaaataaaaaaatctcaacattgtggaacatacattataactcgggaagaaagagacataaaagatattagctagaagtgcttcataagtactaagaagaaaaataatgtaggcaggtggacataaatgtctttggaagctgtagttttaaacagtgtcaccctggctaggtgtaagacagtgccctccttctttcagtgatggcgtatgttcccaatgtttattttctttttggttttacatttctacttttgaaatttgttcctgaaaactatccaagctgtctgttaaaaatttaagtaggggccaggctcagtggctcatgcctgtaatcccagcactttgggaggctgaggcaggtagatcacttgaggtcaggagtttgagaccagctgggccaacatggtgaaaccccgcctctactaaaaatacaaaaaatttagctgggcgtggtggtccgtgcctatcgtcccagctacttgagaggctgaggcaggagaattgcttgaacccaggaggcgaaggttgcagtcagccaagatcgcaccactgcaccgtggcctgggcaacagagcgagactctttccaaaaaaaaattaagtaataaggtgaagaaaaaagtaggaaatttactgcaggttgaagtaaaaaaatgcaataagaaatctttcatcatctcagtgtccaaaacaactgcattctgttatttgacatttatttattaatttaaaaataattaatgagccttcattatgtgctagacacaagatttgcaggaagtatattattctaggtagaacagcaagagtaaaattcctgattcaggcaggaataggctcactgtcctgaggaagagagaaggccagagcagtttgcagggagtcaaggagaggtggagtggtaggagatggactcagagacacagggataggccaggtggtgtgctatgcttcccaaacctctgaaaacccaagtatcctccagaatgcttcctgaatgcattgattcctaggatccatcctagaactatggaatcagaatccttaggcaagagttctgggaatcttggatcccaggtgatgtaggatataggccatgggaaaatgtttgaattttagttcaatggcaataagaaggcagtcgtgaatgtgtgtatgtgtgtgtgtgggtgtgtgtgtgtggtgtgatatgatctgattcaaactttctgcagatcaccataacaaaaatgggaaagagtggatacagtgactagttagcagcatgttccaataatttattagagaaagaaaagcaaaaaatcagagataatagttttgttgttgccacaggcttgctgtaacaattatatgagataatactcgcatagttcttagcatactatcaatgttttatgcttagcaaaaaataatttacttatcactatcatgatatcttttgaaaaaaagctattcaattgttccagtctcacatggtcaataatattttcccactcacttgtgatgcctcccttatcattctttaatttctcatatggactcagattgctctatgatttctacttttccatttgtaaatttgcatgcatgtactttcagtagttgttgtttaaccaactttcttgtgttgcaacttttaaaatcagatttattctcttagggctttatatgcatcccatctaggaacttgggacaggtgttctgggactatatggaagcacatctgagtcacacctcacattacagtaggctttcgcatttcaccagtttagtattttggacttggtattatattattttgatcccatatacccttaacacatattaattcaaaaaatttcccaaagcctgtgtttgaatcatgctttctttgagtttgcccaccaagagcaagtcacttagctcaagaataagcctagacatctgcttctccacagctcaacacagacctattgtccctactatgtaagtaatcactgtcaagaagtatacaggctactgtagtttttcacaaaatttgagacttttcagggtcaaaatataaagaattcaataggttgtactaaagcatcgtgctcaatggcaaacagtctgaattttaagacatatcctagggatcttaactttctcctatgtcaggagaaatgttaaatgctgattgaaccatatctagagctaaatgtactacaaaagtgttggcatttgaaccaataaattttctccagtttgggttggatttgtcatcacttacaacaacatattcctcaacaatacatcttctatgacatggctgaattctgttgatatgtacatagactaagcccatccttcgggtaatccactacacaaatataaaattataattaaaccaatttgtctattgaaaaagtatccaacagttatttatccacatcacacagtaaatgctacagaatttctttacagtggcaaagcaatgagaaagccggactttcaaagcccttcacataatgtctagagattatcactttacttataagatgaatccaaaaggtagtcaacagcagaacaaagctgaggcatgccataaacccgagtttagaatgtaattaaaacccatagctatcacacgtttttggatttaatagctttctaagtcaaatacctgacaaaaagtatttgcaaagaattttctgtgtcacagaaacaatagaatgtctgtctatatgttgatctgggtgagtggtgagcaagacaagaaattttaggattctaggatctcaaggagaggatcgcaagcccctggaaactcatcatcttcctatgtgctcacagaatgcttcctgcttccctaaaaactgcctctgtatcctctcctcccttctccccccgcttctttttcccttctttccttgcctcctttccttctcctgctgctcttcttcctgtttcttctcctccatcttctcctttcctttatttttcttacccatgagtccatctcacagagtaaatcataatcttcccatttccatgccgtttcactgatgtcaaaaaccaccccttatattcccaagccttactaatcctcagtttgctcagatttctgtccaggctagaacattcttcactcagcagcctatgctgaactgaaatggcctgtagttgctaccattccaccattttcacttgcacctctgggttccctccttcctggtgttgtggccttgtgtcttgacaaatatcctgaggatccagtgacaagagctatggattttacagcatactttcatctaaagcggtatttttttcctcttaccatagtactgaccttgaggcattcaatatcttctctacattgtacttgcacagaaatcctaataacagcttcttaattgagttccggaacatagttagcattatttgggataaacattctaattgtgttgtactctccttgtaacaaataaactataaattttcctgattactaataaaaagaagaaagagggaaaaaattcatttgtggataaatgctcttatgaaatgctttgcggtggcaattgggaatcaggaagggaggagagacacaactttcatgccctttttaaaggtagcattctaaaactcattgccaatgatagttgaaacaagaaagaaaaaagtattggaggaaaaatgcttgatccttccttctgagctaggaagtcttagaagttacatataaagtttagaggttgagtgtagctttttaccctggctggaaaaaaaatgcctataatttctccagttcaagacactgatagtcagaacatggtctatttgagtataaattaagtctcaaaataattcttagtaccactgcaatatccctcaaacaagaaggtctgcattgatgtatatgttttatactcatgtacatatgataagcacaaacacacatcaattattccattaaagtcattatgctgccccagaatatatcccttgcttcctgtatgccccatccatacatccattttctgtatggaatgggtcttcaaatcagctgacatttaattgcatcacccctttgctttttgaggaagctaaacattattgatttatttaaaaaataaccctgcctccccagttttgctgctaaatcatcatgcacataagtaatctaagtggattgcaggaaacattaggactggcaattggtgttgccagctaccaaagccacagcatggtcagaggctagggaaagctaatgcagcaaaattgcctattgcctctatgtaatcatcaccccaaaggaaaagcacagcttcttcatcaatctccaaaccacaaataagctgaaagtgaaatgacctgccagaattcctcattggtgccttttattgtccatgatattaaattaactagacagtacatgacattacaagatagaacaagcctcttgaactgtaattcacagtgactttaagagttgatgactatgggtatatgatggtcactaaggaaatatctcccatgagccctagcattaacaggagcatctccagatacagagacatcattaacatcatttatcttcactgaatagacagagtacatgactttcaccttcagaacatctgctactcatgtaaatgcagaaaacttgttcaagtatttcaggatgccaagtgacccacatattttctcttaacaagagttcatcttgtgttcttagcttatgatttttattgaattattgatatttccctctggacattttccaagcaaaacaagagactgtatttcatttgtctctgtttccagatatcccaaggggaaactagatcataataaatactgagtgtatgctagctgaaaacattgacgaatggaactttgattctcaatattaagtaaagtatactatatgtagtaggttaaaaaaataaagaaaaaaaagaagcttgttagatttaattacatttggtgcatagaggagttgccaaaatgcaaacatggtttcattgaattatcttggccacacaaatcaactcatttgattatattttggagcagagatgcaataacaaccatttaactactgatttgtagtttcaatgtggatccttctataatgatgttaaaccagagagtgactgtagttcaaatagggtgtcaacctcagtatgtatttaaactatgataacctccacaatttggaaacctctgacctgggttatacaagcaagggaactttaagaacataagcaatgggatcattgtatcacttttattaataaagaatggttattattcagtaatatcaaaaatgttatctatcaattactcccaactcattttatttgctccagtgacagaaaactactctccctctaccacacctcccctttcagttgtcttatttattgtaatttgagtcaagtgaccagaggatcttcaataagtattatttatttacacaggctgagactaaggcctatctgcttaaaacagattctcacagaaggtaggaggctcagtacaagatataatcaactataattgtaaggccttcctaaagtaatcttttattcaaatatttattaagcatctaccatgtaccatgcattctgctatgagcggaggatacagacaagttttctgatttcgtaagaggaagaaaacagacaacagtcaagtaagaaattagaagtaccacagaataagtgctgtggtacatacccgttgggattcattgataactattcacaatcagtgtttttcttttttcaagcatcaatgacaggaaagaatcaacatcagcctcagcatcagtttaacatactacttaccaccacaattacatttgctgctgggattgggagattttccacttcaagatcttgaccatccatggccagcagattgagagacgggtcatatgcgggtctaggaaatgctgaattgacaatctggtggcgtttgcttacttgagcttcggaagaggaatggtagctatgtctgtagattttttgtggggctatatccaggctcttctcaatgtcttgtgaatgcttataaatgaataccggcttcccactcttcttctgattaattgccaaaaaatgatcattgtttcctgaaaagcaccctgaaagagggaagaagcagaaacaatatcaaagaccctattcagtaagagaggtagatatatctgatgaagaggattaccctttcttgagaggctttaagacttgtgaaggatttaggttagtctccatatttctttgtctgcttcatgatcctcaacaaatagtatacacctggtggtatgaaggcctctcaaagactttaggtggataaaagtgggcgtactttgaaaaagttctatttttcagatattctgatgccacttttactaagaaatttcctcctttatctacacccatagtttcaatacctacttgggcttctattcctggatgtcctatctgctgctgaaattataaatatttttatcatatttaagctttccttaaatataagcatttcctacaattcttatttcatacttattgcttgtattacaatgaacagttttcttcacgcttacagagtatttaagctctctgaggtaagaaatctgagtgtacttattgtggtagcaactttcagtagtccaaacaatatccatcgtctccttacttgtgtaagtaatatggccatctagatagagactacatttctctcagtcttccctgcaactaagcattgccatttgatcaagttatagctattggaatgtgagtaaacagatgttagcagagatgtgatatggccttcctttctacatttcctcttttgtgctggctgaaatgcagagagtctggtaggagcatgaggtagaaaccatgtgtcaaagatggtagagcactaagacaaaatattctgatccctgatgaaagtgaaactaccataccaacctcacagttcccactctgatttttagagagaaaaacaatattctattgttttacctgctattattttaagtatctttgttagagcaattgaatttatttagtaacaaatacattcatctttatttcttctgttagataaatattcattgcattgaataatggcttctcctgtttgctactggccacaggaggaaacagataatacatatgaatcaaaaagaatattactaggtcaaataccagttagaaaagcaaacatgagatctgttttataacatagtccctagcaatggtaccccagattttcactggaaatgcttgtggtaacaagtgctgtccttagaaaattacttacctctttttacaagaattcttctccaatctcctactatttttatcttttacttcccaaatcatgcaagcgtctgtactttattttgtttttcttgcaaatttcagctatttacatgcccaaattcaatagaattatcatggcagatctagtactcatgctactgggcatttaaatttctctattttctcttaggtgagagacccacgttcatttatgcatacaatatacctttcccaaagcacagaatcacctctacatcagtggtattagaaaagtaaaccaggatgaaagtagtatattattttatttcttaaccccaaaggaatcacttcattgtagtgatatcagatagtttttcagagggaaagaagaaaattactctcctttcagaaatgtagaaactcttctaggacactacaatattatttagtaaattatttttagtaaaataataaatacacaccttgtggtcagaaagttcatatacatctaaaacattttggcaccattttccattgataaaacagtggtaagaacaacaacattgagatatcctgttctgaattccattatactacatatgttcttaatgagagtttcatttccaaatccgaggaactcatttaatatggagaaataaaatgtacaattatttaagggtcatcattgtccaatcatcatctttggcaaactatgggtggcttgattgttttaaaaaagttatggtcaatttagcatgctcggaactgaagacatgatgattagtttccattactatttcaggatccacataaaatataattcaagtggtccaaaaagataaagctactggtaacagaagatgattctcatactattatatcgtggaataaagcacttgggctaagaaaataacccatctttataaccccacatgaaagttgaagggatacgggtgaaacagagttgctgaagatgtaagacgtatatgttggtcacacaaggcttgatggaaagcaaagcctgtaaaaactagcaattcctctactctggattctctataaatagtaaataaaaagaaaaaagcagcttagaagattggggaaagtagatatcttaaaagaggagaaataactgacaaactgagtaaattacacaaatatcttcaatctttctttttatatattatcaatcacaccaagtcttttcagagccactttatctaaatagaaaagtccagttaataaatgcatgctaaaattggcctaccgagaaagggacaaaatctaagttgaagcgcaattgaaacacaatgaaaattttccaaccttatccacttgtctgtgtgaatgaacttagtcctgccttgttcctgagtaatgagttctaagatagcagtgtaatattaggtgtcctaccacaatcattaggtaagaaaaaaaatttcatagtgctgtccttaggttctctgtatcagagctacccgggacatgatgatacagtttcttagaccccagactagaactaccaaagcataatctctatagatgtagcctaggaatctggatttataatagaattcttatgttcaaactctgatgtttgaggaccactgacctaatgtctggaattggttttgtattttctatcctcaaatgctacctatttcctccttcacttcagctttatgaatatactcaagtaaaaattttggaaaagtgaagactgagaagccaagttatctattagtgaagccgtaattctaaagcagccaacaatcatagctcttttccctctctctcctatcaatacctgaccctggactcagatgcaggtgtagaagcgcaagaaactcacttcaaatataatgatatggacacatttaaagtgaaagagtgaaaagcaacatatcatgaaaacctaatcaaaagaaacctggagtgactatattaatatcaattcagcacaaagaaattcccaaggataaagagggacattacataatgatggacatatgatgcaatgtacataagaatacataatattcctaaatatatatgcatcaaaaatgagcttaaaattcatggagcaaagctgacaaaaatgaaaggagaaatgggaaaattcacaattatcattgaagattttaactgttccctctcaatagtaagtagattgaggagaaagaaaagaagcaaaggcaaggttgtaaaagaacaccaccatcaaccaactggatttaataggtgtttatagaacacacaacccaaaacaccagaatacacaatcttttcacgttcttatggggtattcatctagacagatcatatactgggccataaaataacacatgttgaaaactgaaattatacaaggtatactctttgaccatgaaggaattaaactaggaatcagtaacagaaagaaaagaagaatatttccaaaatttggaaattaaaaaaacacatttctaaatatccatgggccaaagagaaagtcacaagacaaattagaacatattttgaactgaactaaaataaaaatataacatatcctgaatggtattgcctaggttttcttctagggtttttacggttttaggtctaacatgtaagtctttaatccatcttgaattaatttttgtatcaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctgtgttctgttccattggtctatatctctgttttggtaccagtaccatgctgttttggttactgtagccttgtagtatagtttgaagtcaggtagcgtgatgcctccagctttgttcgtttggcttaggattgacttggcaatgtgggaggacttcatgtctaaaacaccaaaagcaatggcaacaaaagacaaaattgacaaatgggatctaattatactaaagagcttctgcacagcaaaagaaaccaccatcagagtgaacaggcaacctacaaaatgggagaaaatttttgcaacctactcatctgacaaagggctaatatccagaatctacaatgaactcaaacacatttacaagaaaaaaaacaaacaaccccatcaaaaaggaggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaattagttcaaccattgtggaagtcagtgtggcgattcctcagggatctagaactagaaataccatttgacccagccgtcccattactgggtatgtacccaaaggattataaatcgtgctgctataaagacacatgcacacatatgttggttgtggcactattcacaatagcaaagacttggaagcaacccagatgtccaacaatgatagactggattaagaaaatgtggcacatgtacaccatggaatactatgcagccataaaaaaggatgagttcatgtcctttgtagggacatggatgaagctggaaatcattctcagcaaactatcacaaggacaaaaaaccaaacaccacatgttctcactcataggtgggaattgaacaatgagaacacatggacacaggaaggggaacatcacacaccagagactgttgtggggtggggggagggggaagggataacattaggagatatacctaatgctaaatgactagttaatgggtgcagcacaccaacatggcacatgtatatgtatgtaacaaacctgcacgttgtgcacatgtatcctaaaacttaaagtataataataataataaaaaaagagaatccatatgtagaaacctatgtagataacctgaattaaagcaattagagaaaccttaaaaaaaaaaaagccagcctagtaaatgagtatagggattatgaagtttttgcttgtcttcaaatttctaattcaaagtgatacttctataaatgtgaacccaatgcattatcttgtcaatatatgcacttttaaaaagacacctcattttattttagttgttctcttatttatattgtttttctacagtttatgtttttcttttcatcatcatttagtctttttttaactccttgatactctttatataattatttttacatattacatattacatattcaataaatatatatattttaaaaatccttaacctataaatatatatatacacacatatatatgtatatacatatatataacatgatttgtgggatgcagttgaaacagtgcttaagaaaaaattataccattaaatggtctcaaatcaaaggtctcaaatcaaaaatataagcttccactttaagaaacaagaaaaaagagtaaaataaatgtaaagaaattaaactgttaaaagtagaaatcattacattgaaaatacagagagagaaaaacgagtgaaacaaaagctagttatttgaaaagattagtaaagctgataaaactctagcaagactgacagagaaagagagaaacacaaatttctaatatcagaaatgaaaggagggatatcattacggacttagcaagtgtaaaaatgtataaaaaggaaaataacaatcctctacaaataaattcaacaatttagataaaacgatcaaatccttaaaaccacaaactattgaaactcaccaaagatgaaataaataatctaaattgtgctaaaattataaaagaaatgaaatttctacttaaaccttttctgaataaaaatcttcaggaccaaatggcataattgaaaatgtctaccaaacacttaaagaaaaaataacatcaaatctatataatttctcccagaaaatagaagggggaacattcaccgaaatcatctgatgaagccaaaattaccctgataacaaaagcagatagagacaatcctaaaaaaaaacactatagaccaatattgctcatgaacacaaatgtaaaagtcctcaacaaaatattagcaaattgaatgcagaaatacagaaaaagacatatgccactaccaaatggggctgattttcctgggaatgtagggctgcttcaatatttgaaaaacaatctacataacccactctactgagagtctaaagaggaaaaataatagtcatactaattggtggaaaaaactatttgacaaaattcatgtctattcatagtaagaaaaaattaagtaacctagaaatagaagagaatgttctcaacctgataaaaggtacctacaccaaaccccacagtacacattatgcttaatagtgaaaaactgaatcttccccttctaagacaaggacaaggcacccataccattcctatataacactgtattaagagtcctagtcagtgcaatgagacaaagaaaaggagcaaaagacataaaactgttctatttgcagatgacatgattgtctatataaaaaatcccaaggaatttaccaaaatcttcctagaactgacaggtcagtttagcaaggtcacaatatataaaggcaacctacaaaactaaatggcatttgtataagttagcaatgtataattgaaaactagaagtaaaaaaaacaaactgacccaaaaataaaatacttaggtataaatctaacagaacatgtgcaagatacatatatatactgaaaactataaaatgttgaacaaagaaatcagagacgacctaaataaacaacaaatatactatgttcatgaattagaagactctacataatgaagatgtcaatcatctccaattacaataaaatatcattagaattttttgtagatgtagatatgctgattctaaaatttacatagaaaggcaaaataaatagaaagctaaaacaattttgaaaaaataataaagttaaaaaatactgctcaattctaaaacttactataaagctatagttattgaggtagtgtagtgttggcaaagaaatagacaaacagatcaatggtgcaaaatagagatttcatgcagaagcatgaaattggattcatacatcacaccatatacaaaaatgaattaaagatttccatataaaatccaaaacaataaaactactagaagaaaagataggcaaaaatctccacaacattagtctgggcaatgattttttttaaatatgaccccaaaagcacaggcaactgaagcaaaaatagacaaatgggattgcatcaaactaaaaagcttctgcacagcaaaggaaacaattaacaaagtcaagtgataacccacagaatgggagaaaatatttgcaaaccacacatctgataaggagttaatatcaaaaatacataaggaactcaaacaatgtaataccaaaaaaattaacccagtgaaaagatgggcaaaagatttgaacagatatttctgaaaagacgacttacaaatttccaataggtaaatgaaaatatgctcagcatcactaaccattaggaaaatgcaaattaaagccacaatgaagtaacaccacatacctgttagaatgggtttatcaaaaaagatgaaagttaagtgttggccaggatgggaagaaaggggaactcttgcacattgttgtgggaatgtaaatgagtacaggtggtttcttttccaaaatgcttgggaccagatatgttttgaattttggatttttttggatttcagaatatttgcagaatatatactaattgagcatccctgattaaaaggcccaaaattcaaaatactccaacaagcatttcctttgagcatcatgttggtatgcaaaaagttttctattttggagaatttagggttttgaatttttgaattagggatcctcaacctgtacagtcattatgggaaatggtatggcagttcctcaaaaaactaaaaatagaactaccatatgttccagcaatcccaattctgggtgtctatctcccctagattaaaatgaattgtcaaagagatgcctgcactcctacgttcactgaagcgttattcacaatagccaagatacgaaaataacctaagtgtccatcaatagacgaatgggtaaaagagcatggtactgctataaaaataggcacatagaccaatggaacagaatacagaacctggaaataaacccaactacttacagccaaatgatcttcgataaagcaaacaaaaatataaagtggggaaaggatatcctttgcaaaaagtggtgctgggatcattggctagccacatgtagaagaatgaaactggatcctcatctctcactttatacaaaaatcaactcaagatggattaaggacttagatctgagacctaaaactctaaaaatcctagaatattggaaaaacccttctagatattgtcttaggcgaggatttcatggccaataacccaaaagcaaatgcaataaaaagaaagataaatagttgggacttaatcattaatttaattattaattaatttaattaagcttttgcatggcaaaagaatagcagagtaaacagataacccacagagtgggagaaaatcttcacaatctattctatttttagtttttaaaggaacctctataccatttcccataacacatctgacaaaggactaatattcagaatctatacaaactcaaacaaatcagcaagaacaaaacaaacaatcccataaaaaaagtgggctaaagacatgaatagacaattctcaaaagaaggtatacaaatggccaaccaacatatgaaaaaatgctcgacatcactaatgatcagggaaatgtaaatcaaaaccacaatgcaataccaccttactcgtgcaagaatggccataatcaaaaaatcagaaaacagtagatgttggcatggatgcagtgatcagggaacactttaacactgctggtgggaatgtaaactagtacagccactatggaaaacagtgtggagatccttaaagaactaaaagtagaactactgtttgattcagcaatcccactactgggtatccactcagaggaaaagaagtcgttatatgaaaaagatacttgcaaacacacgtttatagcagcacaattcgcaattgcaaaatcgtggaaccaacccaaatgcccgtcaatcaacgagtgggtaaagagactgagatctatgtctatatgagatactgagatatataatctatatatatgtctctatatatgtatagctatatctatatatacacacaatggaatactactcagccataagaaggaatgaattaatggcattcgcagcaacctggatggtattggagacggttattctaagtgaagtaacttcaggaatggaaaaccaaacatcgtatgttctcactgatatgtgggagctaagctatgaggatgcaaagccataagaatgatacaatggactttggggaccagggagaagagtgggaggggggcaagggataaaagtctaacaaatagggtgcagtacatactggttgggtgatgggtgcaccaaaaatctcacaaatcagcactaaagaacttacccatgtaacaaaacaccccctgtacccccaataacttatgggaaaaagagaaaaggtagcatgtacatataatgtaatactattcagtcttataaaaggaaggaaatcctaacctttgtggcaacatggataaacctagaggacattatgctgagtgaaataaggtgggcacagaaagacaaatatcatatgatctcacttatatgtgaaatctagaaaagtagagagtagaaagatggttatcaaaggctgggacagggaatggggaaggaatgaggagttgttggttaaaggatataaagtttaagataggcaggaaaaacaaattttgagatctattgcacagcagggtgactatagtcaataatttattgtgtatttcaaaatatctaagagcataaatttgaaatgtctcaccacaaaaatgctaaacaagtgaggtgataaatatgttaattgtcttaatttaatcattttaccctgtatatctatataaaaacatcacattttaccccatacataaaattatgatctgtcaattaaaaataatgtaaatcaaaaataaaataactgctaaataaaatttaaaaaatgaattcagagaaagtattaccatttgatttttgataaaggtgaacaataaaggacagccttttcaaaattacatttaaagtattagacatccatatgtaacaaaatgaacatttacctaaacttcacactttatacaaaattaactaaaaagtttcacagatctaaatgtgtaatgtacaaactatagaacttttagaagaaaacatagaataaaatctttattacctaaggttaggcaaaggttccttggacatgacatcaaaatcacaatccacagagaaaaagataatctggatggaatcagaataaaaagaaatttgctctgtgaaagatactgttaagaaagggagaaagctagctagagagtgggagaaaaataattacaagtcacatatccaacaaaaggtttgtaactggaatgtataaagaactctcaaaactcaacaattagaaaacaaaccagtttaaaaatgggctaaagacttgaacaaacactttattaaagaggatacatgaatggcaaattagcaaatgaaagtatgtccatttctattagccaataggaaaatgcatattaaaaattgtgatatgatattagaattgctaaaatgaaatgtactaataatactggagaggatctggagcaactggaagtctcagaccttgcaggtgagaatgcaaaatggcaaaggcactctggaaaatggtttgacagtttcttgtaaagttaaacacatacttagcatatgatatagcaatttcacttctacattcttaccccagagaaataaaaatgtatattcccacaaatgtctgtaaacaaattttattagcaagtctattcataattgcccccaaatggaaacaactcaaatgtccttcaatgggtggatagataaactatgatacatctaaacaatgtaataccactcatcagtaaaaaaaagtgagctattgatccacacaacttgaatataaaaggcattaagttgagcgaaagaagccagtctcaaaaagtcactgtatttttccattacatgacattctcaaaagacaaaaaaatatagttatgaaatacagatcagtggttatttgggtgtaggagttggagacaaaaagatagtaggaagtttttttgtggtgagcgaactattctgtatccagattgtggttgtgatgacatgaatctatacatgtgtgaaaattcatagaactatacaccaaaaaagtcaataggttatactatgttttgtaagctacttttttcaagcgtaactatatcaaacatcttttctcataactaaatttaagtctttttcataagaaatatcattgatgaatttataaaaagtagtttcagtgtgttgggaagggacagaaagctaaatttaattgaaatgaggactgagtaggagataaagtagaaacaaaataagtggaaaaatcaagtttgggtataataagagagtgactatgtgttaccaggaaggaaagatagggttgagggatgtgtttttggtttctttttaagaaagtagagattttggcacatttaatcctcaaggagaaggagccagctaaaaggagtgatcagacataagagaatgcagctggaataattagtagactgaactcccccagaagataggaggagagaggacccagagtacaggcagaggaatgagccttggatttgaggaaggtatttatttcattataggtagaggggagggagattagggatgttaatgggtttggtgttggaagttgagaaaattatcttttgatggtgtctatattttctgtgtagaaggagatgaagtcatctcataagagagtgaggactagggaggaaagatgaaaggtttcaggagaatggagaggaattgaaagagttattgtaaagaaagttgatatgaaatacatggtaggatttcttgtcttcattgagagttcagtgacagttttccctacctgtgagggatagagtgtctcttacagaatgtttagtaagtagcttgccaaagatactaatctacatttaaaataaaagaacttttatcataaaaacaacatttacatgaaaataaccagtgagatttgatggtcataaaattgcacagttgaaattgaaatttcattctgggtatgaccttggtagcctctgaagagatctttaacaaaggaaagagaaatgaatgaaattacaatgtttagttagagtacattatgattcattatttcaaattcagtgttggttattcctgaatgcataaggtagaatggccttgtatacactctctcagaataaatcctcgcattgcaagtacttaagtcaatgtcaataacttgtgaaagaaagaataaaacagtggtctccaaagagacttgaaaaagtgaacaatcaaaaaaaggcttttactgtgtaatcattttttgaaaagacaatcattgttttgttaggaatgttaacaccttcttctctagaaaggagagataaatggatagcatcaagggcttcccttgagaatttatgcatgagaaatgattaggctcccatttatttgatttgttaatgcctctcaggaaaattaaaaatacataattgtagcaataaaagttcttttgggaaaggtgcctatttagtattgagaaaggaaagaaacatgctttttattaagaggaaagaattaagaaataaaggaaggacctagattctaatttaaatgacctcccaacttctctcttctcgtctgtgttagctcaccccaatgagcctcagtcttctcatcagaaaatgtaggtggtttttgcatatctacaactagattagaaatatatttcagtaaaaaagaagccacaattcagttagacagattttgcatggtcctgattttttttctaaagaaataagtttttccataaatagtataaaagacactttgggaacttacagaagcagggatttccagaaattctactctgggatgtaaggaggctaatattaaatctattatttagttgttctatcattctattggtaatagtaacaagagataaccagaatactaatctccagttaaaagtgtcaacagtaataacactaaaccccactgataaacattacagccttcccaaaatatgacaaccaatgttagttaggataacctcccaaaatacaacatatgctatatacaaagccagttttacagaattcagtttctgtgccttagttatgttccaacaatatatgcatatgtatgtatatatttgtatgtacacacattgttttgttttgtatcctgacaccaaataaccaatttgacaaaaatatttatccttaaactagccattttgttacaaaaagtttttttaaaaaaaaatcagtttctacgagatgacaataattaaatttgccaaaattataaacatggacccaaaaaacacgtggataaacttattaaaagaacacttccaaggctggtcccagtgcagtggtgtttacaactaattgatcacaaccagttgcggatttctttgttccttctccactcctactccttcaattgactagccttaaagaaaactaaaataaaattttaacacgtccttccaggactggtttttctaagatccagtctacacactggctactaagatgtgaaaatataattctaccaggaagtgttgtgacattctttaatattatttaaactctccacatatttgaacagtgatgtgtccaatacatctataataaaaataaagaaaccaatagcaaagtaattgttctgtttttatagtgctagctctgatcactgctatttaagagaagaacctgaatcccattagagtaagggatgattttaatcaccttgtaaagtttcctcacatgttttttcacatttcccaaaatattctattaggaaaagtggctcctccttccactgtcagcccagcataaatactctggatatcccttacttctccctgtttatccattgaaagttgagctgaacagtgtaaacctctatttgggagttacagaattgacaaccgtttcaggaaaaatccattgtctgctatttgctggtggtaaaattgcaatgaaaggggttcatgtttcctgatttttgcccagctttaatagagttatttttcatttgataaatatctattacagagtggaacataatacaattaaaacggtaccttgggacaatgtgactagacataagtcatgaagaaagaatgagcattaagaccttgggcctcagactctgctggaaaaagtgaaatgtgtgccagctgaggtatagcaatcagatgtcccccagtttctgaagtattgagtcaaaggatactgggaggagaggttgacaggagtgaatgctactatatgttaaatgttatacagccattaagagaggactatcaaactacaccctctgggaaaaggcagaaaaatgctcatatggctagaaagctaagactgcagaaatcacaggagttcagttctgtttgcactcactgaataatgaagtagtacatttagaaactaattctatacatcgttcattgttatacaaacagctaaaatataattgttttcaaataaagattagaaactatctccattgttttcatagcagagttctccagacaacttaaaaactgggctccaattttaagacaaaggaaaaaaaagtgtctgttttaagaataattctcatagcagattaggaattatattaaaacatagcaaaacgaacattagaacacataaatattaaaatctcaccatagtaatgatactacagagacattaatgcttatatattaggggaagaggaaagtgggtgtattagtccattctcacgctgttaataaagacataccagagactgggtaacttataaagaaaaagaggtgtaattgactcacagttccgcgtggctgggaaggcctcagaaaacttacaatcggcagaaggggaagcaaacacatccctcttcacatggcagcaggtgagagaatgagtgcccagagaaggggggaagtcccttataaaaccatcagatctcgtgagaactaacttactaccacaagaacaggatagaggaagccgccccatgattcaattatctccacctggtccctcccacaacaggtggggattatgagaactacaattcaagatgagacttgggtgaggacacagccaaaccgtatcaatggggaaagaggtctgtagctggccacttgaagagatccctgtcctggtctcccttgcctgtgttttgggatttgaggggcacttggtagaccctttcaacactgctattccatctcgttcttgctctttcatccaccatttgaaattaatggcactgggctaaggctctgctttctaatgattctttgaaaaatcaaaattaaggaagggccatataattaacagctattcttatctgaagtagatcagtgtggcacatcctttctgagaagagatctctcctggaataggaagcagcaactacccagtttagctgagggtggagaagaaagagaaaattggagattgaagctcagattagaaacatagttcccaagtgtaaacttcaagacatgaagggctggtggagggaggacctgaggggcgctgccagcagtgacagctgatgctgcagggtgaggtattgggtaccagaggcacaagacaggcctggactggcaggaattgatcctgcacccactgggaatttgctgcagactcagcaaaacttaacccaaggggagacaggacacctgattccctaattgtatgtgtgagaactctctttgatttcataaagtgcataccctcccccaccacacacacatcaaagatatgtggacaggattttcaaattggagtatgcaaattgtgcacaggcatgaagaatcactgtccagatcctcagcttttttctaaaatttatctgcttcagaatgtacctatagtcagggacacatttcatgctggcactcctttccggaacaaagcatttcatcaaactttacaaaaaaaaggtacacctgtaacttaatctgaactgaatttctccatcagggtagaaaaacttctttgagtctccactcaaaggaacaaaacaaaacattagtataagcaaagcctctgttaatcagggcccccttcacataaactcattgtaggatatcaaactttccctgtctagtacatatttctctaagactgaaagtcagcattagaagtggaatgttttggcctttgttggatgttgtggattcatatagtctgtagagtagggtagcagaagtgatgataccgcatgtcctacccaatccctgagactgacagatactttgtcagaagaaaggttgcccgtggtggcagtgcctctggtggttagaggttttttttctcttatatacttgttttgaaagcaggatttagtttcttcaacatgaacttgctaattatgagcatttaaaaatttataagacgaaggttttactagtattttaaaaattgggacatgcttatttgatcttcatagcatgtactcttcacaaatgaaggttttagagtgattttttttaataggtcaatagtcaatgtgcaccatttttctttttatattttcttttcattggtcttatattgcagctataggaaatacaggaccaatgaaagttttcacatgttaatacaactcctacaactactagtattgaatatagaatatattcagtgttccaggttccatgctgcagggtcttatacattagctttttaaatgggagaagatgggattcgaactcaggtagtcaaatcctagagcccaaatgtttttttgtttgtttgtttttattgtactacatgagttaaggcatatttttgttgtttctgaagtataagcatgccatttcaaaacatttttcaatcctaaaaggtaaggcaattatcttacaaaagcaccttgggtagagtttagcacatcaaagggatttaggaaatactcatttgttatctccttcctgtcttaaaaggaaatctatttgtcttttccatatgaaattcaatgcttgtcttgagaggaagactttttattatgtttctgtagcttcagttaatgctcagatttaggagttacaaataacatgataaaatttataatttaagccctctaaatatcaggcattcccagtttgaggaaataaaacaatcaaaagtaaccaatgaatgcctgatgggaaatcctgatgctctagaggtacagaggttcccagcaatgccaagagacatgcccaaatgcccaaggggaccaggcttgtgaggactcatgtgaattgccctagtgagcttcttaaatgtcatgaaattttcagaggcactgaaagagctgccagatgtgtctctggatttgcatagagaagtgaagcatcatgaaaaagtttctataactgaattctgagttttcttgtgaactatgggtctccaagggagtcaaactgaagctataaataataggtcacctgaggtaaaatcagcagcgagaagagtcctggaaaagcagggtcagctgagtagcctgggttttaggggagtggtgagtagttcaatgaataggttgtggctgcatgtgaccttttccattatgttcttcccatacccatgcccctccttctatccctttacattcaaacacccctgtcttggctggtgtctgcagaaccacaggcagccttccacatggacctacagcccaatggtctagaaattccatgggctacaaatggtaaataggatagtatcagttggtcagtagagaagaaggatggccagaggagtagacaacagatgggaagcctatagacctatgagcagcatccctcgtccatgcttgagcttttcaccctttgtgggtccctagagggattaattaggaagatgtatcctaggacaagtctagactgcctgctaagcaaggcagtgcagtaggaactaggcacttcagatttatgatgtttatgtaaatgttacacattttcagtcacaatcaggcatatccaagagaaatttttatttcacattcatttaagtagaacttgctgaagacatgatgctagaattcatgtttagatgaaacttttagaaaaggcattgggagagatatctgcagggaggtagatattttcgagcttcatagtccactacaaacctgcacatatggtcaggctcctgcctatagcatacagatgaaaactatcaagaaaaggctcaactgaaaaaaaaaaaaaaaaaccactcagaatccagaatgtatctaggtgtgtatgcttacccagtattggcataaacataaaaagaataagaaattcctccaaggtacaattaaccatttatcatctccttagtctaatcacgtaatgcctaacacttctatgacactctctaagactgcaagtttggatatattatcccacttaactctcaactactatggaattctgctaaaaagttatctagaaacatgacatttccccttgtttaaattttctcctttcttctgtttaagctactttattttcttcagggagaattttaaaaataccaccttgaatcaagaagacaaagaaactaaattgcttatgattgaaagccatacatttacattaatggattgatggtctttcaacctaactaactcactatgatattatgtttgatcatttttcccagataagtgaaagtcacccagtggtgaactgattctgtgcatttattgcttccttttctctccagtatgcctcaggaattggatcattagtacagtgaaatagctgtagagtcttgctctgtacatattgctgtacagtccagtgaatcactgtgagatgcttttactctgtgctcattaaatgctcctttccaaagaatcagtagtttaggactgcctgaggccagtcttctcatttaagtcagaaaatggacattgctttagatctgaaaaaaaggaaataaaaaataaaatagaaataggaaaaaataattcatgtccccaatgaacttggcatttgctaagttctagactgctgcataatataaataatagttttgctttgttgttggtccatgtggctgcaattttaatggacatcaacatcttaatatattaaaatcaaatgagatttgattatgaggaaagtttatgcagtcattatgaataaaaatgatttaagtggaaagtgctaatgtttataatataaatttgctaattgtccttttgtggcaaatatcattactatagtaggcacttatagttacattatatggtacataagcattaggaaatttgatcttaaaataatattttagcattacatctttatttttcgaaactactaacatcctttatgttgggaaacatcaatgctactctaagtgtgtcagcatttgtaaatgccttgaagatgaaaaatgcactcatgggccaagtagaatctttcaaatccccttttaaaggaaaaaatggctttcactagcttttgaatttgactcacagaacaacttttaagatttaacaataaacttgccataaaatataacatccgtgttatctctaatactaatggcaatgaatgggcttttgatttgtgatctgatcatctcacataaagcgatttttaaataattcacaaaatagtctccattcttcaggtgtaagaatgtcttctatgagaaaaaatatgtgggatccaaaaactttatggttctataaagactgtatacacacaaaatgagagaaaaaatgtatacaaccactcaaatattcagacattttgtgtgatgatttggtttttaattcagagagaaaaggagggttgaataatttttggtcttgatttattgaagccactgtctcacactcccacctgattttgaatgtgtaaatgtcttgtatttgctataggtagataataaccaatcagtaatcagggttaggagttccgggtccattctgtagtggacaactatcatgctatgttgtttatctaactctttgagctctttaaagtaaaaaaaaaatctcattctattcttaagtagtactggaaaatcatgcaagaatgtctatccatctagaaagagttcagcacacaagtacactacaaatagcatcatgcccatgggacacaaacttatcttatggagtgtatttacatagaaaattttctgtcccatctccatttccttgttgtcaataagtgtaaattgcactaaggtggcagtagtaaagtcaattaccttctttatggtcatgaagatgagatataatctcttggtcaatgtaaattaatttatcacaattcattttaacaaatatatttaatatatgtattcattcattgaacacttactgatgccatattaggtaacaagcatagttctagggaataagtatatagaaataaagctgcaattgtgttattgttctcaaaaaacttcagtatacaggttaagtacattgacaggggaatatacaggattgaaaagggaaatgtaggagagctacttgaatgaggtgagtcatccaaaaaaaagaagattctcaaagtgggctatgcctgatcaacatttgaagttggagaaagagtcatctaaaaaaaggagcagagtattggtatttaagagaaatagaacagtatgtgaaatgattcaagacatggcaaaccaaaggaaattttgtcttagtgtgatattagtgtgcaaaggagggcaagatgagaagacctcatcgcaaaagactgccttcctaatgagtttggagtttattctaaaagaaaaggagatagctgtattaaagaattttttggagaaagaatatgatcaggtatgcttttaagagtttcacctccgacattattataaagaataaatttgataggaggtcatcacaagatattatgtgagaaataaggatctgtctcaaggcagtgacatgatcatggagagtggagaacatcttatgagaagagtttgaaacctttaagatgaaagtagcaaagggatgatctaggatcaattatttgtttcagacctgggtcattgtgaagaatcctggtgttattcacaatgttagggaatatttatcagagtaattgtgttgagaagtgttgagtaaaaatagttgtatataagattattgtggggccaggtactgtggctcacacctgtaatcccagcactctctgaggttgaggcaggaggactgcttgagcccaggaggtcgaggctgcagggagccatgattgcaccactgcactcaagcttgggcaacagagtgaggccctgtctctaacaacaacaacagcaacaacaacaacaacaaaaacaaaaagattactatggaatatacaatgacttctaggtaattttaaatatagaaccagagttcaggggagataactgagatggaaatgtggattttggaatctttgacgtgcaagtctgagtataattatccagggagattgtatacagagaaaaataacaaaaaatcaatgacaagctgtagagagcactaaccattaaataatacacagcagaagacctaaaagtacaaattgagaaatggctggagaaataagagggaagctaggaagtaatgactgtctgtggaagtcaagtgaggaaaaattttaaaattcagaaaggggtcaaaatatataagtactatagaaatgcattgataacaagaacatacattacaataacctctttaattatgttcaaccataggatgataggatgaggacggaagctgatagagaagtaggtgagaaataaagaagaaaaggctgaatgtgcataatgcatcccagaatttttacaaggtgttaggtaggatgtgattttcaatggaatatgtgaggtgctattctattggaggtgctagaaatatgtcatctccaatatacatattcctgtgtctcttaagtaccaaagaagcaaatcagttttttctagtgtattagactctctgtttgtaaatcagctgatccctgtagccattcctacatgtacaaggcatttcactgagaagtgaaaatgtagccaatcagcaaagaatttgggctgcacaatatctggcaatcagtttgaaagacttttttcactgagttgattagtagttctggtctaacacaaacccatcctttattgcccttcagttcacaatgacagcaaaatctgttagagatagtgtgttttgggggcatgtgaggcaacatgagttttggacaaatgagctgtttaagtccattccagaagtggctaagtggactatgtgtgttttttgtgggtgttaagaagatattaaatgcaaaaagaagagaccagaaatatcactgtattacattatttatttaacttatttatttaatctttagaaagattttatgtcaggaactgcccccaggtactaggtagcccaagacctctaatacatgcaataataaacaaaacaggcaaaaatatgtgccctaaatgggcttacattttaatacagagaggggaaactacaataaaaaaagtaaaatatattgtatgttgggtggtgaagacctctggggaaagaaaagttaggcagggaaagggtgctagaatttttatctgggtgatggggggaagggaaaatgaaatatgaaatagaataacctcattaacaaggtaatatttaattaaagttctaaaattattgtgggattaagctgtggagacacctggagaaagaaaaaagcaaaacagtatgaaagggtgagtgcctggcatcttctagaaacagaaggataaatatggctggagagaggtaaaaaaagaagaaagtagtgagagataatatcatagaaataatgtggagagagactctagaccattgtaaggtctatattgagtgattttcaataggaaaaacaaattctggagttctaaggaacatcttaaaatcttaaaatatatcatttacctgttagtctatcgtttcttttgagggtggtacttctgcaaatcatctcccagatcttcttggcaccatcatagaatacctttcttctcagagactagagaaattgactatgcacttctctgagagattttcaataggaaaaacaaattctggagttctaaggaacatcttaaaatcttaaaatatatcatttacctgttagtctatcctttcttttgagggtggtacttctgcaaatcacctcccagatcttcttggtactatcatagaatacctttcttcttagagtctaaggaaattgactatgcacttctctgagagtgaagagatagtttcaggagatacattgaaggcagtctttgtgccattcaaaaaggctgatagcaagaacaacacagaaatttgaaagaaccttttccagaactcaaagagaaagcaatggattgaaatcagtttctgtattttgttagcaaaacattccctaggaaaaagaaagctttcacatgagaatttttaatatatctcaaaaatgtactcttttgcaactaaaatacaacactataaataatatctcctcaaatggaatatgcttctttggacaaaggaagaggagaaatgctgaagaaaataagctctgtggatcttccacataatatttttttaccattcgtattattgtggtggcttttaattgcctccttgaatattcctgaagtggtattttcaactggagtttatatattaaactggttcacgaaagagtaaagaataaggacagttaggtaaaaagtattttgcaccactaacttaatcaatggtggcctcacctattgtagaaccagtgtataattttatatagtatgcaaccacgggtctggaaacctgggcttttatcccgactatgctattaactaccactttaatactctagatcttcattttctcacctgtaaaataagcagttggatggacaataaccacaacttccttgttaggtgatctataaaaatcggctgccatgggtagagtagtgtccagcttctctaacaagaaccatgcttagtaatcctttagtgttaatttacccagagatgccacttacacagcatggtacccactcctcatttttctcccacagctattatagaccacagtacttctccctagccagaatgcgagtcataatcttctttttccccccgatggtgtcttaggcaaccataagcaaaataatgggagatggcactcaagttgcaagcagtttgctacttatcattacaggcatggttatattgaaggcaacagttcctaatatagctaaaaagaacacttacatcccgttagcacattcctcccatctctaaagcattataaggtgtcatcagttccaccagcataaagcagttgctgataccctgggcgtaaccaaaatggatcaattagctttacagttaaagaggcctgaatgtatagaattcatttcccttctttatgaagtcagcctctgttctgagagaaaagtcttccataaaagtaacaaactcacaccttcaacaagtagagattaatatcttgatttcttgatctttgtcatcccatccacttattttcttaatctccaaatgtatagaagcttagaccaaggagctgtgtttgttttagttctgatgaaaagccctaacaatgttattagataactgtgataaattttaatctgatgacagcttgtgacccacaaattgctgtttaaaattaaaatgcatttaaaatgaaattggcaagagaactataatattaaacttacaatctgctgtgataaaacaccaatgtattttactatattaaatatgaatacaatgaatagtatcttgcaattgaaatataaaaatgtccttaaatgcattttcttattaaattaaaattggttgattaatcttactttttatctttgttttgcaaattaaaaagttgaagtagagatggattggattggctttggtaatataccctttggcagaactccaggtaaaatctagggctacaggcttctaggtttctcatctgatgagcaaaagtcctcatttttctcatcccgaatattcatctacagtaaatcaagacatgtttttcacatgcttcagtttatttataacttttaagatataattactcaagatgtatcaaatgtgatctttaaacttttttatatgttagttttgaaaaaatgactacactgatattgttggcagaccagctaaatcattgctaccttagtaagaattgagatttttctgtaatgaatgtttgtgtcagtctattattaagcaatactataaataaaactcaacccaatgtgtatgttttcatcccacatttcagcattgaagaattgtatgtggtaacgaaataattcactacagctgtttgcaaataatttaataatcaagtcatagctattttctacttctcaaaatgtgccaaagaactattgaaaactccacaatataacatcataattataacaattaacatgtgtatttaataatagctttaataatcctatgcattatttgctcaaaagattcatgatacatttaaataatagcgttagctggaataagaaagtaccatatttcactcctactattgtacacagagaataaaattcacccactcttttaaaaaagatactgcaaggattgtaatttcagaacaattatttttactcattacccctagaacatagtatacactcagcaaatgttgcttgaaggaatgaatggatatgtgtgattggatgagaagcacactcagggaaaatgcctcgtctctggttgttacaggactactgcatggacaactgctgtcacagtagggtttctaaaatctccctgccatattttattttggttcatgtgtgtgtgacaatgataaggaattcagcctagcaagtctgtctgcattaaatagaggtgctatgtatgcaaaaagcagggacaccacatataatatctctcaggtacttcccaaggtttgcttcctcacgagacttgatattgattctggtgcctcaaatctatttatatttgggagcagtctcactgttactcttggttacaccttatcaaatctgtccgagggacagtgcctaacccagggttgtcagctttggaactgtaattgttttttttttttttttttttttttttttttttaatatgccagcggacgctagccacggtgctgaaagagacaagaggattctatttgaaaccttttcttcctcttattggcttagaaaattcgagtgacaagagcaggggccaaaggagcctggtgcagcatcactaatgtgaaccatgtatttcgatcttttgggcggagatgtggtccatcaggttacagccaatgccttcctatgagcgctcgctagaccaagagaccttatgaatgtagtagccgctgcagtagaaaaggttacatctagcaggatgtcttatccctctcctgaaaaattgacagttaagtgcatagcctagaaacaagagcagggaatctagacggaggggaggcgaaggggggagcaaacctgtattcatattgaaaatgttcactattttcgtataaagtaaagaaaaatcaagagctaattttaggttaagttttcggcctcagttttccaacaggtgcacgactccctcaccccttccctgtcaggtactgtcctgttttacctttttagaaaggctttcttcgcaaggcaagcttttcctagagtccttaagcatgtgcagtttcccatctcatgcacagctccggctctaagcctggcaaccccttacctgcagcgtgaagattaaggagcaggcacagcgcagggaagcagactgctctccgcatagtgtttgcattgagaggtggaggagaaactccaccacgaccccacttcaggtaaagtgctattagaaagagccaccgccaagggtcttctagtctccgggattcaggtcctcggctggggtttgcagagcagtcagtctgtggcgccgacagaaaccagcaccagcttcaacctccctaagagagggagagaggaagagcagtaggaggttgcgggtaaggggaacagaagcgctcagaggcggcaaatgcctggccttctggacgcccagaagccaaggcggagacggcagggtggactccgcgccagcccagcagcccagcagcagcgccgcggctactgagcatgcccagcgccggccctcacgaggcaagggaatttcaaagtgaaattccgcttctccgggtcttagcggcggcttggagcagagtaggctccatcgctggggtggtggttgggggtgggggtgggggtggggaagggggaagtgcgggggagacacttgctgtggttactagggacccagcgtccatcacaaatccgaaggtggggtgtagctgagtgagagtagatgggggcacgaccacaggagtcagaggagggagctgatgacattgtcaaccatgccacccaccctactctttccccaaatcttgatttacacgtggaccgagctcactgctgggaattggcatttgcagattgaccagcttcccaggactcgcctacaggaatagaggtgtcttccactgctgagcattctggctgctcgggggaagcgttcccaaggcagcttgcttggtgtaagcagtaaccatgtatcttgggggtgacttcgtccttcctacagcttccccctctttgcttctctttccactctttccagctcaatgactgtatttaaactttcttctgactcaagtcctcacagtgacagaaagaagtgagaagatacttttagactagtagaatatatccatgtaattgaagcacaagaaggcacctttttgtttcgtggaggtaattaactttagtttcccttttactctttaaggtgaaagataatggatcacgtcagtgcctggactcatccggcccagctctgtgtctctagggaggctaccacagtctgccattagatggttttttatccctccatctaagtctttggagtgtggaaagccttattagtcatggctaattgctgctagtcaagtcaagaagtccctcagctagacttctcttttaactatcccagggcctctgccctttctgcctctgtgtctttatggacactgttgcctctttcccattttcctccacttgcaccaccaccacactagttttcgaaggtgtaatgttggtctcacttttccagaaagccctaactctaactaactctagattacagtgatctttctcttccacaacacttgtttagccgtgcctcatattattctttcagacagttcatttatctgtggtttgttctacagcacattgaagtctccataagaactgctgagttttgtattccattaacttgaataaagttgtcctagccaaataattggggctaacaagtgcccattgagttgagctgcacatctcattcagtgctttctttctccatcctctgtgaattgagacaactaatgggaaataggctatccaccagagcttaaattaggtgggaccttataagatcagagagcccaggcggtaccatttatttcttttatgatttatgtcatcttcagctctgagagacaaggccaggaagcactccaacaagtgggagaaggggacaatgagatgtacttttaatatcttgacaggccttctctgctgaaaatagagacatatctccatgtctagcccctctctagcaacgtgctccaccccctactcccccatgcgtgtggcacactccatttctgtggcactatcatttcatcccaaaccactctaagctgcaacctcttctcctattcctgattcactgtcctccagtttgcttttcccgtatcactttctaacaaaccaaaataattacttataaaatctattgtttagtatctatttccctactcccccccgcaaaacagaatttgagctccaatgttgaagaactttgatgactttattgatatgtcccaactccctagagcaatgcctcatgcaaaatagatactcaaaaatgaataaatgaaaatgatagttgacaaagttcaatactgacaattaactctttgaaattcttactgagtcaacctttgagataatttatttagcattctgtaaagcttagaagaataactcttctcatctaacatctgttactagaaatgctgcagggctggaggttagggaaaaataattgtatcccacttacaataggtctatttttcttattttcttgtttcctaaaataactaattatcaaacttacatagatctccaagaataaaatatacttacttatggtaatgaaacaatgctgcagtaatgttctgaaccccttccttttccacagataattccaacatttattggtggggcatttaaaattcccattattataattgactatgactttgccaaaaagcatcctgctggcaatgtattttgttcagggctgcaggtagctgaattgttaaactatgcatgaaaattccgttagcagcaaaaatttccaatttccaatttggctggatatatcattagaatagttagttcagcatggtaaaaataaccctgagtgggctgtaattttggtgactagacattcattattaatttacttagaaatgataaagtaacgaaaaaggtcatattcctatgtgagtcaatctaatatcatacttgtaacggcttcaattcactttttcactaattggctaattcactcattgctgttcgtgaagtcaaacagcaatgaatgaattagccaattagtgaaaaagtcaaccacttaactcatacagaaatattctgagtcgataggtgctgtttttccttaactgtgatctaatgctagtgaaggtgacttggtgttttggaaaaaaagcttggttaaaacactgcatcagggttttaaaaagttagctgtaattcaaagaagcatggaaattactatgagagaactatacaaattagtagtggcctacagagctatgtcataaaagaatcatttacattttacaagataaataaaaaatatcatatggaattttcctccacataagatgcataatttctttttcttatgaggtgagtcttagagaaaatttatgcaagaaagaagcttttcagagcctgccttcaaaacagatttaatcattatgagcatccatatttacttctctataaatggatgaaaattattcatgtcagccatctttccttaagacactttaaattgagaaatcagatccattgattataaggatctcctacttaagttatttagattactattatttaagtataattatggctaacattgactgtgcttcctgtgtgccaggttctattctaagcatttggatgtcctatttaaacattataatatttctacaaaaggatactataatgatctcattttagagataatatagttgaggcatggagaagtaacttgcccaaaatcaagtagtaagtaatcagttaaaaagtaaattgatagaattaagatgtacatctgataatttgataccaaaccactatattatactacctctaataacacacacacacacacacacacacagacacacacacactcagttgtaggttgctcactagaattagatgattagatcagggctgggcatgagatgcctggccccacagtaaagctctgtgttgaggaacactcatagaagactgtctccaggagaacaagagacactgcttgtggcagtggactctgggccctagcatctagtgaacaaagacagcaagtaaaatcatgcttagaggaactgtgttagaaagatgcttaagatagaatggagaagaatggaggaaatgatttcttctatggagggtgggagcagaggaggggatgggcagcaggcaagaaactggtgggcaacaggaaacgaactgagtctggctggataagtaggttctaactgctctacatgaagagaaaggccagggaattgtgtgagccagtggcagagatataaagcagcaaaatggattcaaggaacttctgaacatgtaagggagcaataggtaacagttataaacacctcactaagatttgttctgtgcttgccctttcccatcctttatgcagccactttatcaatcccaaagtctgtttccttttgtctgagagctatcttttataagaggagaaaagaagaaaaataatttctttttacaaagtaaataattgatgtgaattaagctatattcagagtggaatatagctcaggatgaaaaggaatgaattcaaaattcacagatgaaaataccatgttcaggtatataaattcaccattattattttttagtattttcccaaccataacaagaagaatgatctaccctttctcataagcatacagtgaagagaacaatgaaattgcaaggggcaataagaataggggaggaaaagcactaaaattctaaaaatatatattatcacattgaagtctcacaagagctgtgtgaagtattattttttttttttttttgtagtagaggagaaaactgaagctcagcgaagctagtaatttgcctatagccatccagttggtaagtggtgaagctgggattagaactcaggtatggtgacccctagcactatgctgttatcagctgtattgtacaacatccctgcttaatgaccgaacttattttaatacttaaattgaaaacagtgttcttatcccaagacacagacttcaagatggataacaacaattacattttataacttaacacagttgtagttttgttaaattaaagcatttgatacacacacacaaaggcagcaatatgtatcctaaggaaaaaaattaggtacctaaaacaaggcagatatacttttctgtgcatatgtgaattatgctattgtagtaaaacataaaatatgaaaagcagaaaggctatatgtacctatagattctgctattggttcatcattaaaattttattcaaaacgaagaacaaagttttcttggagctagcccttggtaccaatgtattgtattgtcatctattctggcactgcaaaggtcagattcatccaagatgtcagtaatagatttatttacaaacctctgactctcctgctttagctctctgtttatcccaagacactaatcaggctgcacttatattatccatcatcctgagcagcacacagatgtgacagccctctgttatggcttagactatctactttgagcattcaaatacattttctgcaatggttggccattcttttagatttccttgaatgaggccactttggaacaacttgttcacacaatagcctgggacactaagtatatcctgggattgtaactgtgggttgattagatcatttaatcttgctctcatttctctacattattttctcacataattacaagatgatttaaaaggacatctcccaaatataggccttaatgtctccctcactgactcttcattctttttttttttgcatatatatatatctttattatgccttaagttctagggtacatgtgcacaacgtgcaggtttgttacatatgtatacatgtgccatgttggtgtgctgcacccattaactcgtcatttacattaggtatatctccaatgctatccctccctgctccccctgccccacaacaggccccggtgttgacttttcattctttaaaactaaaagtttaaggccgggcacggtagctcacacctgtaatcccagcactttgggaggccaaggcaggcagatcacctgaggtcaggagtccaaaacctgccctggcctggccaacatggtgaaacctcgtttctatgaaaattcaaaaattagccaggcatgatggtggatgcctgtaatcccagctactcgggaggctgaggtggcagaatcccttgaacctatgaggtggaggttgcagtgagttgagatagcatcattgaattccagcctgagcaacagagcaagactccatctcaaaataataataataataataataataataataataataatattgaataaaagtttaaactttttaaaaatacttatttctttcactcattcttgctgctggatgcctataatagagaatggggtggtttattagtctatagttcgtggttgcaaagcatttcagaagaaatttttttttcttgttagacacctgcacctctataacatgaagagttaatcttactaaaaatgtccattgactataacacaaccactaatacacccagacaatgaagcagttgtttacggttttaagttcgactcattcatcagaaaccatatgtgatagggcaacacgggtgcctatgttcagtgaagtcaagtcatttgaagtcacattacggtaggatatactatatcgcatacattccaaaaacagtggaatcatctgccgacatttcgttggtatgttgcttgatttcaaataattaaactatatattgagtacctatgatgcatcaggaagtatattaagtacttgggatatattgttgaacaaaatagactaacatttttgctttagcttaaattgtaagtgaaatgtacctttaatagtaaatataagaaataagtaaattatatagtatgatggaaattgatgactgctatgagaaacagaaaaagtagatctaagtaaggggaattaggcaggtgggggtggggtgggagaagaatatgagtgcaaggattttgcagaattaagtagggtctttaagtggagaaagcgagcattgagaaagacttggaagttgaaattagctgagcagaaacctggttaaagaacttcctaggccgagggaatagctacagcaaagactctcatgattccatagatatcttaaccaatctgaaaaaaaaaccccacagtatcagaaataattttcagcatatctgtaaatatataaaatatataaagagaaatccagttggcaaattgccaaattagtttaaatgaatatttttacaccagagattttcattgattcatgtttcactgatttcaaatacaactgtgagatagcaaagccgttaacaagattcagaaattgggactacccaaagccaactgatgtaccaactaagaattctgctctttattccatgtttttggtgtaaaataaacaccttattgatttagaaatgtgggtgcctattttgatattttattcattttgagaaacaaagaaaaactttgtgagctgcccttatactaaaaccactagcaaaaagtcaagctaacataatatgaatgagaaatataagcaggaaatgagaccgggcgcggtggctcacacctgtaatcccagcgctttgggaggcagaggcggatggatcacctgaggtcaggagtttgagaccaggctagctaacagggtgaaaccgtctctactaaaaatacaaaaattagccgggtgtggtggcacatgcctataatcccagctacctgggaggctgaggcaggagaatcgcttgaatccaggaggcagaggttgcagtgagctgagatcataccactgcactccagccttggtgacagagtgagattctgtcttaaaaaaaaaaaaaaaaaagaaaagaaaaaaaatataagcaggaaaagaatgagaaaaatgccctagcaagcatttttgttttctcagcctcctgtgtggcaaatgacatcagaatatttgggttagttattgtccaaatgctggaggaaaacagtttgacaaattccttgtttcttaggatggcttaagcaaatcattttgatactttattatttttggatgaaatagaaggtagcttcattttatttttaagtaaaattccttttttattcaatttaatgtgataggtgcccatcaaaatactaccttactgtggccgggcgcggtggctcacgcgtgtaatcccagcactttgggaggccgaggtgggaggatcacgaggtcaggagatcaagaccatcctagctaacatggtgaaaccccatctgtactaaaaaaaaatacaaaaaaaaattagccgggcatggtggtgggcgcctgtagtcctagctacttcggaggctgaggcaggagaatggggtgaacccgggaggcggaggttgcagtgagccaagatcgcgccactgcactccagcccgggtgacagagcgagactccatcttaaaaacaaaacaaaaacaaacaaacaaaaaaacaaaaaaaactaccttactgttaatagaaatagaaaatataaaccatttctcttacaaaggtgtcatttggaacctctaatcttggaagtactttactttaggaaagatatctaccctcaaatttgtcttccaaacttaaactaaaatcatattttatattaggtttgtatcatagagattagaaaatgaattcctttcaaaaccaaattcagctccaaaactggaaataaaatgaaattttatttgaatcagtcataaacataatatatagaagcccaattttacctcactatttctagaaagtaggcaaaaaccaggatggtatttctgcagttttccttcatctaaattaattctcttcagactgaaattgaacattctaaagtacaaaattttgtaatattgtgtctattgcacaatagacaatagagaaaaaacaaaatagaatgtgatctatggattctaccaactggtgacaaatacagctaatgctttggcatagctggttttcctctaccctcatcttggggatatgtgtgtctttgcatgcatgtacctataattattgttagttttaacattatttttacatcattgggatcatgctatgaatttggaaactatttctttacctaataatactgtgagacataattccatgtcatttaagtttgttcacaatcatatttttaattgttgcagagcatcgtgccatagcattctatcattggcttattttttcaagcccttcctcaattaaggtgaattgcttcaggagagcaaggaaagacattcagataatgctcacttactgtacaaaataatgaaaattattatatatttataatatatttccaacatggcagttctaatctggctctggtgaaactatcaccccattaaaagaaattatctaaagtgtcaaagccaggcatcaagaaggggacatcagggattctgagtcatacctcaatccccggcaaattaaggataatctaaatgtgtgccttccaatcaggaacctgcctattttaagaatgatggctaaaagcagagtttgaataaggagtcttcatttatctttttcatgatccctggataactcaattgactaacactgatataattacaaaaataccattgtgtaaaaagtactataacatgaattgtataaaaaagagttataagtaattgtgctatttcttttatttttaaaatttgtttatctttgcttctcatctttttaacttattttttatttctataggttttttgggaacaagtggtatttggtacataagtaatttctttagtggtgatttttgagattttggtgcatccatcacccaagcagtatacactgaaccctatttgcagtcttttatccttcacctccttcctaccgtttccccatgagtccccaaagtccactgtgtcattctgatgtctttgcatccccatactttagcttctacatatgaatgagaaatactatgtttggttttccattcctgaattacttcacttagaatagtaggctccaataccattcaggttgctgcaaatgcaattaattcatttctttttatggctgagtagtattccatcatatatatatatatatatatatatatatatatatatatatatatatacacacacatatatatatatatttttccccttttttaggttttcttttttgtttttaaattaaaatctcactactgggtatctaccagtagtgggaaatatatatatattatcatatatatgacacatatataaatatatgatatatatatatgatggaatttcctttttatatcttttgcctattttcactgttttcgcttttctagttagtttttggaagttatatattctagaatttagatactaaacttttaatttccatttatgttgctaaaatattctgtcattgtattttttgttttattatgtgttttgattaatagttcttaattttttaaatttatctattgaccttttggctatatatgatctctttgtatcatttctttagtggttgtcctagggagtgaaatatgcatacctctttcacagtctacttagaaatattatttttttactttaagtaaaatgtagatgacttacaattacatctatatatacataattgatttatacatataattgattgagatatatatatatcacagtttctttattcacttgttgattgatggccatttcagttgattccacatttttgcaatggtgaattgtgctgctataaacatgcatatgcaaataccttttttatataatgacttttcctctgggtagatacccagcagtgggattactggatctttttttttttaatttaaaaacaaacaagaaaacctaatgatacagctactctctcacccctattctcttagcctctgaatgtaacaactattatgattttgtagttcatcattcctaatcatatctttaaactttatttgggtatccataaacaatatgcagtacttttttaattttaaaatttactaattagaattatgttccataaagcttaattgtttctacttttgtccctattacaaacagtattttttattttaatacatttttgcatgctttccaagcatatttaacatagtttctctaaggtacacacataaaagttaaattgtttcctcataggctataaccatctttatcttaaacataaaccttgacattgctctatatagtctcagtaccagtttgtattccaaacaatgtaaaagagtatcatatagctgtacccgcttatacatattagactttataattacttttcaaagtcaatgcatataaaatggtatcttatttttaaaatgtctttttttgggctagtaacgagagcatgcttataaatcttgaatagctattaacgtttcctattctgtgaatttcctttttatatcttttgcctattttcactgttttcacttttctagttagttttgggaagttatatattctagaatttagatactaaacttttaatttccatttatgttgctaaaatattctgtcattgtattttttgttttattatgtgattggattaatggttcttaattttttttttttttttttgagatggagtctcgctctgtcacccaggctggagtgcaatggcgtgatctcagctcattgcagcctctgcctcctgggttcaagcaattctcttgcctcagcatcatgagtagctgggattacaggcacacgccaccacgcctggctaatttttgtatttttagtagagaagggatttcaccatgttggtcagactggtctcgaactcctgacctcatgatctgcccaccttggcctcccaaagtgctgggattacaggtgtgagccaccatgcccggccaatagttgttaattttaatatagtaatatttattaatcattcatctctacagagttttttttcaggtttgtgtatcttttttaaaaacaggattttggttttattgatttttctctattcttttttatttcaaacattcctgcttttgtttttattagaaccctttttctgtttgttttttatttaacttattccttttttctagtttcttaaggtagaagcctagattcttgattcatgattcttgatacatgattattttttaaaaaaataagcatgtagtgctataagtttctatacaatcattgcttcagttgttttccaacaatttgtaatttgtgttttcactcaattcaaattaatttcaaactttttacataatattctcttcaacttataggttgtttaggatatgttgtttaattttcaaatatttgagaattttccacatatctttctgttatttgtttcttttttctttctttgaacctatcgatgtctttatttttattgtgggtttcttgtgggcaacatatagtctggtctttaaaaagaattttaagatacaatctgataatttctatgttttgactgctttgttcacactatttacatttaatataaatattgatatgattgcacataacactatcattttattattttatttctgttcatcctctctttttgtgtttcctctgtgcctcattcccttccttcttttgtattattaagtttatttttaatatttcatttaaatttatctcgacttttcggctatatatgatctctttgtatcatttctttagtggttgtcctagggagtgaaatatgcatacctctttcacagtctacttagaattattattttgttactttaagtaaaatgtagatgacttacaattacatccatatagattccttaatcctgtcctaattctcaaatatattatatctacatacattgaaaacccatcagacaatgtgataaatttgctttcaacattcatacatattttggataacttaagagaatatggtcctttatatttacccagatataaactatttgtctttgtccctcattcttaatgtctcacattaacttctgacgtcattttcctttaccccaataaatgtcctttcgcatttcttttagagcaagtgtgttgataattaattctcacagtttccttttatccaagaatgttcttacttccttttcatttataaaggaaatttttgctgtatgtaaaatgaacgtatagctatacgatcagcatgggccttttacaggttcttacatagaattagagaggtccattatacttagctggaatctgtttccacccattgtggtttgttttttagacagatttttgggcagaatttatatatattgtttgggccccctgtttttcttcctttcgcttttatggggtcctttcttgattttcagtaaaagtttccccaaatgacattccctagttctttgtttcagaagagctgcaggtttctttctttctttctttctttttttttttttttttgagacgaagtctcgctctgtgcccaggctagagtgcagtggcgcgatctcggctcactgcaacctccgacttccgggttcacgacattctcctgcctcagcctcccgagtagctgcccaccaccatgcccggctaattttttatatttttagtagagacggggtttcaccatgttagccaggatggtctcaatctcctgacctcgtgatccgcccacctcggcttcccaaagtgctgggattacaggcgtgagccaccgtgcccggcctttttcttaatgcagttgagctatactaccatgtgctaactctggcatgccctctagctaaatgccacaaaaatgagtaactcattctatgccattccattcaaaatgccacctctcctctataatacagtctacctacttttctttccagtaccaagttcattttttggtatcttttgtttagtgtttttggtttgtatctgtgaaagcattggcttctattgtgcaaacctgaatcttaactcagaattttttgtttctatttatgtcaatcctttgatgcttccgaatatatgtagaggtctttcattttcccccattttacttaaggtttatgatctgtgtctgttgaaaattaaaacccaggaccctagctattacacaatatggtaacctccctaattttcccctactctgtaccaccactaccatctattccactattctacacctcttctccctgcctctgtgccaatttgtgtttattttcctgactttcatttctctgatgactttttgtcacgtagggatattgcattatttattttgaatttgactatactttaaacgtaactgtcataatttatgtatcacttctaggtatttttgtctggaaaacttaaggagaagtttgtttagcccaccatttcatcagaataagagtactatccttgccttctttattatgtggttcttcattctggaacactctgaagcagtagcattgtatgtacttggcgtaacagccattgacacttggtagaaaagatacaaatgaaacagcattccaaagagttaaagaagccagtaactatcaacagttcttgagcctgcagcatagcagattataaaaacccaacttgctaaaatgctaaaactctctgcctgtaagataactaaactagctgaaattggttggaaccgatatgaccgattggagtttacacagaatgagcttgctgatgttacagcctaaacttccagtttgttttataccaacttcctccaaatttccacaaaggtcctatgaagaaggatgaagaggtaactgcacatttcttatgactttccagacctcacctttccttctgccaaatcacctactaatcccagaattcaccctgtaaaccttttctaataaaattacagccataaagccaacacaaagagacaggtttgagctggactcttgtctctttgtcagtcaactagcaatacaaagcttttcttttcttaaaatcctggtgacatattggcttctaatacatcaggcagtgagcaataacaataacaatgataatgctgttggtgattataacttttgcttaaaaaaccctctataatctaaaaatgaggtatttttcttgtatccacatgttgttctacaaaaatgtaatatataaaatgcaacttagtgagatcaccctggtaatctcatattgtcaacagggcattgttacataaccactagcaagaagttaggtacagttttctcagtatcaggaagctgaatcaggaccatgatttttttcgtgaattgtcctcaagagctctgtaaatacatcaaacagatctgtgaaagcgaatctagttatttaataggttctacttctagttctacttatttaataggccaaaaatggcttctcaaaattagttgcaactgcaatcatagttacgtttgcttggctggaagaagtcaaagtccttttcaaactctagactggataactgtgaaggttaatttgggggatagagaaggtcaacaataaattgtatttcctcaataattttgcttgctgatgtcacagccaaataaagcacatctctgctttattttttttttttagtatagattgaatttcatgcttagaaaacgtaccagaagcgttgttttcttttggtcgataaagaacatgattaattgatacccttcactcaatgtgtatcctggccagtttatttttctctgttctaccaccagaagcacaccattttttttttgatcagctatttcataaatatgtgtgctacttatcactaagacttgccccaataagcaagaagacatggattaacaacaatgtcaccctactctcataaggatttttcaaagcagtgtaatcctcttacatcaaaagtattatcagctctgccttcaagcttattatacatggtcatgaaaccgtgctccaaagagttaaagacactgatgactaaccaatcctcgagtttgcaggatggcagataaaaaaagaaacaacttgctgacacacagacactccctccacttgtaagagaataaaactggctgaaatcatttggaaccaatatggccaactggagtttatgcagaatgagcttgctgacatcacagcctgaattcacaccgcatattttatactaactccacttgaatttacacatacaatccatgaggtagcaaaaagagatgactgtgcattcccagagatgttccagacctctcctttccttccaccagtcacctactaatctcagaatccacccactaaatgttttctaatgaaattactcccatcaagccagcacagggagacagatctgagctgtactcctgtctccttgctagctgacttgcaataagaagcttttcttttctctaaaacctggtttcatagtatggcttccaggatatttggcagggaatcccttttgcttggtaaccatcattgggagccactggtaatttgatgtatgcaagaaaggaatatgcaggtcacttaggagtgcttcacaggcagacatttgctcctcttgtcagacattgcttgaagaagatttttgctgaaagctttctattgagttttggttaaataacttggcaatgagtaaacaaaaaattttcattttgatatttgtattaacgatttttggctcaacatttgaaatccttgaaattggagatcttcgatgctttgttggtttcatcctatgatactctgggatttttctggtataaagttttaccaagttttagaaaaccacaatccaataaaatttaactggaagtagaaaacacaatgatactgataagataccaatgatgtgtggatatttctcttttttctctcattctacaccagaattattgtcaaaagaggagtataaaggtattctcttcctgaaactcaggtaaataggacaaagttcagaaaattctctagagacaggtcgcagtatttcctgataactgatttttttataccatttcatttcaactaccttaatattatgcacaaaattcatagatacatttcatttatacaacttgactgtgaatgaaaggaaagaactattgtgatagctggaggataacataatttgttttttcttctggagaaaggggaggaataaaacaccaaaagcaatggcaacaaaagccaaaattgtcagttgggatctaattaaactaaagagcttctgcacagcaaaagaaactatcatcagactgaacaggcaacctgcaggacgggagaaaatttttgcaatctatccatctgacaaagggctaatatccagaatctacaaagaacttaaacacatttatgagaaaaaaacaaacaaccccatcgaaaagtgggcaaaggatatgaacagacacttctcaaaagaagacattcatgcagccaacaaacatatgaagaaaaaagctcattatcactggtcattagagaaacgcaaataaaaaccataatgagataccatctcacgctaaatagaatggcgatcattaaaaagtcaggaaacaacagatgctggagaggatgtggagaaatagtaggggagagggtgacattactcccagtatcacaggggctgcccacccttctgtaatatttttcataatattcaaaggtggagaggatgatattacttctaatatcacaggtggtgtacacccccctgtgatatttttctaatattcaggggtcggaggatgatattactcccaaaatcgcagggggtgtacaacccctgtgatattgtttctaatatccaggtatggagagaatgatatttctcaaaatatcacggggttgtagacccctcttgtaatattgttcccaatatccaggttgagaggagatgatactactcacaatatcgcactgggtagaggccccttctgtgatattgttcctaatatccaggggaggagaataggatattattcccaatatatatgagggactgtacaccccccctttgatatcacacttcctgcaaaattgggaataatatcctctcccttcattgatattaggaacaataccacagaggaggtgttcaccacctgtgatatgaggtgtagtatcataatctctttcatggatattaaaaacaatatcacagaaggggtgtagaccccctgtgatactgggagtaatatcatcctcctcttacctggatattgggaacaataacacagggaaggtatacactccctgcaatattgggagtaatattcttcctgccccctggatattagggacaataaatatcacatgggaggtgaacacccctgcgataatgggagttatactctcctcccttaaatattaggaacaatatcacatagggagtatacatttcctgcgatattgagagtaatattatcctttttcgcatggatgttaggtacaatatcacatgggtggtgtacagcacctgcgatattgggagtaatatcaccctctttcctcctggatattagaaaaagtatcacatgggaggtgtacacccactgtgatattgaaagtaatatgattctctccccatgtggatattagaaataatatatcagggcgttgtacacttcctgtgatattggaaataatatcatactcccccccacttgatattaggaacaatatcccagagggggttacacttcctgcaatattgggaataatagcatcctctcccttcttggatattacgaacgatatcataaaaggggtgagcactccgtgcaatattgggtataatatcatcctctcccctcatggatattactaaccagatcacagggggttgtacacacaccctgatatggggagtaatgtcacccccacccctcctgcatattaagaactagataacaggggagtgttcacttttcacgatatggggagtaatatcaccctctcccctcctagatattagtaacaataccacagcgggggtgtacatctcctgcaatattgggagtaatatcgacctcttccccactgaataatagaagcaatataacaagggggatgaacaccccctgtgatattgcaagtaagatcatcctttcccttcttgaatgttaggaacaatataacagaggggtgtacaccccctgcgatattggaaataaaacatcctctcccccctggatattacgaacaatatacatggggttgtacaccccctgagatatttggagtaatatccactcttcacctggttattgaaaataatattacggcgtggggcggtgtacaccccctgggatattgggagtaatataattctctctccttttggatattagaaacaatgttacaggggaggtctaccccttcggcgatatttagagtaatatcaacctctaccccctggatattaggaaaaatatcacagagggtgtgtatattccctgtgattttgggagtaatatcatcctctcccgccctggatattaggaacaatatcacaggggggattgtgtacaccatttgtgacattgggagtaatattatctttccccccactggatattatgagcaatgtcatagagggggtatacaccccctgcaatattgagagtaatatcatcctctcccttatggatattagaaacaatatcacaggggagatgtacagcccctggaatattgggagtaatggcattctctaccccactggatatgagaaacaataccacagggtgggtatacactccctgtgatattggcagtaatatcaccctctccctgcctggatataagaaacaatatcacaggcagggtttacatcacctgcaatattgagaataatatcatcctctttctccctgtatattagaaaccatatcacagcgggtgtgtacaccccctgagacatttgtagtaatatcatcttctacctacaaggatattagaaacaatatcccagcgggggtgtacaccccctgagaaatttgtgagtaaaatcctttacttcacctggttattaggaacaagatcacaggggtttgtacatccctgagatattgggagtaatatcactctgtccatccccccccggatattaggaacaatatcacagggaaggtgtacaccccttgaaatattgggatcaatattatcctctccccagttggatattagggacaatatcacggagagggtatacacccctgcgatattgagagtaaaatcatcctttccacccctggatatcaaaaaacaatatgacagggtgggtgtacactcctttcgatattgggagtaatataatcctctccccttctggatattagaaacaacattatgcagggcgcgtgcacgcctaagatatttggagtaatatcatcctccatcagccagaatattagaaacaatattacaggagcgatgtataccccctgcgatactgggagtaagttcatcctctccccccttggatattaggaacagtatcacaggtgggctgtacagtccctgcaatattgggagtaatgtcatcctgacctccctagatattaggagtaatatcacatggagggtgtccacccccaacgaaaattgaatgtaacaaaatttttcccctctctgcatattaggaacaatatcccagaggtagtgtatactcctgtgatattgggagtaatatcatcctctctctccttgcatattaggaatatcataggggatgtacatcccgtgcaatatttggggtaataacatcctctcagtctctggatattaggaacaatatcacagaggagatgtacacttccagcgacattgggagtaatatcatcctttccctccttggatattaaaaaaaaaatcacaggggttgtacacctactgcgatattgggagtaatatcttcctctgagcccctggatactaaaaactataatactgatggggtgaacatcccctgaggttttgggagtaatatcaatctctcctcgcttggaaattcagaaataatcacagcgcgggtgtatacttcctatgatactgggagtaatatcatcctggagccacctggatattagaaacaatatcacggggggagtgtacaccccggcgatattatactctttacccctggatattagaaacaatatcacagggtggctgtacaccccatgcggtattgggagtaatattctctcctcccaagaatattaggaagattgtcacagagtgggtgtacactccatgcaatattgaaagtaacatcatcctctccagggaggagatattgtgcacctgagggtgtacatttcctatgaaattaagtttaatatcttctctcccccacctggatgttaggaacaatatcacaggggaggtgtacaccccatgcgttattggtagtaatatcattttctttcccctagtatattaggaacaatatcaaaggggggcggtgtacgttccctgatatattgggagtaatatcatcttctcttttcctggatattaggaacaatatcacagtggggggggtgtctacacagtgtgacattgggagtaatgtcatcttctttcaacctggatattaggagcaatattacaggaggggtgcacacccctgtgatgttttgagtaatagaattctctccccacctggatatcggaaacaacatcacaggtgctgtataccccctgtgatactgggagtaatatcatcccctctgcccctgaatattagaaaaatatcacagaggggtgtacaccccctgagatactgggagtaatttcatcttctccccactggaaagtaagaacaatatcatggaaggggcgtacaccatctgaaatattgggagtcatatcatcacctctccttctaaatattaaaaatagtattaaggcggggtgtacaccttctgtgatattgggagtaatatcatctttttctgctctggatagtaggaaccatatcaaggggagtgggtgtacaccccttgtgtatgagaagtaatattatcctcccaaccctgaatattaggaacgatatcacagggggtggcggtgtacattccctgcgatattgggagtaatatcatcttctccacccctggatattaggaacaatatcacaaagcggtgtactccccctgcaatattgagagtaatatcttctttctccctgaatattaaaaaaaatcacatgaggggtgtacaccctctgcaatattgggagtaatatcatcctatcaccctctgggtattaaaaaaagaaaaaagcagggcgtttgtataccccctgcaatattgggagtaatatcatcctcttattccctaaatattaaaaacaatatcacaggggtggtgtaaactttctaagatattgggagtaatatcagcctctggatattaggaacaatatcacagcgggggtgtacactgtctatgatattggccataatatcatcctctccccctctggatattaggaacaatatcacagggtgggtgtataccttctgtcttatagagagcaatatcagcctgacccatttggatattaggaacgatatcacggggggtggtacactccctgcgattttggaagtaatattatcatctcaccccttgacattagaaacaatatcacagaaaaggtgtacaccccctgcgatattgggagtaatatcatccccccttcatggatatttggaacaatatcacaggaggggtctacaccccctgagatgttgaaagtaatattattctctcccttcctggaaattaggaacaatatcacaagtgggatgtacactccctgcgatactgggagtaatgtcatcctgttccccccaaggatattaggaacaatattacagggggcgtgtccactgcctgtgatattggatgtaacaaaatcctctactcccctgcatattagaaacaatatctcagggatatgtacacccccctgcaatattgggagtaatatcatcctcttgcattctgggtataggaacaatgtaacagacggggtgtacaaccttagcgatattgggagtgatatcatcctctttcttttcggatattaaagaaaacaggggttgtacacattctgtggtattgggagtaatatcatcttcttatttcctggatattaggaactatatcactggcgagtgtacaccctctgcaatattgtaagtaatattattctctgtcccttggctattaggaacaatatcacagtgggggtggacaccccctgcgatattgcacgtaatattatcctttcccctccttgatattaggaaccacatcacaggttggatgtacacttaatgagatgtttggagtaatattctctttgcccgtggatattaggaacaatatcacagggtgagtgtacagctcctgtgatattgcaaaatatcatcctttccacacctgaatattaggaacaatatcaaagagggactgtacacccactaccatattttgagtaatatcattttctcctcccgtggtattaggaacaatatcaccggaagatatacacctcctgcgatatggaagtaatatcatcgtctccccactggatattaggaataatatcacagggatggtgtacaggaccggcgatattgaaaataacatcatcctgtcttcccatcgatattaggaacaatatcacataggacatgtacactacctgcaatattgaatgtaatatcatctaccccgccggatattagaaacaatatcacaggggaggtgtacaagccctgcaatattgggagtaatatcattctctgacccctggatattaaaaacaatgtcacagaaacggtgtacactcactgcaatatagagagtaatgttatcctctcaccccctggatattaggaacaatatcgcggagggggggtgtacacaccctgcgatagtgggagtaatatcatcctcttcctctttggatattaggaataatatcacagggggttgtacacttcctgcgatatgggaagtaatgccatcctctctccccttggatattaggaacaataacacggtgggtgtacaccccctccaatattgagagtaatataattctcttttcccctgaatattaaaaaaaaaacttcagtgcgtgggtatacacccctaagatattgagagtaatatcatcctcttcctccttggatataagtatcacagggggctgtacacacactgtgatattggaagtaatattattctctttccccctaaatattaggaacgctatcacaagggagatgtacacaccctgtgatattgagagtaatatcataccctccttccatggacagtttgaacaatatcataggggtggtgtacactccctgtgatataggaagtaatatcatccactctttccctggatattagaaacaatggcacgggggggtgtacaccccatgggacattgggattaatataatttttctccttccctggatattagaaacaatatcataggaagggtgtaaaccccctgcgatattgagagtaatatcatcctctcccccactggatattaagatcaatatcacagagggtgtgtgcaccttctgtaatattgggagtaatatcatcctctcccccactggatattaggaacaataccacagggtgggtgtacaccccctgcaatattgggagtaataacaacctctcccacccaagatgtcaggaacaatatcacaggagtggtgtacagcccctgtgatactaagagtaaggtcattctctaacccctgaagattaggaacaatatcattgcagaggtgtacaccccctgtgaaactagatgtaatattatcctctccctacctggatattagaaacaatgtcacaggagtgctgtacaccccatgcaaatttgggagtaatatcattttctttccaaccagatattagaaacaatatcaatatcaaaggttgtttgattctcattgttcaattcccacctacgagtgagaacatgcggtatttggttttctgtccttgcgatagtttgctgagaatgatggtttccagcttcatccatgtccctacaaagggcatgaactcttccttttttatggctgcatagtattccatggtgtatatgtaccagattttcttaatccagtctatcattgatggacatttgggttggttccaagtctttgctattgcgcatagtgccacaataaacatacatgttcatgtgtctttacagcagcatgatttataaccctttgggtatatgtccagcaatgggatggctgggtcaaatggtatttctagtagtagtgttttagtaatgttcttctgtgttgtaccttgtcatcatatagtactttctcattaatatctttttgaaaaggacgtgtgccagttgttaagccactaagcgtgctctaaaccataatgcactgcagaatggaggaggtgcatgagaatttgttcataaccatgaccttccacatcatgctgagaaggcagggagcaggcctgtggaggtgcacttaccaaagaggctgtaccagcccattaatgggatgccacagacggtgagctgtgtgtgccgagtgaaagctctgcggacacattttaagcaaattgatgtgcttgtgtaccatcatttggactatacctgtgagtactttgatatttgccttgatgtatatttgatgtgggtttttaatgtattttagagtaaaccctgcacatctttatccttgtctgttccctaaagggatgttatttgtgaatcttattaaaaattaacgtgaatctactttccatacactgtctgtcacagatgaagaatgacctgtgttgataagtataatccattcattgatttctgaacccagatacactggaaagcatctcaaatcatgtgatagatctgcacaaaacttaatgatttatctaaatgatgtacaaaatttcatgtttcataaaagccctctggtggctataaattcagagaattatatttctctctggaagagggaaaatataatagcccctgaattcagtcccaatcaatatagcactaactgtacttccttttcactcaagccacatgtgttagaacaaaacaactcaagttagcatcctaccagtgatggatataaaacttgaaagaagtcagctaaactgagaattaactgggaaaaccttgctaacatgacagaacccttgtggcagcagaccattgtttgaagtattcaagttcaatttatatgttgcaaaaaaccaaacaaatgggaaaaaaagagacccactcactaccaaaactagaaacacaacaaaagctctatggaacataggcctacaagttctggattaaccttctccatcacacaaacatcacaaagagttttggtaagaatattatcttctacctactttaatatgttcccagaagataacagaaaagctaggcagaagagtgataaagaattatagactctaagaggcattaggtaagttatttatcttctgtaacctcaatttcctcactgcaaaagggaaataatattctctagtgttattgggaaaactaaattatatagtatatgtaaagctcttacatagtgcttggcacatgtaaaagtgatgactaagtgtgattattattattgttattggagggtttgcattgacattcatcactacttgtaaattaattttgccatctactagcaggtgacatataaagaatttgagtgaaaaatattaagagagaaaaacaggaaatggactaaatgatatttattaattttagctataaattaggaaaatattgctgctatttaatttagtgcagaaatacatgtgttctacagaaacagtttgaaaaccagttttcaagacatggcataattacacagtctgaaatgtactattgtggaatatttctttttttgctttttttaaattagacttcgagttctagggtacatgtgcacaacgtgcaggtttgttacatatgtatacatgggccatgttggtgtgctgcacccattaactcgtcatttacattaggtatttctcctaatgttatccctcccccctcccccctctccccaccccactacaggtcccagtgtgtgatgttccccttcctgtgtccaagtgttctcattgttcaattccccccatgagtgagaacatgcagtgtttggttttctgtccttgtgatagcttgctgagaatgattgtttccagcttcatccatgtccctacaaaggacatgaactcatccttttttatggctgcatagtattccatagtgtatatgtgccatattttcttaatcctgtctatcattgatggacatttgggttcgttccaagtctttgctattgtgaatagcaccgcaataaacatacgtgtgcatgtgcctttatagcagcataatttataatcctttgggtacatacccagtaatgggatggctgggtcaaatgatatttctagttctagatccttgaggaatcgtatgtggaatatttctattctgttttttcacagcaaatagaattaagcaaagaataacttcagtaattatattgtgttgaccaacttgcttcttttgcaaagatatgtgcatttggtgctgtgatttttatattgtacacacataatatagccatgttttctgttagtaaaatttcttctcctttaaatgggagttcaatacctcagcatgcatcattcttacagttttgccacctgaataaacttgagaaacttcaagttaatttaaagatggctaatttcagaagtttgtgataaatctccagcaatgaagattgtactgaatttgaagggctctgatgaaagacataaggaagtaaggtggtagaaagaaagtattttcataataaacagtaagttaaacaatgaagatacagtgcttggggtgctctatacaacacttcccacacataaaaatgtgttgactaaatgaatgctggtgtcccaccagaagggacaaatgccaagataaatataacaaatatccccaagcaccacagggaaaaaattcacataaatatttattcctaataaaaacctgagaaaagcaaacagcggcaggagaatacaatgtaattacacatggaaaagatgaaactatttctgaacctgacgctgacccatacacaatgacattaacggtcaagcagccattgttatgaatatattcacatgctcagtccacacttaatgatgcatgtccttcattccaagttttattctgggcaccagggattcaggggtgaaaaagatgctgcctaagacaatatggaactcttagtatatttggaaaacagctgagaaagtgatacaattactgaagagtgaattaactaacgcgtggtcacagatgagagtttctctcactccgcatggaatgtcagaatgcttccaagaggaaatgacacctgacatgactttgctgatttgaaggaattcctagaattaaaacaagttctagaaaacattccaatatacaaaggctcagaagtacaaaagcacaggaggcatttagagggatgacaaggagtgctgtattttaggtcacaatgtgccaagtaaaaagaatgattggtaagaagatgataagaacccaagtaatacagccttgttatgtactggaacagaggtgactcagatatatttggtgtctagcttcttttggaggactggctttggtggtctctatattctgggacaacagcagatgtcagtagtgtcttttatccatggcttatgatgcttaggccacagagcaaataccagaatagtctctaagggggagagaccaggaaactttgagccaggaaattttgtctacaagcagctagggatcctgagccaagcatgagaagccaagattgagagccaaatgggaatctgagacttagacagatgagtgcagagagcagtgagacagaacaggcaaattggtgtcaatttgggtaagttctgaaggtagctgaaaaacccatgagaaaatgtttcagcactcttggcgatttgtttatgtgtgtggttgctttgagggtccatagtaggacagttatctggcacacagttggttcgcaacagggtgtgtggttgtgttatactatttgtctatttacatatttgcctacatacaatgattcaccttagagtcaagaatctcttcgatggagaaaatcttttaggacgctttaatatgaagtgtataggtctggtgcagtggctcacgcctgtaatcccagcactttgggagaccgaggcgggtggatcacctgaggtcaggagttcaagaccatcctggccaacatggcgaaactccgtctctactaaaaatcaaaaacaaaatcaaaaataagctgggcgtggtggcacatgcctgtaatcccagctactcgagaggctgaggcaggagaatctcttgaacctgggaggtggaggttgcagtgagccgagattatgccattgcactccagcctgggcaacaagagctaaactctacctcaacaacaacaacaacaacaacaacaacaacaacaacaacaacaaaatgaagtgtataaaattcattataaaacatcatcttcttgttcattgctgtacaacagagcctattatagtgtctggagtagatgtaatctcaattgaaatgaaatgaaatagctatctaatgaagccgcccttaaaaaccaggttaattgtggcagagaattgatttctacacattcttcatctttaattttatttatttattaaaagtttttttttttatttcaatagatttgtggtaaaaatggacaggatttagggtgacatggatgaattgtgtagtgatgaaatctgggtttttagtgtgcccatcaccctaatagcatacattgtacccaatagatgattttttcatccctcaccatcctcctaccctcatcccttctgagtctccaatgcccattataccactctgtatgcctttgtaaactcatagcttagctcccacttataagtgagaagatgttgtacttgattttccattcctgggttatttcacttaggataatggcctccaggtccatccaagttgctgtaaaagacattattttgttcttttttatggctgagtagtattccatgatataaatccatgacattgtagttacccactcaccagtcgatggctacttaggttgattttatatctttggaattatgacttgggctgggaaaaaacatatgagtgcagctgttttcgatattatggtttattttccttttggtagatatccagcagtaggattgctggatcaaatgttagatctacttttagttctttgagaaatttccatactgttttccatagaggttatactaactaacattcccaccaactaacattcccaccagtgtataagtgttccctttgcatcatatctgtgccaatatctattgttttttgactttttaataatgacaattcttattggggtaaggtagtatctcactgtggttttaatttgcatttccctgataatctttaattctaaaactgaaagaatgctttaaaatagtaatataagcatcaactttattaaaaaattaaaaattgaaataaataatttaagacaagcattaaactaaaatgaaaaattatactaatacaagtaacagactttataacaaaatatagaggaatgctttgcaaaacgttacctaactttggaaaaaaagagggatttttatgattaaaacatcagaacaaataatttttgcagtttaaaatggccttttaggaagttttaaaggtcactatagaggtataaaacatgaaattttgagagctgagagaaaagaacggatagattatttgatacaatcagtttctattgtaggtgagttgagacccacaaaatgacttactaaaaagggttttttatatgagaccctctcttacacatttttttcctgtacttgggatgatacactataatcaagtataatacaacagagtctttattgcccctacctataagctcttaagcataggcattatacaaaaacgagtatcactgcatctccaaaacgcagcatggagctaggcatgataggaagtcaatgaatatttgatggatgactaaataaattaatgaataaatgctggtctatgtataaaagtctgcccatgtggggaaaaataatattttacataagattgatatctcctgcattaatatgcatctgttctctttcctgtctatactagaactcatcatagaacactttaattagtataaagttctgagatagccagtgcctgattttttttccacattagcgaagctagatttgttaagactcataagttcatgtgatgccaacagttttcccagtcatctgtgcctgaacgcttaacgtggttatctttctatggggaatgtaccttttccaaattaactctgagaactctggttgattctaggtttatcctagctttagcctcttctttggagaggctaagttgttttatatctgatatcatcatattttcctggcaaagattaagaatttagtccaaatacacaaacttactttaagatgagccatattataaacactaagtaaagtctgtttctagtggttgtgaaattgaccaagatgaaaactgaattaacattttcttttctttttttggtcagtctaatagagtaatgtatttattaatttttccagcttcattgcagtacagttgacaaataaaaattgtatatattaaaggtgtatagcatgttgtgaaatgatcaccataatcaaactaattaacatatcaatcacctcttatcattgtgatttttcgtgtgtggtgagaatacttaagatcaactctttcagcaaatttcaagtatacaacacagtattactaatattttctttgatttgagtcatacaagaggaggccaagttgaaccattaaaccataagacatgatgctgtctgacactctcattcaaaacaactccttttctaaaagacacagcctcccagccaatgctatttgtaaacagatgactgaagatattggcttaatactaaaaggatactcaacactttctttttcattagattttcttgcagaagatcactgatgtgtgggttcaatagggtatttattcttcagaacttacatatagctagggttgtgtgggctgcgtattattgagattgtaatctttggagagatgactacttcagatatccccttctgcttataagaaagggatgagcagcagttcataacagtgggaatatcaaatcatgggacagcaggctattgccactcacttctgtgttccataaagatcactgtgtaatgctctgaaaatgcttttgagcaaatgcagacagattctcaaagaattctctctacagcagcaaaatacaatggtaatttttttcatattataatattttattctcatattcaatagaaaataaatataatagtaccattctccttacaatttggattccttttctttcagtgaaactaacttctatgcctgttgattattcatattgtatcaggatgatagtagaaaaatgtccaccagtcattaatacaacacaccagatggaaaaaaaccaagcatctctcttttaatagcagaaactctgaaatgtattaagaaggtactctttataagaatagctattttctcttagacatctgttttattctcctataagattcgatccatgcttcagagtcatattctttggaatattaagtagcttgagaagttattacttagagtgtaaaaacatagacttgtagccagttgactgaagaatgtaattcattgggatgttatggtaatatagatctattctattaactacccccaactattctatgttgactccaaccttccaacagggtaaagggtctcttcctaacaccttggtcagattccataactttcctgacacatgttttaactagaatagcctcatttaagtatataaagtgtcaaagtttgttttaaaactataatgtcaaactctttataaagtttatttccctgcaatgcttagtgctaactagatgaactagtcactccacacatattagtttctgatagaactatataaagcaaatactgttatcatccccattttacaaatgaggaaattgaggttcatataggttatttgtacaatttgtacaataatgagcagcaagtaaactgtagatacctagttctgaagcctgagccatttccagtaaaacttactacacaatagtaatgaagatttcattaccaccctttgtgccacatttaagccatttttaaaatgcatttgtaatcctttagaatgatattcttgaaacatacaccttgctcatcttccacgaaggctccagaggttagaaactcacaaatatatattttttttctaaaaagagatcccttttcaatttccttcatgggtcttcgatgtgtccaattttccacacccaattttttatatattaacacatcatcagtgctgtccatgttatttttacatgctttaatatgttgacaacattaaacataaaatcaaggtttcttgtttacaagttacatagctgaatgtaaagaagatccctgggcccttatttctttttttccatcttattcagaggaggattgaaattctttgtttgatggtcattctaatattacacatttccccttttgagatagtgattatttcctcaaacctattttctctggtttctgtttgacttctaaggcatcagccaattttagatattcatttagcttgtcgtttgcctcatgacttttattttcttggccaatagttaatcatcaaaataaccctcaaaatcctaatatctgcgattgctgaaatgtacgttttcaattttcctcaagtaatctttcagctgttttttggtaatggctacaatggcaagatgtttgctaatcactagtgatctcacatgttcttttttgaaaatggacttaaaacacctacatattctttcttccaaaattttcatattttgttctttctctccttttgctaatacatttatttttgttttaatgcttctgcctacttaaacgcacttataaaagcctttctaagttagcaaaactgcaaaatgttcatggtgatcttgataaaatagctcctagatatgtaataagatcatttctacccatgaccagatgatcatgcaaatttcagtttacctttgacaattcaatttttaaagataaaaatgtctaattgttgctataactaaagaaatggtactccaaaattcaaggtcttacttctctaatattttagtgctactgtcacttgcccaataaattatccagatcatttgattaaaatgaatatttaggttttgactgttcatctgcatttcactttactttttatcccccatttgaataattgtctttcaagcaaagagaggctgaaataaactgtaacagacattttaaaattccacaattttaattgtgattggtgcctgtaaatttgccatgtggaagatcttgaaaaagcagatgaggagaaagggaaggtggtcaggtcattttctttttcttcagaaatgaaatttttgtctagttctatgtgtttcaatggaaaaagacctgttttatttatctaagtgagcaaatgaaagcacacagtctgagctttcatggaccatatcagctgagaaactaaaaatatttaatgttttggttgatgttgaaaatttctgttgcaacatgttgcataaatatcacatcacgttttaaaaacaactccacttgttctccagtatcttctgccttatcaaactataagtccaggttattgaaagtgatactgcaagtcacattgaaatgtaaaatttcatcttctcaaaatttttgcttaattatgtaatagactttattcattcacccacacatatttcaagctaaaaaatttattaaggaccttctgtatactgtgcactatacttggcatatgaatacaacaatcaattaagaagtcattaaattcaaacagcttaagatctagtggtagaaaattagatgacggttaaagcaaggtatgatatatgcttatgaagaaatagaaaattagtgctaagggtacacatagaacacacagaaacaatgcctccagctgttacaatggtttccttcctcttctttttatttatttatttatttatttatttatttatttatttatttattttgagacagggtctcacttgttgcccaggctacagttcaggggtgtgatcatagctcatgggaaccctgcactcctggatggactcaagtgagcctcctgcctcagctaagactacatgcatgtgccatcatgagtagctaggaccacaggcatgcaccactatgactagctaatatatacatatacatatattttttaatagagacagggtcttgcaatattgcccaggttggtcttggattcctggcttaagcaagtctctcatctcagcctccaaaaacgctaagattataggcaagagccaccacacccagttagcttacttcttttgaatacttgtacagaaaagtgtgcagcatatggttataaatttatatatattccattttttctctggaataggatgttgcctaacagacaagagatttgagcagaagggagatttattttgcctttactaattatcttttgagataaagacataccttcttttaaaaaatccattgtctattccagacagcaaaaagtaaaggaattcattaccgctagatcagtcttacaagaaattcttaagggagtcctacaactggaagtaaacagatgatattattatcatgaaaaaatacaaaagcataaaactcactggtggagcagatacacaaaaaggaaagagaaaagaaagaactaaaccttatcactaaagaaaaccaccaaaatgcaatgacaaacaatagggaggaagaaaggagcaaggaatacacatgaacaaccaaaaacaattaagagaatgacaggagtaagtcttcatctatcaataataacctgaatgtacatggattaaatttccacttaaaagatacagactggctgaatggattttaaaaataacccatttatatgcagcctacagaaaaatcactttacctgtaaagacacctatagactgaaagtgaaggaatgaaaaaagacatttcacacaaatagaaaacaaaattgagcagtggttgatatacctatatcggaaacaaacaggcttcaagtaaaaaactgtagaaagagataaaggtcattatgtaatgacaaatggataaattcagtgagtatataacaattacatatgcacccagtatcagagcacccaggtgtctaaataaaatattagatctaaagagagagatagactctaatacaataatagttgggaacttcaacatcctactctcaatactggaaagatatatagacagaacataaacaaaaaacataggatttaagctgcactttaaacaaaatggacctagtagacatttgcagaacatttcacctaacagatgcagaatacatatttttttcatcagcacatggaaccttctccagaatagaccatatcttagtgtgcaaaacaagtctcaacaaattcaaataagtggaaatcatatcaagcaccttttctgaccacattgaactaaaagtagaaatcaacaataagagaaactttggaaattatacaaatacatggagattaaacaacatactcctgaatgaccaatgggtcaatgaagaaattaaggagaagattaagaaatttcttgaaataaacaaaaatagaaacacctcatactaaaacctgtgggatacagcaaaaacaatattaaggaggaagtttctagcaaaaaaaactatatcaaaaaagtagaaatatttcaaataaacaacctaatggtacatctcaagaaattggaaaagcaaaaacaaaccaaatccaaaattaaaagaaaaaaagaaatactgaggatcagaattgaaataaaatcaagacaacaaattacaaaagatcaatgaaattaaaagttctttttttaaaaggtaaagaaaatcaacaaaccattagctagactaatcaataaaaaaatacccaagtaagtaagtgaaatcagaaatgaaaaagaaaatattagaactgataccacagaaaaacaaaggatcattagagactgctgggaacaactatacaccacagaattggaaaagctagtggaagtgggtatattcctgaacacatacaacctaccaagattaaaccaagaggaaatagaaaacctgaacagaccaattatgagtaatgagattgaatctgtaatgaaaatgctctcattaaaaaataatctcaatggcttcactgctgaattataccaactatttaaagaactaatatgacttcttctcaaactcttccagaaaactgaagaggaggtaattttttcaaattcattctacaaagtcattatcactctgataccaaaattagctaaggacacaacaaaaaaagaaaactataggccaacatacctggcaaacacagatgcaaaaattctcaacgaaatactagcaaaccaatttcagcagcacattaaaaaggttgtttaccatgatcaaatggaatttaccccagaaatgcaagaatgcttcaacctatgcaaattcataaaaatgatacattacatcaacagaatgaaggacaaaaaacagttgataaaattcaacatcctttataataaaaactctcaaccagttaagtatagaagaaatgcacctcaacacaataaaggccagaaacagcaaacccacaactaacatcatacagattgggaaaagttgtaaactttttctctaagatctagaacaagacaaggatgcccactttcatcacctttattcaacatagtactgggagtcttagctggagcaattaggcatgagaagaaaataaagaacatccacaggaaaggaggaaatcaaattattcctatttgcagataatataacataaccttacatgtaagaaaacccttatatagaaatccctaaaagctgctccaaaaactcttagagctgataaattaattcaataaagtttcaacatacaaaatcagcacacagagatcagtagcattccaacacaccaataaggaactagcaaaaaagaagtcaagaaagcatttacaatagctacaaaaatatacctagtaataaaattaatcaaagaagttaaaaaaaaaactctacaataaaactataaaacacactgatgaaagaaaccaaagaaacaaagacacagaaagacatcccatgttcatgaattgaaagaaatttatgattatgaattccgtgataatattgtgaaaatgaccatactattcaaagcaatatacagtttcaatgcaatccctatcaaaatatcaatgacattctttacagaaaaaattttaaaattctaaaatgtgtatagaaccacagaagatcctgaatagctaaaacaatcctgaacaaaaaggacaaagctggaggcatcaaattgatgtatttcaaaacatattacaaagctatagtaacaaaaaccagatggtgcaggcataaaaacaggcacatagaccaagggaacagaatacagaatccaaaaataaacccacatatttacagccaaatgattttcaacaaaagcaccaagaacattcattggaaaggaacagtctcttcaattaatggtgctaggaaaactggatatccttatgcagaaaaataaaactagacccctatctttcaccatatacaaaatttaactcaaaatttgagacttaactgtaagacctgaaactatgaaactactagaaggaaaacatagaagaaatgctttattacattagtctgggcaaagattttatggaaaagactggaaaaacacaggcaactaaagcaaaaatagacaaatggaatcacatcaaaccaaaaatcttctgtacagcaaaggaaacagagtgaagagacaatctgcagaataggagaaaatatttactaactatttattggacaggaattaatatccaaattatacaaagaattcaaacaactcaacacacacaaaacccacaaaatgaataatttggtaaaaaatgagcaaatgagctgaacagactctctcaaaagaagacatacaaatggtaagaggcatatgaaaacatgctcaacattactaatcattagggaaatgcaaatcaaattacaataagatatcatctcatcccagttagaacggctattatcaaaaagacacaaaatagcaaatgctggtgaggatatggagaaaaagggattctatttttttttcttttttgagatacagtctcactagttgcccaggctggtctcaaactcttgggctcaagcaatccttccaccttagtttcccagagtgttaggattacagatgtgagccactgcccctgaccaaagagctcttattcactgttggtgggaatgtaagttagtatactcattatggaaaacagtatagaagttccgcaaaaaactaaaaatagaactaccatatgatccatcaattccattactgggtatatatccaaaggaaatgaaattggtatgtctaacagatatctgctttcccgtgtttattgcagcaatattcacaatagccaagatatagaatcaatctaagtgtccatcaatagatgaatggacagagaaaatgtggtatatatacataataaaatactatttaaccataaaaaataatgaaattttgtatttgcggcgacataaatggactggaggtcattatgttaagtgaaataaaccaggcacagaaagacaagcatcacatgttctcacttatttgtgggatctaaaaatcaaaacaattaaactcgtggtgatagagaggaaaaggatgattaccagaggctgggaaaggtagtggcacaagtaaattctcacatcacccatccaaattattcattttagcaacttttataatcaatattgattactgcagccaagttgattgtatgagaatctgcatcaaatattaaggctgaacaaacaatttgccacaatagacatttatttttggtgtacagatccattcagtaggtctttatttaaggtcattaaaaaataagactatggatctttttttttttttttgtgaagatgactcatgggagaggtgtgagactaaacctactcaggcatgacctttttagacaggcaggaaaatgtacttctaacaatagtgatatcaacctccatttgcatagcaagattttcaaaggtccttctactatttcctattattctcgtgacaattctgttatttagacaacacagttattcctctcttcattatgcaaatgatgaaaccaaagaaagagagattacactgaaaacatggtcaacaagaaaatgtaattcctttaactaagacctcagcacactccagtacctagcatgcttacttaataccactgaagaactctacttctctgagtgccatgtctttagtaactatagtataaattgtctcaaaattcattcaattactctcaggtttccccatatgcctttccttctttaggcatttcacttagagtggaaacaataaacctccaagtttggctggcttgaatcatgtataaaagaaaatggttccattgattattaggtataatgtgagatatttgccagaacggtttgactactactgactatatcattattttagttctttgtatttttagtgatcattttttgcctttattatttgctcaactatattgctaattcctcatgaaccattgttaactcttagagaagaaatgataatttatactttgtattcttagcacctatgcttaaacatagatggtcactaaaaataaatgcttgttgataattttatgtagaagataatttaatatatgcatataattgggagccaacagttcccaaatgaataaaaactgcgggaagaaaagcttctttcaggttactaaatctaccatacaacttaggcattgctcaccatctgctgtatttaagctttttatattgtatcatgtttcatacaggaaatgtcactgtaagactaacttcatgatgttttccttcatttcaatatagtatattttgatctatttgaagttcattcatccaacaaatacttaccaatctccctttctatgccagacactggatatgagctcagcccatagaaatatgcataaaattggcctggactttaagaaactttacattttatagttaatttaaaacatgtgcattctctatttttaaaacatgtacattctatttctatctcttctcaattcccatttctccttaacttttttcgtatttgtttatctagtccagcagcaaataacaaaaaggcttcttttattgaatactcactgagtagctagctgtgaggaactctgctaagtgctcttagcacaatgccttgttgaattctatgtaagccctggagcaaacctacttggtgttattattatctgtttattttgcagtggagaaaataaaagtatagagtagtctaatgatttgcatacgatccatggctcacgtaggggagccaggattgaacccagatttgttctcttcaaattcccttcacttgcccattgtgatgggtatactaagaatgaagtaaatgatttatacaactgttggacttttgtggcttgcacactttttcttttcctgatgtatgtgaatcaatagaaacacatgtagagaatagaaggaatatagagaggggcttgaaataatatccacatgggctgaaggaagtgaggctgttcagatggaaaaataaaaccctgtgaaggaatataacatctttctgccttcaaggatgtcatgtgaaagaggaattttacttgcctgttaccgtaaccacagagctaagagagggtcattgttaaaaggaagcaagtttgggttccatatgaggaaggatttttataatagaattgttgtagaataaactaattcagaaagaggagaatccaatttgtagagatgttcaaacatgacagtattacggaggggcctcagcaggatggggaagtgaaagagagattgtgactgtagctctgcctctgaaggctaaagagcaaaagaaattggcagtcttacacagcccccaggatcagccccattgagcagcagagttcactgtttcatagaaagaggagtaagggggcatatttctggttgtaaatgagatacttataagagacatacacagatttgcctcccttttatatagagataagtttcttgagaaaacatttatgattaatgttacatctaagatatgcaacgagggacccaacattttatagcattttgcttaaaaatccttaagccttacttttattgaaaggttagcccaacttagtagtagaagtttatattagtttcaaagggtctccatgcataagatgaggtctaatgaaaaggcaaaaattcctgttccctagctgctggtggtattgagggtgacacacacacacacacacacacacacacattttgcaccaatgcttattttgtttgcccttctggctctctattctttctgtattaaactcgaggtctgtaaggaaaagggcaagctatgagtacatattggcgagtacatttatatttctcattttgtaaagacacagaagctgagatcactgcatatcaagttccaggcagagggaactttccttgccaaagttaaaatctgctaaacctgaagattgggattgaaatgactccttagtgccaaataaagttatagggtcattgacatcttttagtaataggagacagcaaagccctatggaccacattcaaagtgtacgctcttccctctctgctttgtctccttagttccagagattcccactggagcacacaggacctgatcctcatttgacctgtctccctggggagcttttctctgggtagaggtttctttaacttcaaagaaacttcaaagacagagagaggaaaagagctgatggggttctctaaacctgccctcttcattgcctatgaactacttcaacaaggacttcttaagaatctataaaacatgtgtaactcctggttgcattctcttaaggagcttatactctctgtggagggacgaaatgtagacaaatgacctaataaaaagtggaatgcaccctaaaagtagaacaaagagccacatgttttaaaatacaaaagtaagctggaataatcatagaaagttttgagcatatggaattttaattaagatgctgaatgatgggcagaattttggtttataaaaaagagaggagaatgacattttaaaatgaagaaagaaatggtcatagtgtaggtgcaaaggtgaaataagaaggcatttgtggttcttgttcagattagttaaaatttagggcttataaaggggaaataaaacttacacaaattatgatcaggatcttgctatgcatatggggatagacactgaacagtttttaggaaggaaatcatagttttaaaaggaatgctttagagagattactataataatctttatattgccatggtcttttaaaatatggtggtgattttctttctaacaggaagccagatttcctgttgacagtaaggaaggtgggcatgcaattgggatcttcaaaagtatgaaaaatttggaaagttactatgaggattttaatctagtaggaaagaaataaaacattgcaatgagatccaagcaggctgaggtcagaaagcccagattatgaagcgcgaattagtaactaccagcataatactgtagttagcagttctggagttgaaacatgaaaagaagatggtggcgagcactcaaggtcaggaatgtgcatggcaagtaggtcagagaataaagaagtcctggaaattctagcatatagagagggcaggattgagaatggctaaatgttagtttcttttccggtggaaaagtaaataaagtgtatgtatatatttaccatttttctgagcacctatgtgtgtgaggcaaggtataaaaccattaatttttacaaactccatgtgttagatgttgatgttatcatgttacagacaaggaaatagagagttggaatgggactggtatggctggtacgagataggattaggactctagaccaggcctgcctggttagaagagagtggttggttgttttctttggatggcaaggtgaagataaatgggtgaagtggccacttttggagaagcctgggtcaagacatgccaggtggctcttaggaggtaaaaggaggattatacaatgaagggcaagaggagctcaactactgttttgggtgactattcatgtcatatgttagatgttagaataatacaattctctaaaattaatataatacaaaatagtaaatctcaggatcagagtggctttccagaggaatgcaagttaataccccagtgttattattggcaccccccacagtcctgtgaaagaaagactgctctggccagcaggaggacactagagtcagtcactcttctacaaccagggcctatccaagagataacctcaaactgtgaatacaggagcccctcaggccatctgcttgaaactcctctggtagagtgtaggagaggacaccaaactggggtaaaaaggagattaggtctaggctggtgtcctcgccctggggcactgcttgcttggccaatcccagtcactagacagggatttacaaaacatggggcaggggattgggagaaggagggctgaggcttgatcctttccttgggtctgcggtggctctgctgtaagtgcagcactgtttactatagacacttcagtgttgaaaagcacgttttctcctgtcagagagaactactttagattccaatccctgtcactcgccaaatactagttatgtaattttgagtaaattgcttccctgggtctcagctttctcatttctgtaaaagtgggactaagatgtctctcttgtcagctacttggtatttgccccacaactaatagcacagcaactggcacattgcccaaatcaaaaaatggtagcttctactagctgacaataggttatagaaaaaggaagtaatctatttaatgatagaagtttgctttaaaaattcacattacttcacataaagtcaccaaattagatcatggtaggatctcatttttataaagaaaaaaaaggaagattggaataaagtaagaaagagtgtggaaggtgaattaatgattgttctttttgctttttttgtgtatattttctgttttttttttgtgtgtatttttgtgcttataatgacactgcttttgtaatttcaaaaaaggcaacagaattaaataagagcaattgtattgaaaaagtgaaaatatagctttaaaaaatatttttaggtctttgtttctcactattccccatgtttcaaattcaaaatgcttaggaatttagaacatttttggttcatttataactatattataataacatatctagcaattttaaaagagatacacttgttcacatatacatttatgactcaatctgtattgcctcaaattttctccactcaaacacaactggttttgttctttctgttccactccattgcttgcccatatataaacaagtactacatgttgtaatcatagagtgtatagagatgttgtgtgcttttttcacttaacatttttcacattgccccatagtctccatatccgtgacttttcccggctgtttagtaatcttctattaagcactgtgatgttatttgtttccctaagtttgaacatttcagacacttccccattttaaaagcatggactaaccacacaaccataaagttttgtgcaaatatataaaaacctttttcttctggtgaactgtttccttagaataaaaatttttcagagatacaagtaatatttttctggttattaaaatttatttccaaatagtttttcaaaacgtctctatagatttacaaatacactcgcttggcagctgtggtagtttgttggtcttctggtccagtctcacattctccttattatcattttaatttgtatttctctgatcactagcaggtttaagcattgtcacttccatgctcactttttatgtttcttctagtagctctgacatttggaaataaatgcaaccttttcaagtgtaagggaagcagatgaagttccttagtcatcgttttttttttttttacttgttttaaaactaacaaaaagtattcattctacttttgaattgtccccaaaatgccaaatgcggcaattggagatcagaaataaaaagcaaatccatccattgttttgcttttgcgccatctcaccctcaaaaaagaaactgagggccttgatatgtccttgctgaacattctgagacccgaggcaccaattccacagtctcctggaggaactggttgttgagacagtcgaaacaatcatactttggataacggattgaattactaaccagaatcaaccatttatgggccagttagtttggttgttatagcaacaaaacttgatttggcattcagttattcagtcaatagttcagcagcattcagccaatgacctgcaaatagtacatgctgtcgataatgaaggctgcctttcctttctcaataaaccttatgccaaagtccatctgcaaatgttcaggggttagtatttcgggtttgaagcgtctctccctccccttaccacctgcccctggaaatggatccaggccttcttctggatattggcattagcttaagtcagaaattatacaaagatgtgcacagcagcatagctggatagaacgctgtgtcactcgttagatcccagctttgggaagctgaggggatttaatttgctttactcagttttataggagaaccagagaaaatggctgccctggaggatcaagtagtttctctccttcctggcacttcctgagttttgctctgtcttacattaatcattctgaatgtgactctccctcatggcccattgaactgtggatcaatcacaacattttcaaagtgctgtaatttcatacatatttcaacacagacctaagagtttccatatacgttgaccattccgggcaaatgcttcatagactagtaacctaatatgcttagtaatcccttagggaagcaagtgcagtagttagctgcagctctagaggtaaatctctacctggatgtctgttccacttgtaagaagttttacattctatctttaggcaactgttacttacacaattacacaaaaatgtataaaatttttcatccaagaacctattttgaatttacatttaaagtgtatatgcatgcatttaagaagtcatagaataataaaaaaaattttgggggaaagccactgcttgattaaagccaacttataggctccaccaacaataaagaagctataaacattatctcctgttgctcatgtggcaacattaaaaatgtgttgccacctgacatggtggctcacgcctgtaatcccagcactttgggaggctgtggcgggtggatcacttgaggtcaggagtcagcctgggcaacatgatgaaaccccaccattaataaaaatacaaaaattagcccggtgtggtggtggatgcctgtagtcccagctacaggctgaggcaggagaatcgcttgaacctgggaggcagagcttgcagtgagccaaaatggctgctctgtactccaatctaggtgacagagtgagactccatctaaaaaaaaaaaaatgttgcaccgaatctaatatatcttcctgtgggtgcttccacaagctatggtatatataatctagatttatgttctattttttaaaaaatctaaataaaattttattttaatgttttgataggtcattttatttttgctaatctttctgcagaaagacaatgctgccaacaaaccatcaaccaatgtatgatgtacattttgagggcatctatttgcttttccagtagtagggatggctttgattcttttacatattattctactttctgtctccaaccaaagtatacataggggaaatgctcaaccagaatttaaagtacaacacagctaactgacccacaaaatgattgaacccagaacaccagcttgatcagtatgccaagtcagttttctgttacatggtagccttttaaataaagaacatggcaagctggagttggttagtcaaactcattttccttaaatcaaggaagaactaatagtctcttgtaatgaatgtctcttttttcccatttgctttgttattgactacatgcctgaacaatttagcaaatttaatgcagcagattttacaaagaactttttttgacctgtcataatattaaaaagccgagtttgggtaatagtttctgactattttgataaagggattatatttttaaactcacaggtaataactctgtagctttctttagtccagaatatctaatcatggaagatctctggagacagaaagaagatttctagatatgagtccctccgttttttaaaaggacacattctatttttataaacaagtctcgaactgaggtcacagatagagtttcaagagtcaaggtcatccaatttggggcttcaatttttgatgttaagttccacagttgatactgatatccatttccctctccatttttgtctccctctcttggtttctaaaattgttttcagtatcaggtgttttcttttgtcttttcttgctgcatttggaatgaggctaacttccttctggccttaagactgcctgtagggagggatttgcacacagggttgggcaacctccccaaacaggatgatgaaaattccctcaagcccttcttctaggcaggttcccctgatatccaatcttcgagttccagccaagtacaaaatgcagatctctaaacacttgattctttctttgaagctatctgcccttgcccatatcattttgcattccagggtagagaataaaaattctttttggttataactgagaacatgaagtgtttggttttctgttcctgtgttcattgctgaggataatggcatccagctccatccatatcactgcaaaggacatgatctcattcctttttatgactgcatagtattccttggtgtatatatacattttctttatccagtctattattgatgggcatttgggttccatgtctttgctattgtgaatagtgctataatatacacgtgcatgtatctttattatggaatgatttatattcatttgggcatataactagtaatgggagctgaacaatgagaacaaatggacacagggaggcgaaaaacacacactgggacctgtcagggaggagtgggagggagagcatcaggataaatagctaatgcacgcacggcttaatacctgagtgatgggttgacaggtgcagaaaatcatcatggtacacatttacctatgtaagaaacctgtacatcctgcacatacatcccagaacttaaaaggaaaataaaattaacttttttaaaaaaatcaacaaatacatattcatttaaatgggaaaaaatattttttgtttaaacactctcctgtccatgttcagtcttttcattcctatgtcctttccatgattccttctttggatctgaaccactccaaaaaaaggatggtgccgggcatttgatattcatggcttatatatcatgaccatttaaccatgtcatttagctacttaggtcagtcattagtcttatcagtttagctgatgtattttaaagctttcaaatcttgtttagctttagtttccgctaacataaagagaaaatatgggcagatatgaaatgcagtgctacagataaacggatttatttaagagccaagtagaagaagatgacttttctttccagtaaacgtcttacctgttctaagctcccaatgaattttagtgtgatcatgtgggcagatgagtgatctaacacatggtgtgaccgttttcaaaacaaacatatacggatgattcagggttgataaccaaacatgctctcttcttgacatatcagaccactgtcagaaaagaaaaagggcttactttggaaagagacctcactttttggccccactctctgatgatgaaaagccctttatgttggaattgtccttgttctgcttccagttgcgtgaccttgagcaagtcacaacctccatgtttgtttattcaacactacatgagtaaattagattttcatgaccctttcagttaaagaatctagaactatatatagagcaaagaatccataaattcagaggtaatgaagccattttatttttcattgttcgtttgtcagccacaaaattaacatgagttgggttggtgttaaatagaagacccagtccaagtgagattaactgagactaagagttaagtgtacacccagtcgacctctgagtactcactgatcagtgctgctccgtgaatgcactttccagaaacttaacacagcatgttgtgctcatgaacccatcagccaactgaatatctcctaataacaatgaatggccaagccatttccacctttcacaagttactttaactcttctttcttaacaagaaggaaacactacggcatccaagacattgcttgggccagtgtgttggatgcatttgttgtactacatttttaatgatcaaactgtgaaaagttcttggcaataaagcagactatggaacacacaggaaaatgtgatttttaagggcaaagaaaaatctcctttcttttttacaatagcaaaatattttgggtcaggttctttgactaaaattcaattccccaaaagcctctaaagttttttcatcatttaaaaaaaaatcagaaaacatttctatttaaacagcacaactctaactccaatagaacctgcatagttttcccaacaaccctatcaatgcaatagtgttatgcagtctgggaataaatgaaattcatttttagcgtcaccatagtcttaagccaagtgatattgccaacaatgcagcaaagattagctctaatggagaagaaatgacagcctgaagaatttcttctcaaatttcttccaactgtcagtgagtcaaaaccacaaagagtaactgattcaacagcccagaaagagatgaggagctgaaaaacttccaatacctgtcaaagaaacttgtagtctttcttacattttgaaattaagttttacttatgtcaaccccatcagcacaaaggaataaactaacactctgtttatatgacaccacaccaaccaggcaattcagtgggcagtgaactcaaatcctttgattgactcaattttttactttcagtttgctatttcattatatttaattggccacaatcttaaaatggacatattctttcaatacattcatgtggtatttgatcaataacaactttctgccccagttagtcccagagattgcaataacatgctttcagttcttaatctgtgttaatcatctaaataaaaatcaatgcctgcaattctatatttagaagtagcacacaaactttgttgaaaattgtacttataatcttctattcaacatggaacaacctatgttgtttactgtcgtgagagtttgagttagtaatcaaaatatccaacccacttcattgagccaactttattaatgtctctgtgctgagagagattgagaaaaaatcaatttaagtctggtgaattttttactgataaaaaattttcccacttttgagaattaatcttttctaaaagacactacagaaatgtactcccatgaatgatcattacatgtataaaaatagttaaatatgtactaaatgagagaaagtgatttgaaatagtccccagatatttgaagtacatttttccccaatggtaataatccacttaggttataattgcttagctgaactgaattagttaaaaacagaagctatttttcagggaaaacaaactgcaatggctcttaattgctactaacatttgttaatagtttcagtttatttcatatggatttttattttctttttaaaattaatttttttttgtatttttattggcatatcatagttgcacatatttgggggtacatgtgatactttgatacgtatatccaatgtgtgatgatcaagtcagcgtcattgggatatctaccacctcaagcatttatcttttctttgtgctgggaacgttacaattctcttttagctattttgcagatttttattttcaagggtattatttggaaagatgtcattttgtctggcctaagccaaaatagcacttctagctgaaagcagctctcaaaatcagtcatgattacccataggaaataattattttattggggttggactttgtagattcaactactttagagagagcaaatatcccaccactgcataggatgatacagacaacacccaaaaagagaaggacagagaattcttacacgttaatggtctagtcacattttatttcctttccttctatacatgccccaaatcatacaac

SEQ ID NO: 157 - DNA, 171931 bp, Homo sapiens
cttatccttaattcatttcccctccatctaaagtagggttcatttgggctactatagaccaataatctaggttttaattgacatgtcatccaaaagcaattatcgaacacctggttgccttaggacagtttccccccattcatcctataggtgtagattcactgtcttcttaggtaaccgcttaaccattttgctctttaaatgacctatgaaaggcttgattttcttataatgaacacctataatgattttcaacaggccgggcacaggagctcatgcctgttatgccagcacttagggaggcccaggtggtggattgcttgagcccaggagttcaagacaagcctgggcaacatggtgaaatcttgtctctacaaaaaatagaaaaattagctgggcgtagtgatgtgtgcctatagtcccagctagtcgggaggctgaggtgggaggatcacttgcgcccaggaggcaaaggttgcagtgagcagtgatcgcaccactccagcctgggtgacagagcgagaccctgtctcaaaataaaaactaaaagaaaaaaaaaagcagattttcggcgtctggaattgcaaagtcatattcccaggaatcatgactatatcttcattgtaatttcatgacctactttttatttaattaaaaagactgttttgtcagttaccttctgtaaataaggctgacattcagccactgtgcaccaatacagctgtatcaattgttggtagccgatattcattctaatttgtgggtcccagctgttcaatatctaggtatctaaagccaacattgagatttatttgaacattgttcaaaataaagaaattgagcacattccccttaatatgaaaaggcttgtaaggactgggatatatcctacttttctgagggataatgttggggtgaggaaaaaaaaacctcgccctgtttttgggtgatgtaggagatgagaaaatcacccatgaagagatagtagataaaagaaggtggccttggacagagccctgggttgttccagcatgtagaggtttcacataagaggagtgagaaaaggaatttgagaaggagcaggcagggagatagcaggaaaactaaaagagtagtgaaaaagtatttttgagatgaacagggaagggatcaggtgtgtcaaatggtgatagatcgagcaatacgaggacaacacactgaccatggatttggcaaggcagaggctgttagtgagcttgaagagagctatttctttggagtaatgaggtatgagaatgattggataggggtgagtagagactgagatatgaagaagtagaggcagaaaaaaaagacaagtcttacgctctgaagggaagcagaaatgaagtaggattgagaaagataaaatttagtgtgcacattggagttgttagaagtaaaaagatgggccttggagaagaatttgggaagccagtagacaactaaaagtaacatttcatctcaaagactacagagatttgtggctttagagcctctgaaaggtacgtagtgcttggcctgctcatgtatgttagcagaggaataggatgtgatatgtatgtctagccacctgaaaaaatctctctttcagctttcttgtcgatgcttgcacatctttagaagaccatattcataccgaagggctttttcggaaatcaggatctgtgattcgcctaaaagcactaaaggtgagcatattgttgaactattaatttttcatttgagccattttctgatttggtttttaaaactgaaatatttagaactattaatatgaatagttgacagaaattgaatttgcatttttttcatggcagaagattttttttttccaaaagaaatggtatattatttctatcatgctttaaaaatttaatagggtacttttaaattcatggtccttatttctatcaagtattatgtaaaatgaaaaaaatgtgttaagttatattgttgttagccttctagaaggagtgatagagctgagtgtggtggcacatgcttgtagtcccagctacttgggaggctaaggcaggaagattgcttgagcctgggagtttgaagccagcccaggccacatagtctgtgccacatttctataaaaataaaaataaattcaaaaatcattaaaaataaagtagtgacatatattaaaataagagttaagagaaatttattaaagaaaagtgtaattagagtataacaaaagatactttatttgcaataaactcttaagttgccaaaatactcaagattattatatttatttcagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttaggtaagtggtaattaaaactcttggcaaataatagttgaatttttcaactaacgttttatgcttgtagatatgtacaatttcatttggaatggaaatttttctttaaaaattccatatttcattactatgaggagtatactccaatttaagaaacagcataccaaatgatttaatatttccttatcttaaagtcatcatcatgaatgccttaatggttcattggtgtttataagattcattgtccactgaaagcctttgtttactgggtttttaaaatatttctgttttgcttttcaaaatttccctctccctgctgtcagtgagcctgcttattctagacatacttgctgccttctgatacttccaactttttatgtgtaggtctgaaaatcagataaagatgttcaatttgtgtggaaaagcaaagtatgaactctaagattagcatggtttttagaatacatatttaaatatagagaggctatatatttctggttctttcttgtgttcaagccaatcatgtagatgaagggtaactattttgacttgtgtatgactgataataaggtcttcaaaatgtactacatacgttattttaactcttctgtattttcacgtttggctccatctaataaagcgtttattcacttaagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattggtaagatgtagttgcattattaacagaatttgtttaaatgaggaaaatctctgtttctttcaaaggaactatgaaggcaactgttagaaagttggtatattactgacctcacccccaccctacagtaccggcccctcctgcaaagaaaaaaagaaaagaaattggtatattagtatctaaacatttttggggaagagtggaggaaggataataattgtcttacttgtgaacattttcatttagggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggaggtaagtggcggtcccattttatggaggtacagtgatttgctttaatcgaaagtacatttcacataaagaagcatgaactgtggtatgtgcctttttggtgcttaaagcacagctggaaagataggacgtatgcgtgtaaaaagttaaagcgatagtacaatctaatgttaagtgctacatctttagcacaaacataaaatgtgttaaaaggagaaaagttccctggattgtaattatcagggacttgtcaaagaggagccaaactgaaccttcttgaataatggatagaatttagtgggattgggtggaggatcagaatacttgtatcctattctagatgagaaggatgctatgaagaaaggtttgtgtagggaagaagtaacctatgtctaatgtagatagtgcagtatgacttgagtgaagtgttcagcataaggataaaggatggtattatggtaaacttaatgccaggctaaagaattagaatattaacctgggtgttggtgaatcattgaagatttatgatgtgaggcatgatatgatttaaaaattttagaaaattacctgatttgaagaattgagacttggaagtagggagaatggtcagcaatgtgtgtcagtagtccaggcatcagattattgtttgaacttgttagtgacatggattagttaggagtacgaactaaataatgaaggaaatattatcaaggaagaatcagaaagaccaaaagaccatcataagatggtagagttggtaataaaacttgcaatctccttgatcaagaagtcagaggccattattcttccaattactttaggaaatttattatcttttgaatatcagaaccaaatgttactaactatcccaatccctttttcatcttttggtttatttgttattgcatacttgtgtttcttctttacctcctttgtagataggataatactgatgacttatgtatgattttcctagggctactgtagcaaagtactacaaactaggtggcttaaatcaacagaaatttgtctcaccgttctggaggctagaagtctgaaatcaaggtgttggcagaatgcctgaaacctgcaggggagaatcctttcttgcctcttcctggctcctggtagtggctgtcagtccttagcattccttggcttgcagccgcgtcactccaatccctgcctatgtcatcctatgatgttgctctgtgtcagaacttccctcttacagggcacattggattagggcccacccaaatgacctcattttaactcgagtacatctgtaaagacacgaattccaagtatggtcaccttcataggaactgggggttaggacttaaacataggttttttggagaacacaatgcaacccataaaacttcctatccccaatggagatatttctcagatgcagatcatctttattgccctctttcccagtcctgtagtttcagttatcaccagtcctgtagtttcagttatcacatctaaatagataaccaccacatctgtaccaccgttatcttgaaaatgtcagttccactttactaatggcttgctagggagacctcatcacatctgcttttcattggtgctttaagcttaacgttttgaaatgaccatctttatcctctttatcctggttctgtgtgaattccattttcttctaacagcaccactattccctagatactcaggctttaaccatgggttctacctcttcctctaccatctataatcagacagttttcatgtcgtataagattctatctccgtagtgtttattgcattgttactgtaagaatcttcttggccgggcgcgatggctcacgcctgtaattccagcactttgggaggccaaggtgggcggatcatgaggtcaggagatcgagaccatcctagctaacacagtgaaaccccgtctctactaagaatataaaaaattagctgggcgtggtggcgggcgcctgtagtcccagctacttgggaggctgaggcaggagaatggtgtgaacctgggaggcggaggttgtagttggctgagatcgggccactgcactccagcctgggcaacatagcgagactccgtctcaaaaataaaaattaaaaaaagaatcttcttggtctttatgcctcctccttgaatctaccctacatattgctattaaggctcacttttttttttttttttgagacggagtctgtctttgtcacccaggctggggtgcagtgatgctaccttggttcactgcaatctccacctcctgggttcaagcgattctcttgcctcagtctcccaagtagctgggattacaggtgcacgctaccacgcctggctaatttttgtatatttagtagaaagggggtttcactgtgttggccaggctggtctctaactcctgacatcaagtaatctgcttgccttggcctcccaaaatgctaggattacaggtgtgagccactgcacctggccaaggcttacattttaaatgtataactctactcaagtatctcacacacatacccttcagaaattttaattggtaatagggatatttatagcttggcattaaaggtctttcataggattgctctagcatacctgtctactatttcctgtctttgagcaactttagtcaaactatgttatttattttccagacacttttattcatttgcttacactatttattgatataatgtttttacttccatctctactgatcttttaaatacttttattcgtgcctccatttccatggttcttgcctcagttcagaccttcatcttttgccttaacatgtaatgatttctttttccctacccttactgtacattatatgtatttgtattacatttctttctgtattgtgtcttttttattttagggatatggaagtataagtggggaatggaataaaaatatatcctttagtatttttcctattttgaaataattcctcttaaataacttaaaatttataagccgatgtaaagttacatgttgaaagaagactgcaaatattaatatgaattattggtgaaagacaagtaaatgtgaagttgtaattgcttatgccttgcatttcagattttgttagtggagcactaaataaatttaaacctaacagaacaccttctattacacctcaagaagaaagaattggtaggtatttattatatgcatttatttaaattaaaatttgtatagtattctataaaatacaattacaataataattacctaacttagtaatcaaatttagtttaatcaaatcaaatattatttttaatagtcatactgtactatacacactatgttgtgacattgctaattacataggctataatgaacccaaaattgtaggcaaaaatttttttagtctcctgtctttaatcttcttaatcatgcttttctgtttgtaatttagatgctattaagcgtgtgaaaatagttcaacctcatttttatcttaggactagaagttcattattgtatatttcaattttttattctaatttgcttgtggctgaaattattcagccagtaagagtcaacatgatcttctgttttctagagtgaagaaatgaactggttaatactcacttatgatgaaaagcaaaaataatatttagattagtttttgtttcaactccttgattgtaatttcttccttacattaatattctttaatgtatatcatatgcatcttttagtctgttagatttaagtaactgctgtctcttaagagtcttgcctctgcgacttccttattttcatttaagtaattgcagagtgttttagttaaacaacatctacttaactgatgatgtaaatatattctcattttttgtttagctctaagtaatagctttataagaagaaattatgtaaagcttttatatgttgtcaactctgcagtagaaacaagttggttttgttttgatattttttcagcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcaggtagcaaatagaatttatataaatggattgtaaagattaaaatgagtgcctattctgggcacagtgcaatttcatattaataataccacccttaggaactagaactttattctgttttatccaacctatgaatttttataaaaccccctgccttttaaaatagacactgtttcaatatagtgtgtgtgtgtgtgtgtgtgtgtgtgtgtgtgttatgacaacatctattgaaagttgtgataacccagagtagtagtttgggcttctggtgatagcattgatgcttaggttttatgtgattagacatcctgaatcctgctatagttacatctgggtctatagctgtggctttattgctgtcatttgttgaattgaggttgccagatgtttgatcatgtctgattcccaagtgggagcgttactattgcaggttatggtttgaaaatgagggtatttttaaagttttagactcaagtaccttttgtaaaagctttagaactttgttgacgctgttccttgtgccatggcttccagatcccttaccagcccagccattttcttccatattaactacaagttctaatgtggccaaccagagccttcagagagtaatagagtatgatcatgctaatccggagattagtctgggtcttagattcaattggctcttttagcatatacagaattcaagttggctcatattaaccttacgatcaaccaaaaatgaaatgaaactctaagcccagggtcctccatctcatttatcttacatttagtcaaaatgtgagtgatctctgattattttagattttttattttgttggtttcagacaatgttaagtttcatttttgattcattatctgagttatatgagttccttcccaaagcctgtctcttttttctgttgtccaaaagggttcttatttgttttattgagaagttgaacagaatagcaacttgaggttttccagaaaaaaacacttcttcacaggttctctagggctcattgaaatgtgatgatagtaactctgaagcttatgtctgtagcttttgcagtgttcacaggttggagacttaaacttttttaagtaacatagttcagttgtttttttttttgaatatatcctttgcagtttggaggactttttccaaatggcaaatgggagttgtagttctacctgcctttgcttattagcattacattttccccaaggaatgaacatactgattccttcttctcctcctccaagctcccaaaacagaggttaaacagtcttgtgctatttttagtttgagcttgcctaatcaatgaatttttttataaaaaaatttaaaagttcaacaatagtaatcgtattatttttacaccacttttctttgaccctactttctcagccacaattcaacaaattccatttgcaaaattgaaaatagattgatttctaagtttagattataacaaatatgatgcttttaaaaatatataaaggcaacattagtctgtagtccatagagtatctattcataattgtctcttttttttttttttgagacagagttttgctcttgttgcccaggctagagtgcaatggcacaatctcggctcactgcagccaccacctctcaggttcaagcgattttcctgcctcagcctcccaggtagctgggattataggtggccaccaccacacctggctaattttcttttgcatttttagtagagacggggtttcaccacgttggccaggctggtcttgaactcccgacattagctgatcaacctgccttggtcttccaaagtgctgggattacaggtgtgagccaccatgcctggccataattttcttacagatgtgataaatttgcattgttccatatattctgactgtgcctcctgcgaccattgacacattttttatttttattttttgagacggagtctcgctctgtctcccaggctggagtacagtggcatgatcttggctcactacaacatccacctccgatgttcaagtgattcttgtgcctcagcctcctgagtagttgggattacaggcatgcaccaccacacccagctaatttttgtatttttagtagagatgggatttcaccatgttggccaggctggtttgaactcctggcctcaagcaatccgcccacctcagcctcccaaaatactgggattacagacgtgagtcacggtgcctggccggacacatttttaaagtgactagactgcagccctagaataaagctacttatgtcactttagatgtataatattggcttccaaaattttctttagctaaatgcacccaaaagtttctaaggtggttgtattttttccgttttcataattgaaaaaatgtgaatgtctctgggaaactttgtgaattctttattaataactcagatgaattgagagggttcatgtttgttgaatgtgtcctgggcgtgattcaaacataaatgtatatggagcctttgttcataactattttacttctttcgtaattgtttactatagttgatttcataatataaatggtgttaaataattgagcttctgttgtaccagtaattatttgcatggaacacagcagcagccaagggattaggaatgtgttatagaataattagtttttgtttacttgccaaaaatattgaacaaattacattccggagtcaggtgggtagcagttggccagcaggtatatctcaaatactcagattccaacttgtttgccaatagcttattttttataataccattaattggtattatgtactagatactgactaaatattttatatagataacagtaatattcatcatagaagtccgttttcagagcctaaagccatttagtaagtgatggagcaaactcaagcctgtctccaaatcttgttctttttccagtctgcaatggtgcctatccctgccttgtattattaacagagtttaaagaaaagctctaatataaaagtaatgcttaagctgacctttaattggcaagtcaaaagtaaaaaatgaatgctttttcttagctgagttgggttatttgacacttgaagtttctaaccagaaattaagtgatttcggttgttgcttgggatagaaattaaggctttgaatctaattgctgctattactattttatactttaaaaggaaaatagatatgtgtggtatattacatgtggttatttttgtagttcacatcgatacaagctcagaagggtcatctcagagttcactctctcctgtactcattggtggaaaccatttgatcactgcaggtgtgccaaggcgaagtaaaagaattgcaggcaaaaaagtttgcaggtactttatccaggacattttgttttcatcggataaatatttggtgtacacataattaataaaatgttttgtctttctgtcaagcatcatatttgagtcataattttttaaaatcccttctgcctttatagtcttattaatcaattgccttttcaatacccaccagagaaaaattactaatttgagtccgctttgcttgcttaaaatcctattttatgttgatggtgtaattttaaaatttcctgttagaggctgggcacggtggcttatgcctgtaatcctagcacttagggaggctgaggtgggtggagcacttgagctcaggagttcaagaccagcctgggcaacatggcaaaacctcatctctactaaaaagtacaaaaattagccaggcatggtgccacatgcctgtagtcccagctacctgggaggctgaggtgagaggatcatctgagcccagggatgtcaaggctacagtgagcagtgattatgccattatactccagcctgggccgcagagtgagaccctgtctcaaaaaataaaaaacaaagaaaaaaattcctgttaggttaaaaagctagcctattctaacaattctgagttataactgactgactaacttttaagattagcagatcattttttatgcaaatgcagtgtgttcatgtatggtatcttaaagttgaactgtttttaaagaattattaatccatccaattattatcaatatgatttgctgtggactttatttcaaatttcgtatttcaagtatttctctggtgtttatactataaactgacatttttaattccacttcttctagagtggaatcaggaaaagcaggctgcttttctcctaaaatcagccataaagaaaaggttcgaagatctctgcgtttgaaattcaatctagggaaaaatggcagagaagtagtaagtttcttaccattttattgatctttatattagcataacgctataaacttgatactaaaaaacactcatagccctaccttccttccagtgactgtctcattctgttctttttatccaaaactcttatacttgagttgatatcaaatttccttgcattggagtacccaaagcttagtccttggacttctcttttttctctccactcactcaaggtgatcatcagttttaaacattatatacaggttgagtagcacttatccagaatgcttgagaccagaagtatttcagattccccatttttgggggggattttggaatatttacattatttttactagttcagcatccctaatctgaaagtctggaatgctccagtgagcattttctttgaacatcatgtcaaatacttaaaagctttggatttttggagcatccagaactttggcttttcagatttggaatgcccaacctgtatttacttaaaacttccaagtttatgttctctagtcccaaatgctcttctgaatgactccgctgtctcttaacatctgcttttttgactctcctacttggatatctaatccaataggcatttcaaatgtaacctgtcccaagcagatggatttctttgctgctgctatgccctgcaccaaacaacacttttacctgtggttttccctatctcagttatggcaaatcgttcttccagtcacttaagccaaaaaccatggtcaaatccttgattcctcactttctctgagacaccatgtctaatccattagagaatcttgtctaacttctgcttttagagtatctccaaactgaccagttctcactattactacttttcccactttctctaagttctgtcatctctcagctggattactctagtaaactcctgttaatagttcttccttctcctacccttgctgcagttctgtagttgaaatttatcttttaaaatctgttaggttatgtagttttctgctcagaactctccagtgactcctcgtttcactctgaataaaagccagagttctcatgttgacctgcaaaggcctcacgtgatctgttctcaggctgcatttctgagctctcctccagtcccccttgctcactctgctccagtctcagagactgcactggcattctgctctttctgtagtgttcttcccccttaaatcttcatggctctcacctttgttttgttttactcacaaattatctcctcatcaccctattttaaactaaacctccattcttcaccactccatatcctttttactctgttttacttttctccgtagcacttttcaccttgtatattgtatttatgcaatataatttactgtttatcttaagtctaaatttccccatctaaatagaatgtaaattacataaggataagattttggtctaggtaccccactgccccaactatttgtgaacaggccctagcacagagtcagagcacacacagaaattattttaattaatatgtgagactgttttaaaaatagatcataaaatatcaactaatagcaaaatcaaatgattacagttttcattagcaggcaagaatgtttgtcattgttaagaattgtttctcaattatatatccctttttaaatcagctaaagattttgataactacaaaaaattattctgtctttatattttgaattaactaggcttatttcttaactaaaacttttttttttctgtacagaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgacttatttgccatgtgcttgggtattatttcaaaacaaggttaaatacaaaggattaagcactgaactgctttattttaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgacgttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatgggttcttctcactgtcttataaatgtaaataaagatctaatattaatttggttatctaataacaacttaatacatagaacttagtagactgcatggccacattctataatatgatcactaagaacttaatgtaggattttaatagtcatgtttttcttaattgtggcagaatttaaaccttaattttgtgatcttttttagttagtttgttttttgttttcttttcttttttttttttttttttttttgaggcggagtctcactctgtcgtccaggctggagtgcagtggcacaatctcagctcaccgcaacctccatctcccgagttcaagcgattcttctgcctcagcctcccaagtagttgggactacaggcatgcaccaccacgcccagctaatttttgtagttttagtagatacgggatttcaccatattggccaggctgatctcgaactcctgaccttgtgatcctcccaccttggcctcccaaagtgttgggattatgggcgtgagccactgcacctaacctctgtgatctcttaaatatatatgaagttttatttttgaaacaccaaatttcaaatgaagcataggcattttgatctatttcagttaaatttaacacaaaagcagtaaattgtagtgacttcatttttttcaaccacaaaatgaagataacaatgaacaaagctaaagtaaaactcagaattgaaaaaagtctctgtgcatcaataataaatactaactccagcatggccagtgagcctagagccatttaatggatagtgtttgtcctgttgatttagcatgcattgaaacaagaagcaagaagcagatgagcatccgtgaaagaaaaagtactgggaaagaggcttggcttcaaaatgaaaggccatgtgtctcataaatgaattttgccagcctctatttattgcataaaaattgctgtagatgataatggatttgctctctagagctaagataaatagatctggattctaacctcatcaggttacttgttttgagacccccaggttctttactcatcctccatcttgatcaaatttgtagtgccatatttattgtatggctttacattttgattttagtatttgaacaaatttcagtgttcaagattgcacatagtaggtgctccataaacccttatttaagaatctgggactacctggacatacttctacagtatgctgggagtatggtttctcttcaggccaaagtggaattttacttgatggtttgtgtggacgtttagaaataacactcagagctgatatttctacagattttcaagtttatcactttaatggaagtttctggcttcttgtattaaatatccccatagttttcctgattagtaagaggcccctcagagcagggtataccttatcatagccaccattaaaagttcttaggacttcatcttttgtctctctaccattcattgcctcttccctcttgaagctgaaaggctttagacacaaaaacaaaaaacatattctagaagttgacaaaattaaaggtgtgctgtagtggtgatctggcacgttgtaattgagactgaggaggtgaatgacttacatggaggtcgatggagctgaagagggtctctaggaaatgtcatagtcaagaggtttgtatgcagaatgtgggggttgaagagctgtgcggctcctggtgagaggcacacttatctgggatgcagtctggggagtcctggcgaggcagcttccacctgctggaggaggggccggggcggagctaagatgcggaggagggtgacgcactagctctccagttcgcccgttcctggcctgacccccaccaaggcccataccgcagtaggctcctcgggctgcccctcggtgagtacagttttgatgtcggctcggccgcctgccgccaacccgagatttggtattgccagttgtgggagggcgtcctgctaaaatccttgaggtggaggctggggtcagacgaaggatgcgtaggggattagaatgtttggctatcagtaaggggaagggagtactgagggaggagattgtgtagttcatcaaatcagagcggcgtttgctgggatgacatcctgcattcagagtggacaagggaaagatggagatggagagcctcgtgtctgcctccagccttttccatcagaattgcagattttgctgttaaacagctactctcagctctttggagagcaaggttttatatctagtggctagaaaaggccttttctttgcagaaaaagaaattggagggtataaaaatttttgtttcagtaaaggaaatgcacgattttgcctcctcccacctctccatcccccatcctcagtagaagaatgattagaaggagggtttgcgccggtcctggtggctcacgcctgtaatcctagcgctttgggaggctgaggggagggggtggatcacctgaggtcaggagttcgagaccagcctgaccaatatggtgaaaccctgcctctattaaaaatacaaaaattagccgggtttggttgtgggcgcctgtaattccagctactcgggaggctgaggcaggagaatcacttgaacctgggaggtggaggttgcagtgagtcgagatggcgccactgcactccagcctgggcaacaagagtgaaactccgtctcaaaaaaaaaaaaaaaaaaaaaaaaaaagggtttgcaaggccgctgcctgaagcatgcatccaaacacgttaagcagctgtggggtaagctgcaaggataatgttcacttgttttgcagacatacccatagaaaccaacattttggacaggttgaccctcccacccccaggctagttaactccctctcaccaccactgcctccccatattctaacctccagaactgttaaggcaatgttagcaacataataatagcaatataggggctcattctgtgcctggcattgtcctaaacactcttaacatgtatttgcacacaccctcacaacaaccctaaaaggtaaatgctttaattatctccgttttgcagaggaggaaactgagggacttgcctacgatcactcagcatgtggctgagcaaacaaacctcaaactaccccagcagattgcagggctggatctaaggaacattttccttcctttcaggatcgcaaacgtattggatgtttgctaaactgaaatgtttccctgccaccactcccaaccttcctgagcttcttgatttgtgtcttcctgactccctcctgttagacttttattcccagagactgggaaaacccaagatgccactatctctttctcaaaatgtaagcaagtttggtttatttgttttagtaagagagggagagagtgatgaagttaggagtaatgcagaactttcagggagctacaaggaggataaaaattatgagtgagaaccgccattccagcctagctttctcaagaatgcaaacagagggaattggatacctgcaactgttttgtttaatacctttctgcaatgatgctctgcctagcatggaaacttaagacaaaagcaacctcctaaggattctttgttacaacccctttctgggtggtcctcgaaccacaacctggagtggttgcatcattataattgtattatcacaattgccgattgtagcctatcagtatacatttggtcttttatctgcaggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtatttactgtgttctgatggtttgaagtttccgttagcattttaaataatatatttgcacacttctcacaacaaccttataagtagatgcctttattatcctatttttttcagaggaggaagctaatttttaagagactctactttctcatggttttccctttcttcttctacacagtgtctacatacttacatatacacacccacatgagactataagtcctgtgagagcagggaccttatctatctaattcatagctgtagccctagcacctagcacaatgtctggtacataataggtgctcaattaatgtttgttgaatgaatgaaggagcatctagtgttatcactaaagaaagattagaacccagacatgatgttttctcctcactgctgatcttcaggaaattgtgtcatcagatagctgccttttgagtcaatgccagccagtacttgtaaaagagcttcaaaatgtagaacctacaggatctgacttgattcctaggaatgactccagtatacccaagaggagacaaaagaggtactgacattaagagtttacgtgaaagcttttgaaaatatttaaaaatataacaattttattaaataataaattaagaataattaaatcgttttaaggtggcaagaccattttccccctgaagttttccaagtttctggcaatgtggtcataatacttgtattagaaagcagtacttcatttgtttgttgtttaatgatttgtttataaagagaatctagcttctatgagctggtgatgcagcgttagacagattccttatttccatgctttgctttttatcctctgattctaatgatctccttctccactaaggcagaatcctaaagaagtagcatggttaatttcagttaaatgcaagggagcatttccttatagttcaaggatttgcccatggagtgggtccgaaggaaaatgagaattatctctaaaagcataccaaccaaatgctgtttgttccctacagattgattatgcactattttgccagagtctgtgattttctaaaaatgctatctgccctagggttctgtgaatgccatgaatattgttgatagatgattcttatttctgttttgttacccatagttttaagccattgagtaaaactaattcggtgagattgtagtctgtttaggttgacatttgatttcaggagtggattaacacaaatgcgttgaatcggcaagcatgcaaacctagcacatggcttgaattagaacaaatccgacagagcttcctgtcatcccttttagggagaatctcagtccttctcagcatctgtcaccgttacttcaagcacacctatatatttcaggccagctcttttgagacaaacaataaatatctacctttttaaggcaggaagtgcttggttattcacctaagctgttgtcatggagttctctgagtttccactaatacctgaggcctgatcagctgtgctggaaaagaaacagccactcccggggcatcaaaagcctctttatccagagactccattccctccagtatccaactatttagtacccactatataccaggcactaggcaggagactggtgcagctctgccctaaagattcacagtctgagtggagagggaagtggggacacacatcaaaagttatgacagtgcatcccagcaggtgttttgatagatgtacacacaagctgccgccgtggaagcaaacaggagtaatttagtctgcttaggagtggatggggtggctataaggaaatgctgctttgaagaagcaacatttgacctgggttttgaagtttgagtaagagttcatcagggaaccataagtgtaaaggcatggaggtacaactattatgtacccacaaaaactaaaaaaataaaaggcatggagacatgaaagatcatggattaggacaattcagaattaaaaactctgtttcccttattacccttggaataatgtgcttaacatagcaatttttttttcttctttttgagacagagtctcactctgtcacccaggctggagtgcagtggtgcaatcttggctcactgcaagctctgcctcccgggttcacaccattctcctgcctcagcctcctgagtagctgtttacaggcgcccgccaccacgcccggctaattttttgtatttttagtagagatggggtttcaccgtgttagccaggatggtctccatctgacctcatgatccgcctgcctcggcctcccagagtgctgggatcacaggcgtgagccaccacacccggcctaacatagcaatcttaagtctcccctatcagtatctgtggaagggatgaatactgacttgaattttagttttctattactgtataacaaattaccacaaatttagcagtttcacacagcattcatttattatttgagttttccactgctcaggagtttggtgcggattagtgttcaggtgctgaccagaggtgtcgtcttggctgcagcttgcgtcctcttccaagctcgttaaggctgttggcagaattccatttgaattatattgtaggactgagttccctttctcttgctggctgtcagccaaccaaagcccctctcagctcttagaggccgcctcaggttgtaagccacatgccttctcatagctggaaggagaatatctctttagtcttctaattataatgtaatatgatcctgggagtgactatcccatgacctttttcggataacaagggactgatatctcattatattcccagcaggtgggaatcttgggagtcttcctagaattgtatactatagctaggatgaaaactaacaaagaaaatagtccaaagatacttggggcaaaaacaacaaaataaaaagcctgggtttttcccagtctgggaccttggcattgaatttgttgggtggtctgatcatttattcatgtgagttagttattgtttcacctcatccatttatttgcattatctttgctcacactccctgatgctaattccctctgacagacacatggagtatcttccatacccttccaacattgattttaggattttattgtgaagaaccaagttgggaaagtttatttttaattgttacagaaagaatatacataatatattatcatattttatagtaatactgtattctggtgtgaatttcaaatacacttaacatggtgcttatgagcacaaaccattgtcagagacacccgaatttgaatgccagcttcatcatttattactaatatgaccttgggcaagttacttaactcctataaccttctgtttagcttaggggtaggatttaaattcacttacttgtaagcaggtaatgttccagtccacagaagcaaaaataaagttttagcatggataactgtgctacgatgaaataatttctaaacaaatcatcatcatcatcactttagataattactggatgttaagttccttgcaggcagagttgttcactgcccaacacatggtacatagaagacaaatatctatcttgtctacttaaataaattaattgtatgatcaatggatcttaacaaatgtgtatatttgctctcaaatatagaattataaattggccttttagtataggaatatagtatcagtataaattaatgttaggtcagtgaggtatcatatatcccattaaaaaaaacatatcttctttgattccatatcccttctagttactgttccaattttctgctgcctttcacagcaacctttcacagctgcctttcacagcctttcctcacatgccaattgtacttcttcacctctcattctctcctggtccattgtagcccactgttctcaccgctcattcattaaacctactagtatttattgagtgccaggcactgttttaggtactgaggaaataaacgtgaacagcaaagtagcagggcgaggaaatgtagtccttaaataaacaaataagtattgggctttccttttttcctttttttctttacccatttgttagtttcgtttacaggtttctctggcggcctttaaaagttaagttctccagggctcagtgctgggtccacttctcttatttccctcaattctctatctacttgatctcattcattctcttgactctcaatccatttcttggctggtgactccggtgtttgtatttcagcccacatttctttcttgcatatccataggcttacactaattgctaaattgccaggtttcgatcctgatttctcaaaccaccaccttccccagcctgtttatatcagtcttttctgtctaaatgagtagtgcccctgcttagccatatatgcaaactaaatacctacagtaacccttgattttctccatcacacttcatgcctcaattttaagtaatttatttcatttttatctctaaaatccatgtgcaatttcctgtctgcttctctctagctctactccaaacaccctggtccaagataccatcatgtctggcatggagttttgaaatcgcctcctaactcatcttcctgcttctattcttgatcccttttcgattgttcttcacaggaagaacaggagttaaacttttttcaggagttaaacttgaaaagtttaaaccatattagtgtcatctccgtagttacaattccattggtggcttcccatcgtaccctgaataaaaataacccttcttgccatgacctacgaggatccacagctccagtcaatcgtactccctactttgttccacgcattctggccctgagtcacaccggcctcttcccacctcaaggctatcaacacattggatgggatcaacaatgggaggctatcaacctcccattccttgtgtagcgagtttcaaagtcacccactcagagagggctgcctgactgccctgtctgagtagcacccccctacattctctgttgcagtctccttttttttttttaaaaaaaaaacagagtctcactctgtcccccaggctggagtgcaatggtgcgatctcggctcactgcaagctccgcctcccgggttctcgccattctcctgcctcagcctccccagtagctgggactacaggcgcccgccaccacgcccggctaattttttgtgtttttagtagagacggggtttcaccgtgttagcctcctgacctcgtgatcctcccgccttggcctcccaaagtgctgggattacaggcgtgagccgccatgtccagcctttttttttaaagctccatagcattttttgtcatttataatcattgtttgttttcttgcttattgtttatctctccactggaatgtaagctccatgaggctatatctgcttattaactgcattatattccaggcacatagtaagcattcagtaaatatttgaggaattaatgtataatatcagggggaaataaatatacctaatggcaataagtatgtaaatactgttttacatctggatctgtcaagactttctgccttttagttcaaggaaaatattccatttctattctgtttttaaaaatctctgcctagaggttcttgccatgagcttagtgataatgtggtgagcaaaaatgtctgttatctagaattgactatgactgtgatcaccatggtgcaaggtttgtgccctttgtacagcgcctaccaaggagctagaaggactttttgcagtcctgggactaaaccagcagagggccaactagactagaagtttattttggaagattcctgaaccctggtagccagcctcctggtcgttaatagctttaagtggtcgctggggtagaagcatttgccaaaacatccagagaggattgggggttatgtttaacttctccgtgggcgccttaaaaacagcttggtaaggagcatctttcaaatgtgtaaattcttagtccaaagcaaataaaaacacaaagacaaacagggacctacttggcattacatgaaaaaaaagagtgtgtatgtttatggcagagaactcgggttaacccgtagccgtactattttctagctatgtgtaatcctggcaactttctaagcctagttctctcaaataaaatcggcccaaataaaatgggcttgtctggttcgagttggtgtttgaaaaataaaaataaaataaaatggggtttccagcccactcttacatgcaatcagtgggtgccattagtaactgaattgcaggccttcctcctctcactttgtggattatcaacaacatgttttcagtctttaatggcttaccccaatcttatttatttatttattttttgagacggagtcttgctctttcgcccaggctggagtgcagtggcgggatctcagctcactgcaagctctgccctcccaggttcatgccattctcctgcctcagcctcgcgagtagctgggactacaggtgcccgccaccacacctggctaatttttttttcgtatttttagtagagacggggtttcaccatgttagccaggatggtctcgatctcctgacctcgtgatccgcccatctcggcctcccaaagtgctgggattacaggcgtgagccaccacgcccggcgccccagtcttatttttgattactcatcagttagcaatacagttcagatatgcttcagtgcaccatatatttcagcagtaaccatcttctcccaagcccacggttgctcactggtctccaagacatagctaaatggctactgttgtattatccccagaaacaaataaagccaccaactgtccaggggactgattcggagaaccatgtgctgtgagatgggagctcttgggagttagaactggttgtgccagctgacactgatgatggccttggatggccttggatgaatccaaccagaaaatgtgctttcgttttcagaacattaacagcttcaggtaaaagataggctgctcagtgccagctgttcattttccccacagttctaggccaccagctatctagcactgtgataacaccagttatctagccattaagatagaaatgtataaacattagcatttgatggctctgagtaattttaaatccatattgccaaacattaaaatacccacgttctgccgggcgcgatggctcacgcctgtaatcccagcactttgggaggccgaggcgggcggatcacctgaggtcagaagttcgagaccagcctggctaacatggtgaaaccccgtttctactaaaaatacaaaaaattagctgggcatggtggcacgtgcctgtaatcccagctactcgggaggctgaggcaggagaatcgcttgaaccctaaaggcagagattgcagtgagccaagatcgcccattgcactccagcgtgggcaacaagagcgaaactctgtctcagaaaaataaaataaaataaaatacgttcttttttataacactgactgttggacttcaaatttttcacttagaaatagagacccaaggttattttcttaataaatatcaagtggagaaagagtcctgtggatgataggctacttgaagaggcagatcctaggagcctctactctgccaagctttggccttggtaaaggagctgcagtgcctccgctttgccacagggtggcaacagttgcttcccatttgaggatggcggggtgaagcaaaccttgaactgtaggggacactccgtttctggctagtctctctctgcagttggagaaagcagtgcagctgactcttatgtgtcttgactaaaatctgtttctaggttatcctcaccctggaggaaccaatgagaacattgggcttgtaggccatctatgaatggactgggaccgcccaatgggcccatgcctttggggttgcattttgtccaccttgaacttcaatccttaaagtctctggatgattttcagtttttctctgttgagcaattgcatggatagtaatgagaaattcaaaagaaacggggaggttctttttgggaggggaaaaggataggaaagatgaacacgatgacatgtttgtgtatgtttacagtgtcctgggtatccagaaggcacttagatgtatatggcacaggagagaagtctgggagaaggaagggtttcagagtcatccccgtgttagtggtggctgatactgtaggggtggatggggtcaccctgggtgggtattgagaacaacagggcacctaagacaaaggccaggtagatgaagaagaatccacaaaggaaactgggataaatcggccagaaaggagaagaaccagaaagatagagtgtaatgaaaacaaggaaatagtgttctgagaaggggcagtggttaccactgtcaggatcagcagagaggtcacatgaaatagtaaaaaccactgggtgtcaagtgttcactgggggtagcaacacagaagttactgctttgtgggggctttgggcagagccggctctggggagtagtgggggcccaccatacctgcagggcattgaggggataaacaaggaagaaatgcaacgtataaatgtgttcccagaatgtcaggtaaaggggagatgagtaatagctgtggaaggattgggggaagggtgaatgatttagagctgaggacggtttctgttaaggttgttttaggatgtgagaaattgaacttgctgaagtgctaattgctaagaaccagcagagagggagagttgaagatgtgggatggggagcagcaactgaggaggtgggagaggatgaggactggagcacaggtgttggcctgtgtcttaggtctttccttcctccattggggaaaaaggaaagtggcaaaggtgtgctgggatacagagctttggaggttttggcctcaggtgtttgcaagcactgtactaattctagccaccttctcaattaaaataagaatacaagaatgaaatgcagtctcccaaatctcttttctttgccagcttatacatttatacacctcactgatatgtcttttgatgttttaaaattttggacagcactatttttaacttttacaactataactattagttatttactagttatagtataaacttttaatatttactttttataactcctagatgtcttgtagatcaaaagatctaaagtgtcatctttgtctattttatatcttgtttaatagtaataaatgttttagtgaagcataaacctagaacaaaaatagaaaataatcttaatagggtgttggggaattttatgtgaacacttcatgtgtctttggaacagtacaatgtaaaaaattagcacagccttattgcatgcacaaaatgtgaaataatgtgaatcttccccaaataacaatttgtcaagaatcacaatttcaaagtagtaggcttagtaattctaaacagtgatcggtagaatctgtcatcatcctcaattaggattgttcttgaattttgtgaattttcaatcacgagtgagatctttagtccattccttaaataacatgtgactatcttagaatgtcaaagagggacacagaaaactagataacaactcctgaaattaagtttgctgtatggcaactactaattgctctgccagttgtctgactgtagaataatccttgtgaaatattcacttctatatgggttggagcctgggtaagtctgagccccagtgtattttcatggaagtcactagaaccagatgtaaatcctgggttctctagagaaacagacaaacagaaccaatagaatgtatagagagacagacagttattttaaagagttggctcatataaacgtgggggctggcaagttgaaaatttgtaagacagactggagacttgggcaagagttgataattttgagtctgaagacagtccagaggccgaattatttccttttcagaggacctcagtcttttctcttaacgtcttcagtgattagatgaagtccacccgtattatagagagtaatctgcttttcttaaagttcactgatttaaatattactcactttaataccttcacagaaaaatctagtgttggcttatgatcacacaactgggtactataacttaggcagtctgacacatgaaattaatagggtgttggggaataaaattaacacagctgtcatcaagcctccatttcctaaggaaaattattataatccacataaatatggtattttgcttttgaatctctctaacagagtctgggtctcaaattgtcttcatgcacagtgtcatgcttaccctcacaatcacttactggaggcaggcaaggagggtgagtattccttgccaccttttacagatgtggaaaaagaaactcagagatgagacttatctagggatacagcttgtcttctggtctgttcaggctgctataacaaaaattccacagactaggtggcttaaataacaaaggtttatttcacagttctggaggctgggaagtcaaaaccaaggtgctggcagattccgtgcctggggagagactgcttcctgattcataggtggctgtctttcattgtattcacatggcagaagagatgagagagctctctggggcttcttttattaccatcacattggggattaggcttcaacatgtaaattttaagaggaacacaaacattccatccatagcccagctagtatttgtgggatcagagcctgagctggaccccggtgttttcctcttctgtctgtccagcacatcacactgcttctttggctagttgatctagttaattataggtactgtacagatgcagaaagtgttaaaccttgaccacaaggtttatccttaaggatgatcctcactcctgggctcattgttgatacttctttgtatttgcttctttagcctcattgtgaattggcattgatgatgaggaagagcttgccttcctcactagactgagatttgcaaatgcgcacacagtatctgcctcgctttttgtgtctgtagtgcctagacaaggccaggcaaataacacccactaaatatttgttgaaacaaccttgccatatttgctcccttgaaatagccattgacctctgagacaccagcaagtgggactcgtgttattccagtcaagattatccagccttcgcaacatgtaaatatatctggagcattttgacggtaataacctaaaagtcaccggcatttctcacacttggtcacttaggactgcaatttcctggaaagtgctttaaatatttctggagattgccgggcatggtagctcatgcctgtaatcccagcactttgggaggccgaggcgggcggatcacagggtcaggagatcgagaccatcctggctaacacggtgaaaccccgtctctactaacaatacaaaaaattagctggacgtggtggcgggcacctgtagtcccagctactcaggaggctgaggcaggagaatggcatgaacccaggaggcggagcttgcagtgagccgagatcgtgccactgcactccagcctgggcaacagagcgagactctgtctgaacaaaaaaaaaaaaaattctggagatcatagagcaaacaccatatatgatcctaagcaaaatgaattggtccacttccgtgggacagttacccattttccccttttcctccccttgtccccttaagttcggcaccaccatgcccttcagctatgattgtctcccattacagctggtgggtgcccccaagctatgcagcctcagggtgttctgttgtagtgggtgctgacttgggagggcaacgggaaatcccctcagtgtatgctatggtctgaatgtttgtgtctcccccagatttatatgttgatgcctaatccccactgcaatagtaataaaagatagggtctttgggggtgattagaccttgaggacttcacccttacaaatgggatccatgcccttatgaaagaggccagaggaagctcatttgccctttccaccgtgggagaacacaggagacggagccactgtgaggaacaggccctcaccagacacagaatctacaggcactttaatcttggacttcccagccccacaactgtgagcaataaatttcagctgtttgcatatcacttggtctaaagtattttttacagcagcctgaatggaccaagacagtgtgccttgatatccctaaatactagagattttttagggaaacatagctttattttttttgcccctctgccccacaactttctgtaggattcacatgggggtgttggacatggagacaaagctaagcactgggaaccataggttctaaaaatcccaacctttccattgaccactaaggcattatttattgtctggtgccttgcagttggcaagccgactcctctttccttcagtctgagctttctcctggaggtttctaagttcctcatgcaaataggcttctggcagatgtcctctcagacatatctgttcaaaactcagagtgttcaagctgggaccttgtttcacgtcatctggaaaaagagggaggcaacaggaagtgtgctgagtcgccagggaagccacaatcaacaatttcccacaggtaattgacaaagtggatcaggcacatgtaggaagtggaattgtggtaactaaattttatatattttatggcttgcagaaatacttttctatattctgtctcatttgatacagcctttaaaaaggttaaaaacgtttatcattgcccacaatcacaccgcttaagctttacgagttaaatgtcctgttggcaggacagctgtgttaggtttaaatgtatctccccatccagctgtcttctatcctggtagactagtacaatcctgtgatatttagctgagaaactataatgtgctgggagtcgtggtaaaccacatgtggatttgggtggatggtgtttcagagatgtgccgcttctggaagcaaatgttctgacaaactgccttcttggaaccaattggtgcaaataccttgggcaccacagttcgtaaagagaactgtcgaaggcggctggaagggtttagcagaccacaatttcgcaccgcaaatataactgagcatgcacttttgaccatggtgtgctgtgtgatgttagtagaggaaggggcactggcggtggaggctgggggggacttggtttgtacagcatagcaggaagagcactgaggcaggatgcccaggggttctagtcctagctcagaccagctgcatggcactgaacaagtcccttcagttccgcaaagtttagcttcccaatctaaaaatagagataaactgtccagtccatctcacaggtttgacagggcagtcaaattaaataatatatataaacgtattttggaaagtataaaatggtacacaggtgcaaagcatcattctcatggtccttaattctttctttcatcctcctgtatatatatatatgtatgtatttccaggtgtaagtggctttgggattggaagatagtcatatctttcaatcttaagtttccttcacgtggcctcagaaaactgcccccagtagttgcatgttaaactttgccagaatcagtttcccacctggccttaagtgctctgctctgtattggtgttgaccttaggcgtgagaaacatgtgactgtaatgaggatggatgctttctaaaagctcataaatagcaactttttcatactgaaatttgctctgttccattcttgcccttgtgactttacagatgttgtattctgccatgaaataggttatagaagcaggtttaaagtgaaggagactatgattcagctgccaaaccaaaagtgaaacctgtccatgtggatatagcagatgtcagtggaagaaaggtgtgcagaattgaaaagcttgctctccgtggtttgagaacacactgtcctcttgtgggcgtctctggcagcccatgatcggtacacttccttgaaccaaatagcctatcaaaatattatctaatacatttctacttttatttactcaatgagtaattactgagtgcctactacatgccaggaactgtggccctgatatgtttcaaaacccataaacatgcatctaacttatttatgtaggatctccatcaggcactatcttcttttaacctttccagtgaaggttaaactctgaccagaggaattgagcgtgtttacagaaaatcaggaatggaacagaattagactgcttttccccttacttcccactcccttacagcatgttccattggtacttgagtctagaggcatccagaggtgtaagaataaccaaacacaacaaagattaggagtaacgaagtgttttcatgcagtgccgcaccccagtgaggtgggctggctaaaaggatgtgatacaaactgatatccagggaatggcaaagaggagtagctgggcctgtccatcatctcttatcatgactcacagcccttgtttaaggaatttgaagtctaggtggatgaaagggacatcaaacttaaaatgcatagctgcaacctactagatagaagctgagaaccctatatgtggatcaggcagtcactactggagttcaggaggggaataaggcattggcccctagagaagacatcacagatcaaacttgagctagacttccttgaggacgggtaggatgtagatgataaagattcagcttcaggcagtaagaagtgaaaagaaacatactttttaaccagtatgtgttgagtggagggtggttatggggaagggagggtggcagggaaggctggatgcatttaaggctgtcgccaagtttttctgcttaaagagcatctgggcacagtggcacatggtctatattactcagggccctaagctcacctgagaagctccagcctcccttctgcaccttgcccacagaatgttctgtaacacttctctgtccttgcagataaataggctgccccaaatctagcgataccctcgatggtggcaggggtagtagcagtggcattggatgggacggtgggttggatatttccctttgtattggtcaaatacatgcacagatggcaccaacaccacggggatctctggagatgaaggtaggtatttcttcagtcactcagcacttaacaactgtcagagagggccgggcgtggtggcttatgcccgtaatcccagcactttgggaggccgaggcgggtggatcccgaggtcaggagattgagaccatcctggctaacacggtgaaaccctgtctctactaaaaatacaaaaaattagctgggcatggtggcgggcacctgtagtcccagctactcgggaggctgaggcaggagaatggcgagaacctgggaggcggagctggcagtgagccgagatggcgccactgcactccagcctgggcgacagagcgagactctgtctcaaaaaaaaacaaacaaaaaaaaccaaaaaaactgtcagagagataataggagaaatgtgcccctgcactcgcactgcacagcatgtgccggatcatctgtgaaatggatctttcctctgggagctccatcttttccaggtgattgttcacttggacatatttgattataagctcccagagtgtcagacacggacttctcatggcaagttagacgatcccaggtgcccagtgggtggcagtgcagtgagtggcaggaggaaaactttcctgctggcttttggtctgaccaagacagagtgatacttatccagggcctaaaataaccatagcaataggccttgccagaagggatctgtggcaggctcctggcactactggtcagttcccccagtggcctgttcaagtttttctttgcatgagacagaggttatggctgaggaaacagccaggccaggaggctagcctgccctgcagaagcccaggggaccttcctgatgccatctttctggtatgacagctcagcaggcctgtgtcaacaagccctgcacggtttggacaagatgtgagtgactaacgttttcctctggagcagcaggaatggatgggcctgctgggaagaatccctttgctgtgagctacctaagacgcctggctcctgaattgaaccagcaggtcccttctctgtatcttgcttgctttcctttaaaaaaaaaaaaatcctcagcagatgatgggaggaattatttgctgagtttgtccagactctgaatagcccttggtcactgaagtgtgcaaaaacatggcaacaatgcaggtgctatggtctgaaaatgtttgcaaaggaaggagaggaaagagcagttattctgacagtaaatgatacataatactaatattggaaggattattttttccctgtgtggtcagtgaatagaatttttggcagtcgtctatcatttaactaggtctgtatagagcacactggagcctggtaaggacctctggctttttttacagtcagagttttggtgcctaggggtctgggctgtggacaggcgagatgtacctgcaggcagggagtggtcagcttgctctcagcttgccagatccgtgactctgacgagagagttatcagtacctacagagcttcctcctgcagcctgcctacccacccaggccatcttctgacactgcctcaatgtgtccatgctccaggcaggtcagatcacctccctcattcggtttggacatcaaggagactgtgtgaatgaccatcagcctctctccagtctacccaaaggtatcaggtatccagcactattctgatggagaagcagtaagagtgagcctaccttagatctattaatagagctcattcagccaaggaaaaggatccaactaacccagatgactacatgagcctaggtcattcacatgtagctttggtgagtaatgagagatgcacgcatgatacccctgctcctgtcctttggtgccctgcacccctctcaggtgctctccagagtcagcccttctgactgcagggcagaccccaaaaggagatcagcttttcacctcgattacccctagtacttaagacatttgccttcatgagtttttggtaatcaatattgtacagccagtaatttaattttttcatggtatcaatctgatattaaagctctagtatctgggaagagcacagcaaagcttacctgactgactccactattatatttggaatggataattgagatataatttaaagggtagaatatattctttctataactgcaaaagtttgctataactcacaaaaggaaatacaaaattgagtaatagtgttggaggagaaggaagcaaatatttattttgtatctactatgtgccaaacactttatgtattgtattttgccctcagaaatcatatgcagatgattctattttacaagggaaagttgaggtttagagcaggtgagcaacatgccaagatggaacagaaggggcatagaacctggattcaagtcagagcagggtttacaccctcggtaccatttagatgtgggtcagataattctctgtggtggaggctgcatccctggcctctacccactagatgccagtggcatttcccccatttgtgacaacagaaaatgtctccaggccaggtgcggtggctcatgcctgtaatcccagcactttgggaggccgaggcgggcggatcacctgaggttgggagttcagagaccagcctgaccaacagggagaaaccctgtctctactaaaaatacaaaataagccggttgtggtggtgcatgcctgtaatcccagctactagggaggctgaggcaggagaatcacttgaacccgggaggcagaggttgcggtgagccgagattgcaccattacactccagcctgggcaacgagcgaaactctgtctcaacaaaaaaaaagagaagaaagaaaacatctccagacattgtcaaatgtcctctgagggtcaaaatcagacccgctgtggagacccatggctctagaggctttgttttttctgccatcacacactcggagggaaatttgggggtaactttaaggatgctatatggataacttatgtttcagtattttttcttatgaagataataaaagctgtcgtggatcatttcgaaaataaaataaagattgtttagaatcgtaccacctagagatacccactttcagcatttggctatgttttcttccagtctgttttctgtgcacacataggtagtttttaaaatcatacagtaaatcttttatctctttttatacttaatattatatcaagaacctatccctatattaaaatcagtgtaattatttttagtagctgcattatatcctattatatgtttatgcctcaatttactcaagcatttttgcaaatggccatttagagtttttccagtttatcccatcataaacacagcttcaatgaacatatttgtgcataaacgtttgtgtacagtcttgataaattctctggggtatatatttctatgaaaagaagaataattgggtcaagctctgtacctattgtttaggctgcatttcctacatactgtcaggttgctttctgtaagtgttggacttatatggctgtgctttctctctcacttgtttgtgggtgtcttgtctcacttgttaactataagtattaactttttaaagtattttaatttgataggcaaaaatggcatttcattgttttatttgtgtttatttgatgaccaatgaaacagaacatctcttcctattatatagctttttgcttttcttagtctctgaaatatttgttaatacgatgcattgcttctttattagatctaatttttgtctatccactttaagatttgtttctttccattttcacatgtagacttaaaactacagttctttaagctatttagcagcagtagaggaagacttgaggcaagttggaggagagatgaaggggagtgcttttgtataaattggagatcacctcaactatagaattaactgagccctgaagttggaagaagagggaagaatggcgagagaggaggtagtgcagaggtgtgcggtcaggatttcctgtaatggccaccaggtggtgccatctgcccgggacgatttgatgtctctggtgcaggagagcggagagctggggagagtattaataaggtggtcacaagcgaggtgattggagtgccattcatacatgtgggacattagttgggcctctgtaattaacctgtcaatgatcatgagttggtgcacgtgtgtttgtgtgtagagcggggaagagaagattagggctgttaaaaaaaaagaatatatatatatatatatatatatatatatatatatatatatatataatatataatatgttatatatacacatatgtatacatatatacatatataacatatataatatatgaatggcagctttattgagatataattcacatactatacaattcaacaatttaaagtatacaatgtaatggtttttggtatattcacatagtagtatcaattttagattttttattgccccaaaagaaactccattccccttagccattccccccatctctgcctccttactccttccctcagtctcctttccccagaccctggaaaccactactctactttctatgtctgtgaatttgcctcttctggacatttcatataaatggaatcagaataggtggtcttttgtggctgtcactgcttgtcctagccaatgctataccagcttgactttgtggcaggaggcatcagggtatccagatagacttactgttttaaaagaaacagcatttccaggctggctaggacagagaaaactacgtagaacaatacttttcctacctggtggatcatcagaattacctgggaagcttaaaatgaaagattcctggcccctaatctctccaggaattcaaatatggtagttccagggagtctgagctgcttgggatttttttcagtgccaccagtgattctaatgattgtctagctgtaagcagtgggactcaagttttgaacagaggcatgagaagaaaatggcatttccctgcagatgggctgtaccagctgcagcttcaagtccagtgcctcttgtgggaaaggagccactcccttgtcattcgccacatctacactgcaacgctggtttatgtcagactatcatctttgactcggcatgacaacagtgcatatttgaaggccatcaaaccaatgatattagccttgtttacggtttagctggaaaatatctcccatgtggtatagtaagaagagcactgaatttgaattctgaagctcaccagagtgttccactgactagtctcagggctactgtgagcacccagtgagagtggccatgagaggtgacacactgcacaagtcagggcactggaatcatgggacaagatgggaccttagagaatgtcttgtctgcctgcctcatttcatagtagagaaaatgaggccctgagaggtaaagttcttcactgaaggtcatacgccagctattagtagtgtagccagcaccagggtgtcctagcctttgcctccttctgtttctcactgtgccctccttccctacattgctctcttttgggatctgaggaatcatattcaatcacctttcattttcagaaatgaggaaacccaggcctcgtttgtccatggctacaaaactaattgatttatatttgctttggatgactaggagttaaaataatgacaggtgaaaaatccaagatggcgtttgtataccgcttttaagagcaatccacagcagattcaagttttgtgaggcctgaaactcatgcaatttgaaaacttttttcaagaaaaataacacacaattgcaaatgaaaagttaggttccaggccttggaagcagtctgcgcccatgaggggccctcattcacttcactataaatccacctccaggagcagtaataaagagatccctactcatgtttgtgctgctaggttcttctgtttgtataaatagcatgtgtcctgctaagtcacctccactcttataaaatggaggccattctgccaacacatgtgtattgaacatctctttatctgtaaggaatacagaagggaaccaagaaaggaaactaagctaccatctctaactcaggagatgaggcacaaaggcagaatggaggaattccctccctgctgtggtctgggccagggtgcctatgggagcccagcctctaggaggtctccagttttaatctcagataatcttcctcttgtagtcattcttctccctctgcctatcaaatgcagatgttgagatgagtaaaccctttggggtttttggatgaaaaacttttcaagatttacatgacatttttggggttgtgcctacccaaaaaagtcttatatctcacatcactgccttagaaatgaattaaaggtgcatttatccatcagggccacattcccctaaaatgcacctaatagcactgaaacaattagaataacacagggatcctgaataatccatgcctcttgtcaagaaatttttttctatttttatttttgtaaaacagcttccttatccagttgtgtttagtttatttaaacgatcacatcagcattaggttctggtttggggtttttttttttatttgtttgtttaagtctcgtttctgacactttctgaaagatgcaacatggagataggccaggagggaaactagttttagggtgttctcattacattcattttatgtcattttttattattaggtttacattattgaattcctgtggagaagaggagtcagagctgtgaataagtcataagtccctataggtaaaatcaagtactatttgtctctgatcaaaattgccctttccattgataggagaaatgactgggcctccttgtcatccagagttcattttgtttttcgtggcagtttcactgtctttgggaattgagctttttgaaatgttaaagcacgagaagcatgaacaccttggcagggtttgcagtatctccttctagtgcaggatggagggctccagagctggcaatttgaggaatggctggtggcttctgatgtcacctgccactcatgtgtccctccctgttttgaatcatggatctcaaacatcctcaaaagctcttccctggtaatttcaaaactctgaacaaatcaatcctaagaaaaaataaacaaacatgcagaagagcagaaggatatttaggatatggttctaattaaaatttttaagttttcctttttcaaaatcctgtatgagctattaaatagggaaaaacaaacttctgagtaggaaagaaataaaggccattacccttagagattttgaatcttacaataaacaaataggtcttcttttccccgaatgtttcttcttatcaacacaagggagttgagtgatggctacagctctaaaatactgaacatggctgcctactgaattcagcatacatacgtagggatatgttacataagatgcacatacatactttatttctattagcctgtgaaacagtgaacatgcctgctcttataaagcttctagtaaaggaactacaaaagaaacacatctactgggcattctcacactggctgaggtaggttggaaccatctggattcttgcctgtggcatagttaacctcgtgactatccagttttccaattatccaggcccatttacctctgctcccactcagcgagccctttggctatttctctgttcattggcacctaaagtcaaggagaaagaaacgaacatttattaagtgctatgtttgtaccagttaatcttctcaatgaagtattattatcacccctgttttacagagaaggaaactaatattcaaagaggtaagataacttgttcaggaccacatatgtttttaagtatagagctcatgcattataaagtgaccaccctagctaacatttattaagcacaatatttgccagaattcttgcaaaaagccttacaaggactattttattttatcctcataccaacggcttaaggatggtattacttaagtattcttgttttacagatgaggtcatacagctaaggtgatgaggccaatattcaaactcaagcatctggattgcaggctgcacttttgatcgccatgtctagcctcctctatacacctgctctgaccgatttggtattcaccacgcccaagaggctactgaacacctgaaatatggctggctggagttgtgatgtactctaagtataaactacacaccctatttggaagacagtatgcaaaaaagaatataaaaagtctctttggcaattctttatatcaattacatgttgaaatgataatttggatatattgggattaaaaattatttaatttcactatttctttttactttttgaagtgagaagactagacaatttaaaattacaaatgtagttcatattctatttctatagaacagcactgctatatactattttaaaataatatataaaggggactagaactgactcaggccaacattatttttcatcaatagttctagttaaaaatttggttggaagtgggtggatgggaaggttgaagcccatttttaaagataagtttggtgtttttatgaatttgagttatgtgtgctttcttcacccgttttaccatgtgtgggtaagagacttgccatttttaagaatcagaagaattctgtgaggtgtatttccagtgtctgtgtgtagtgctgcagctgtctgagcgtattgccggaggcacctcctttggactttaaggcacgaattgctcatcactgtccacacagctttgtggccgcctttgagtctatctcttttaacataacattgagttctggctccaggtctggcacaaagttgataataactagtgaatactgttttgtttggtttgttgtagttttattctttttttttttttgagacagagtctcactgtgtcgcccaggctggagtgcagtggcacagtctcggctcactgcagcctccgcctcctgggtgcaagtgattctcctgcctcagcctttcgagtaactgggactacaggcacacaccagcatgcctggataacttttttgtatttttattacagatggggtttcaccatgttggccaggctggtctcaaactcctgacctcaagtgatccacccgcttcggcctcccaaacttctgggattataggcatgagccaccggacccactttattcttaatacctattgccaggcagaggttacatggatataaaagagagaaattgggaatatttgtatgagatgggaaaccacaggccaggaaagcattaccaaagggttgtagaggatttagtctgggcccctccccaacgtacacaccacgtgccttctcctctcgaggctagaattaaccctcaccccaccaccagctgccaaaaaatagtagtagctgctgggaactcagaaacagaaaagaattttctatgagattactgtctaaaacaaatgtttattctagccatttataaagaacacttatggatttacagcagcttaggatagtgaaaaagaagtagaggaatggtaattaattcaggtacgaatttgtaaggccaagtgagaatcacgttccttgtcgtggcccaaaaggccttgtcagactcagatggagtctcctcgttttagtctacagacatatgggtggaagtgacatgatggaataattacattcccaagccgtgtacccaaaatctgtgctaggaccactcccctggccagtgcggaaccaggtcagctggtggaaggggctctgaatgggcacagcgctgccaggccctgccactcccacctcatcccatccagaatgggtccaacacagttcctgctaacccttatccacacctcctcaaccatagtccccagtgacctgcttcctctgtgaagcccaggctgactggaaggtgaccctcaacagaaaccatcagagagctttgggtctggggcggagggtcacctccactctcacggtggtgtcttggtgttaatgtcatctgttggctcagccattcattgcttctctcttccctaagctcctgcagatctcctttactcgtttcttaagtgtaggaagctatctccttggatgctgggtcactaattataaacttcctatgcatttacctggctctggtttggcccctaatgtctttatttctgcctgcaggattgtcattgccattgccccttttccttacctgggaacccgacatactctgcttatcccttgagctggcacaccagggggcctggaattcctgttggtgaagtcactactttaagagaattatcccagaaatcctctaagttgcaaatcctacaggagcagagtactacatgttaattagcactcattatcatgttagtagagaagcttacccaaaggaatgatacataggacctgctatgtcattgagaacagagaggtggggctcaggttctggacaaatgatgtcataagtaagtgtagtttcagaaaggaagatgaagtgggagctttagataattggaggcggtaggcctgtatatggaaccagatgctagagagcccaagtccatatttttactttttcacagttttgtgtccatatcctcaccgaatcccaaccaccaccaccacagttctatatcccgttattttttcaataataactgatacctcaacttaagctccactctgaccctcagctaagccatataatttcagcaagaattataaaataaagtttttaaaggacaaacatgagccttaaccttagtataaagacatgcttagccttcatacaaattgccaagttgagacttcatttcagacggcaaataaaagttacatgaaggagctaaaagtgctattgcaaattacctatttgaaacggctttttcaaaacctgctaaattcacacctctcctaaaaatgcttcacttccagattattttattttggggttttgtgtgtatgtgttagagggggtggggtttgtggtgactacagaaaaattagttaaattcataggataaaatttgaacttttgcaaatgagtaaacagccaaaacaaacaccgcttcagaaaaaaaaaaaaatacacgttttctccttttggaaagcaagcaatgcttaagcaaaataccttaaaagttaactaaaaagcttttctaaaataaacaactctgcttgtgatcctaaattgggaccacatgtagatgtgaaagctacaaatgcagtgcactcagaatttgcgtctctgccttcactgtttgcgtgcctctgagtagatgatgataatgttggctttggtccccaaggagcctgagttttttagatcctagtatgagggggaaaagcagaagaagaaagagaaggaatgaaaacaaatgcctttcaagacaaaatatccgaatgggtttcattttgcttatctgccaacaggctcaacccaatttagatctctcctacaaggacaggatagtgccagccagggtgtctgcccttgccggctatgtggggcagtccctgtgagggaccaggctcgaattcagagcagaaggatcactctagcaaactgccagggccagccctctgccctgaggcaagtcaatgaattagccaattcagcacagatagaatcattcctttgtttttctcaattaccaaatgctgtgtgctttgggggtcacttgtcatgtgagtttagagaatgtggatattgcaacataaaccctcaccattctaaacagcttaaactaaattctgttactagggaggagagctgaggtgataatatccatctctaagtataaactattgtgtgttcattttcccattatgggagacaaatttctcttctccgctagtgctcatgatctcttccaccaggcacaaacatcagatgtgtgtttatgtggacatattttgtcccctattattggagagcaagctccttgagagaagggattatgctgcctggatttgtaactttgttaggcaaagcatgactttatttagttttgaattgatgaggaggcactgatgttagtaaaaagctcaaatgtcctgagccctgttgctcaatacctcaaacacaggaccatgatcaccacaatgaaaaatatgcaggatcattaatttcggctctgttaattgtgctgttaggaaatgttgactagataggaaaagcagctaacgttcatggagtgcttattacataccaggtactgaggtaagcattttacatacagtatccgatttgtatcctcccacaagcatgttatccccgggttaaaaggggaggaattggggtccagtgagattgggaggttatgagaatcccacagtgtgtggcagaatgtggacttgaactcagggccctaacaacaggaagctataaaagcctctttgtataaaaagtgctctctttctgtgggtcctcagtaaatgaaaatatttgcttttcataaataggtttgaatgttgggaccctcatttctcaccaggagtcaaggccaaaaggtcttataaataagagtgaattttgagaaaggatgtgtgaaaatgactctgttcttttcttttatctcacttcagttacttgggatggaggaagcagaaactgggagtcagacatctaaaatatgaagttccaccctcatgttggccatttctttcagcctcctttccccattcctaggggccaatctgtttctccctctcctgctctttctctttgcctctgtcttcttctttcctgtggagacaatagcgtgtggtggaactgcctgagtgcttactgagaaggagaaaccaagcgcagattgtatagaagctgacgaatgagtcctctgattgtggacaagtgatggcgctttttgtaaaattgtgtatgtgtttacctcaagtagtgaaaaaaaaaaaagaaaaaacaacttttggggcaagttggaccttaggaaggagatttctgggtctcggggtttctcttagcccccagtgcctggtgcctgcggccggtgtcgcctcagggagtcccaggctgttctgtggcctccagaaggagccaccccgccccttcctcgccccactccgctttgccttcccttagcctggggagccttgccgcctctccaccttctctcctggtctcctcgggcgctctcgcgctggcaccttcagctctgtcagagtctgaggggaaaccaaaggaggccaggcggtgtctggaatgccccatccgactgcttcaggctcccagaccgctgacaaaaggaaaactggtccgtcgctttctgaatgatgtatcgagaccgcagtgtatttttagcatctgctgtttgtggtaacataagtgaaaactgctggacccgttcccttcagctgaatggctggtattcaggggcctgtgcccgctccctgccagacgctcctcacagaactccctttttacgaggtgggcgactggctccctggcaccaggctgccccaccacaattctttattgcccagcgccagtgcccaattgcatgaatccccagggctgcaggcagcgtgaggggtgcgaatgggacgatgctggctgcgggcttgtcagggtgttcccaagttgtgtggcagagtctggagggcaggggttgtccggatgttccaaacctccagcgtgaggtgggcactcaggtgcgaaggaaccatggtggcgaggcccacaggtggcgtcccatcccagagccattttgccggggcctggctctgcagtagtcactgacaccggagatcccctgagtgacctggaaactatgagagaccccaggtaccccgacaggtcattctactaactgtggctgtggagctccagctcatctttggaagacggaaacgcactggaaagggtatgaatggacgcagaaggcctcgtgggggctctctcagtgccactgtagagtgaacacagggctggaatccaaaatagcaccaacttgctgagtggctttaggcaagaaacctttccccaggtctcactttctcacttagaatgatgaatagtgattcttgtcctactgacctcactaggacgtttttaataaggatgaaagcactttgaaactgttgaaaccataacatcacaaaaaaaaaaaaaaaaaaaagagacagagtgacgaagtaacgcaggtcccatttatgttcttaatttctgaccaaccttaacttccatcaaaactgcttccactagccccagccaggagagccgttgcatcgtggtgggacatcatcaggctctccaacggacatcgcttatactatgagaactcacgttcaagggaggtgtttacctctaattcccacagaactagcgtaagtaaaaaatggggcagcaggatcctttccttgcaaagtgtgagcaagtgcctctgtagagtaaaactttaagtaaaaggactacaacggcagtgacagctcctttatctgaaactgcagacttttaagaaggttcttagcagccacaccgatgtcacaaattccataaagcaagatcacctaggcactctctcggagctaattttatctcattttatatataattttaataagcctggctctctcattttctagccccttattactgaaaatgtggctcatggaccagcagcatctgcactatctgggagcttgtgaggaatgcagaatctcaggccccacccttcaccttgaatcagaatccacatttggataagatccccgtgtgtgtgtgtgtgtgtgtgtgtgtgtgtgtgtgttgtgcgggggagggtaaaattagaagagacttgcagggcctaggcgcactctcaatttattgtatttcattatggaaaggatttgggatgactagaattaataacttagaaggagtgaggtgacaaagaacattaaaaactattgcatctgggaccatttaatataggtttgtttgtttgtttgttttgagacggagtctcactttgccgcccaggctggagtgcagtggcatgatctcggttcactgcaacctctactccccaagttcaagtgattctcctgcctcagcctcctgagtagttgggattacaggcgcctgcctgtaattgtatttttagtagaaatggggtttcaccatcttggccaggctggtcttgaactcctaaccttgtgatccacccgcctctgcctcccaaagtgctggcattataggtgtgagccaccgcacccggcccatttaatatagttttatatccgaatgccctttaatactctgagaatacactgttacaacactgtatagtcattgatattcccagtaatagtcccaaattatcaagaacaggcaaagtcatattctcctgctgtttaaagtatttacctaatgttcatagtggaaaattctcctttaaaatggttaaataaatcttgatcttaaaccgatgcttcagtgatctgaatactacatgaaacagcacgttctctctaaagagataagtgagatggtactataatcggaaacctctgttaattcggattttgttttttatgcacattttagagagtcaaattatatcaagataaaatatgataacagagatttactctaaaattaaacaatgaaaaaaaccctaccagtgcaacaaaaaggccatggctgttcagagccaagtaaaactttgggggtcagaaggtatttaattttcatatttctgtttactaggtactaacaactgatcttcaaaatcatagagacaggaaaatggatttgaaacccaagggagtttttaagtaaccagaaaagttagtgccctcttctggacaagcgatcattggagttgttagaggttgtccttgggagtgctgttgggggctttgttaacaccgaacaagaccatgagtggcaaaacttggagctgaggttgatcaggtctccaaggccagggagagactcaaaccaaccaggtcaacttcccagctgaattgccaacctcaaagggatacgtacagaagggagaattggaggcacatagcagagggtgagaatgcagagaagagcaggatgcggtcaaaagattggcagatttttatggagggttccagcacaggccaagaaagagatttaagggttctgactcaaataagaccaactgtccttctttctcattcccttgacaattacatctgagtgcaactttattgccatggcaatacaaagaaagtctaccaatgatttgatatctagagcttagaaataaacagctgcatggtaccaattttattatataaagcaaagtttatataaacgcaactgggcttaaaactcatttggcaagaattaaatattttccatttattctagagacatttttagagtgccatggctgtggtggaaacataaataaagcatcatcacaggacaggattaattaattgcctgaaataatttcaaagctgtaagtgaaagatcctatctttattaatggtattcttttctcaaatcagattttgaaacctcacaagcttttgactcatctctctcctgtgcactgctagaaatcttatttaactcatgttgcagccaccctaattccaatccttgtcacttcactcctgagtttcagcaacactcttagagaagaacttcttaatttctctccaacctagctttgtacaatggtctgttctctataccaccatctattgtctatactacaatacattatgttgggaatatatcttattatgtactactggcttattgtgttagtcatgggtaaccaactagaatgaagaacgaactagagaacaggaactatgtctttcacatttatgtcgtctatagcacctaacgtaattattgctacacagtatgttgctacagggagtcttccgtggcctagatctgggctagatacttctcctctacacaactgtgacacactgccgtatcctggttacattatcagtgcattacaactggctgtattacgtttgtttctttttgtttctctatgaactatgagagcagagcctacatttatctggttcatcactgaccctctagtacctagcccaggttttgattatatattatgtgctcaatgcatatttttagattatttgttgttggttagtgcagtaagatagttaaggaggctgggatgaatagaccaaatggcatccatagcatcatattattttgtttgacttggcttcaggtacaatagatcaatataacctaaatattataatgaaccagataactgcatttggccctttgcaactgtataatattaaaattattatattttctatacctgtttaattgtctataaaattctagctcctggagtgcaaaggacagcattttttacttctgcatatctccctcagttcctacctcagtgagtgtttcttgatctgacatcattaaatgcagtttaaaaagagtctgtgttctaatctgtctgcttagtgctaaacatctgttgcttcctaacaagtgctgcattcattttaatggcactggtgcacagaggtaaacggagctttggcaggccttccataagagaaactgtttgcttccttcattaattactaatggagcattaagacacgcattctgccttgagccaagttggataattcctggcacttaatgctagggtgctttcaaaagttgagacatgtactgacacaccagagagcctgccctatagcaagcacagtggtgtctatagtgccaacattatataaagcttcaaatatatcaataccaagtgtactgatatgtctaacctttgcatctattgggttaatgtggaatcataggtatccctacactagctctgaaggtagctatcacaaatgagctggatgaatcatcagaaagatacagaaaggttaaaaataaaaggataatcaaagatttaccaattaaacacaaatcaacagagtgagagtggcaagctaatagaactataaatcaacatctgatttatcaatttatatttagcagccaattgccaacacaattaaaatgaaacatttatacccttggatatgctaactagtacagcatcaaaatgataaaaacagtaagaaataagagaatgacagtcacttattgttagtagtagattttaacatatagccatcagattatgatagactagagataaaatatgaatatggatataaaaagaatataattataaatgttgataaattggctatatttagatgtttatgggttatataaaataccttatattacatattcacatggaaattttacaaaaataatatggtagtttacaaaagaaatagcattttttttaaatgcagatattttacagtttctctcattacaaagcagtgacctagatctgggctagatacttctcatcattctcattacaaagcaatgaaatataatataaatgtaaacaaaacaagcgaacaaccactcgatgttgcctgaatgcgggggctagaggaatcagcagaggtaagattgtccttttaaggttaaactttaatcaacacagcacacaaagccagagtgatgcaatgtcacttcagagagaaaatatgatccccaggacactgagatctagtcatgattctactgaatatattaacatttccaatgggggaaaaaagtgtgaatccaacgaagagctggctcagccaaaacaaacaaaggcaagtgctagtgttcatccagggacaagggagcctcattcaactagacttaactaatccagcctgtggcaggatcctccttcatgagaagatggaagcatggtgttgtttttgcctggttttgctcaaatgtcatgcacaccaggcaccttttgattgtaaaccagcctttcctgtattggtctgcgtacaccatgattgtcccttaggggaactgtgagtgtggggctcctctgtcctcatggagttggtaagtatgaaatccttctaagaaatgatctgctgtggtcctggaaaaggaagcttcatgagccttatagaatgttaaggctacaaggaaagaaagtccagaaattaacatacattggtatgttaacttggtaacttagtaaaacaagttatggagtagaagttgttcttattcactgctgtgttttggtgctcagaataggttttcgtatgtatgagacacttaagtatttggtagagacatgaaacaagtaggaaaggacagaattatttagcaaatgctggtgggataattgattaactgtttgacatacactgaaataaataacatggattaaagagttaacttacaaatagaaaattaaaagaatgatccaaatgtcagtagtacttctgaaggggcaacgattttgtgcatttagaaggataagaagaaatcacaaggggaataaaaatgacaaatctgactacataaatattaaaaacgtatgttagcaaaatactataatagtaaccagaattcaaactcagacaacatgggaaaatattttcagaaaatgcgacagccaaaggccttgcatctttattatgtaaaatgttcatacaaattgataagaaaaacactgaaattccaagagcataaacaaacagctcacataaaagaaattaaaattagtaaatatatgggaagatatttgacccagctggtaatcaaagacattcaaaataaaacagtaattttaaaaaatttgaattagcaaagaaaatctaaaaattgattttcataaaacccaatgcttgtgagaatgttgcaaaagttgtatttcatattttgctgctgatggcttataaattggtacctcgtttttggaaaacagtttggcaatacaatatcaagagtcattaaaatgttttatagcctttgacctagtaatttgacttctgggaatctatcctgaggaaaattaatccaaaatatggaaaacattaaatgtctaaaatgaattgggaaacactaaatgtctcacaataggggattggttaatatgttgtagtacagccattggactaaaaactacatagccatttataattacaggaatagagaccatgcagccaaatggaaagatgcttgtgcttcaatattaaatagaaatgaatatatacttagtataaaaagatacgtagcaacaattggagtcaatacaccaaattttaagtggttgagctaaaatagcaggataacagtgaccttatcttttttcataatgtgctttcagcctgtatttctggatggcaattgccttcctttcttgacccaagtcctgcccaagctccacgcccagcttccagagccctacccatctgtgttgatgccacttagtttccagcttttccaagaagccctcccatcccatcagccaaatggaactctccctttcccatgctctttttttttttctttttttgagacagagttttgctctgtcgctcaggctggagtgcagtggcatgatcttggctcactgcaacctccacttctcgggttcaagtgattctcctgcctcagcctcttgagtagctgggattacaggcacctgccaccatgcctggctagtttttgtatttttgttttttagtagagccggggtttcattatgttggccaggctggtcttgcacttagacctcaggtgattcgcctacctcggcttcgcaaagtgctgcaatgacaggcatgagccaccaggcctggcccctttcccatgctcttgtgatgctgtattaacatttcttttacaggataatatacagtttgccttgtatggaaataatatgtgtacagtatgtgtctgtttctgcaactaaatttctaaacccctagagggcaagaaccatttcatttatttttctctccccacagcagaaggcacagggcttttcctgtgtgatatgcctgaataaatattggttgaaattaattgaattgcactgcaatgaactacttctgattccctcgcaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacaggtaacagatatgcctttgggttcccatgaaaagttggggctttggaaggaaatcagaaattctaacatcagctacaaatattcccagaaattgttatttccattctgatgagcccatgtgtatttgtaagtagatgggaaggggaaatttattctagaatttttatatgagctctgtgttcagacacacccacataggattttcccttgccaaggctttactttctttctgtgtctccccttctttgggaattgatgcacttttctgcacttgctactctttttttttttttttttttgagacaaagtctcgctgtgtcacccaggctggagtgcagtggtgtgatcttggtgcactgcacgctccgcctcccaggttcatgccattctcctgcctcagcctcccgagtacctgggactacaggcgcctgccaccactcctggctaatttttttttgtatttttagtagagacggggattcagcgtgttagccaggatggtctcaatctcctgacctcatgatccaccctcctcggcctcccaaagtgctgggattacagtcgtgagccactgcgcccggcctgcacttgctactcttttaatgaaaggggaaacacttttttttccttttccatgatacaacttctgctgagttttaatgtctttggaactagttagtttgtggattatccatgcctgtttgttctcctcgttgatcatgacagtcaacattctaacagtgtcatgcatcaacaccgagttagcatctatcctaaaatcctgtttatttgggggccaggaggtggcatgggagagaagaggttcaggaagaagctggttaaggaagaaggttgaaattttccatgttgttcatgcatcccacccactttcctacccactaatgccatagagaatggtgagtgggcttcacttacatccggctttgagcagctgaccttggtggttaagagtagtggctctagactctgactacctgagttcaaactccaggtcaacctgtgtgaccttaaacaagttaattaaccacttcgtacctcaatttccttatttgcaaaatggaggtcattgtgggaattaaataaaattatccatgtaaagcattttagcacagcacctagcacagagtaaggactctttaaatgtcatcctgattataattagctttgctgcccctagtaaataatgcacctcttaccttgggcttgtgttagcttctagcaccagagtagtcttttcctgcaagcctaataataataatagttggtatttatcaggttggtgcaaaagtaattgcactttttactattgctttcaataggaaaaactgcaatacttttgcaccaatctaatattatttctactttatattaagaaaacagaagcttagagagtagcttgcataaggttatccaggtaacaagtagctgaaccaagactcaaacccaagtctacctgattaaggactgtgtactcaaccaccaggacatactgccttgctctgaaaattgtgataacattgactactcaactttttttctttttctttttcttttttttttttttgagatagggtcttactttgttgcccaggtgggagtgtagtggcacaattatagtaattctgtgcctcagccttccaagtagctgggacaacaggtgtgtgccaccatgcccagctaatttttaaattttttgtagaggtggggtctcattatgttgcccaggctaaactcaaacttcagagctcaaacgatcctcccaccttggccttccaaggtgctgggattatgggtgtgagctaccacaccgagacttttttttcttatgatacccataactagtctgacatcagcttttcttaaacacaatgcaggctgtctctgaaagagactgtcttagaaaatatgctcctcctttcatttaggatgaggcctctgttttccgtggggcacaaagcttccatcttgaggcagaacaaccaaagtagttggatgtgaccaagccaatgtgtggctgctgggccaggaaggcaggaaaacctgaatccctgcctggctctaatcatttcagccaccttctacttgtttgtagggttttggatgggtaggaagaaagactagttcagagtttagagagcgacagtctccattgttaagtccattggatgtggtacagtgcagtggttcttaaagtgtgattccaggaccaccagcagcagcagcacctgaaaacttgctaaaaatgcaacttctcagtccctaccctgattcaacctattgaatcagaagattctgggggtgggacccaggaatttgttgcaaccagtcctcctcatggttctagtgcacactgaacttagagaatattataggagaatggaaagaggtccagagtttgagccaagagatctgacctctagtgttgactgtagtatgccactttcactttcttgagccttaatgtcttcacctatggaaggaagacataggcaatgcctccaaagagcatacagtgtagttctagcttgtctgaaaacaaaaacaataaaaacacaaaatcatacagacctgtggaatcaagctctagtctgtgcacttaggagctctgagaggacagcaatcaagctggcctggtagaattggacaaaatcccaaatccagacactttcttgtcacaggttgtctgccatttcctttgctgttcttccatgaaactaacatattccctcattctttgttctgccacaatctgcattccaagaatgaaatcgcttgctaaatttagccattatttgtgaggaattgcttgaattatgacacaacacagcacagttgagcaatccaagaataaaaccttgatttctcctttcatgccatgctgtcctctgaatcatggcccactcaccctggatagagcagcagagctcaaagagtccatctcagcctcagagataggatgtgaattctagggcacatttttaagcccggagacaccttcggttcccagagcaggctttatctgcatctcagtcagggcccactcagaggtacaccagaaacaattatgaaaggttataaaggtgccatatgcagattgcctgaactctcttgaattggtatattttcctacatgttaattgctatatattgtgtaagttagataaatagctcactgaaaagtggagagccgcattagggatttgttcagaatgctgatgacttccacactagctgtatactgctaagagctgagagactgtgtactgaaagcttaagagcagtgtcaagaactagacaacctggctaattgtaaatggcccccctttcagcattgactttgatgtctcattatgtctttcaaatgagaccctccttcttccccctaaccctgcacaaaattcacaatccctcctctgtccccctttttattgctgttgtctaaaatatattagacatgggaaaaatgactcatttttagagcatcatgcctagtaataatagaatttacataaaagcagcatctgagagagatagccttctttctttggtttcaatggaaaacttgcttgatttcaaagggcagtcatagtataaactgtcagtcaaagggagataatgggaagggaactaaaacatattgcaaacctattatgtgccgggtgttctaaatgtaatcatctctattcctcacagcaatcccgtaggtaagtatttgattatttgcatctcacacatacatgaacaaacttggagagaccaagttaactttccaaaggaactaagcctatctatatcttaggagctgggatttgatccttgagctctgctcttgtctgactccaaagcttaagctgttatcacaataaaacacaacatcaagtgctgtgtggagattgttgttgttgtgtaatgtactttctccaagaagccaaagtagtttctaaactgcttgctcaggagaaaacagagtgggtcatgtgcaacagaagtatgttacctaaggaaacacttgctcttgtaacaaataaaaacattgtatggctcaacgcaatagaagtttatttttcacccgtgtgaagtcctgccagaggcgcgtgaggctgtagtgcggtggatggttcggcaccccagactgccatctttacacttgacccccacagttgccctggcaacatgtaacaagctgaccaggagatgggggtggggaatgaggagaagtggagcatggtatgagaggtttttatgcttttaggtgatgtatttcaattccaggcctgggaatggaatacattacttgtgcccacattctgttggcctccactcaggcaaatgactccacgtgattgcaaagcaaggctgggaaattagtctagctgggtgctaaggaggaaagggaagtgggtttggtgaacagccagtgagtctctgcacaggagtgggagtttgagatgagtaatcctatctaactggatcctagagggaaggtggctgctagtgttctaagttactactgatgtgaacagattctgacctttggctgcctagttgtttttgataaattaactcttagaataatgatgaatgtcttggccgttcctcaaaaacctttggctgtttgcagcagatgatggatgtctagaaaacacccctgacactgcagagttcagtcgagagttccagttgcaccagcatctctttgatccggaacatgactatccaggcttgggcaagtgggtaagtcctatctcaattgttagtagattttgcactttggtactctgaaggtgctgatggcagggatgagcaatatgggcagaaggagagaagaaaaattatttagaagctaatttttcagaaatctctggttgacagagcttcaagtcatgactactcaaaaccacacttatgtgtccaggcagcactataccaaatccaactaaagagacagcaacctaacattgaccatagtctccagagtcttctactctggtctgcttcacagcctgtgtcatacacatcctaaatttcaccagtgtttcatgcatctctatagggttttatcaaaggatatgattttttttaattgacacagaaaatttgcaaatgtgatctctaaactaagggagatgatctctgcagaatcaagggaataaagatgccagagcttagaaacagatatatataattctgctttatagaaagagaaaaaatattccgtgatgtgtagcagtgagattgctgtcagtcctaggtaagtgcatatagctgtcagttaagggagttgtttataagcacttggaaagataaatcatgaccatttggcatcagtgtgctaaaaacaagtcttgccaatctaattatattcttccatttgccagcattattcatttatttgccagcttgatgagggaaatgcagtgggcatggtgcatttggacttttgcaaagcatttgacaagatcgttttatgttcccctattggaagaggtggaaagatacagcctaggcaacagaatgtcaccaaaatggggcttgttaaagagtccatgtaaatagggagggagatttcacatggtattctgtgtgtcttagcactaccccactccacatttttatcaatgtttgtaataatatagaacttgtacttatcagattcccagaggatgacatgaagttggaagagataccatcagatgacagagttgggattcaagaagatcccagcagactagaacaatgagccaaacaagatcagaactgagtggggatatgtctgtgtttctgtggttgggccagatgctgaagccatgggagaaaagtggggaaatacctaggagtgttccttcacatgtaacagtaggtggccagtacgtctgtggaatgaatgagtgagtgaatgagcaaatattccaactccctcagcccttctaaagtcctcatctcttcttagctcattattggcagatggccttgcttactgctttactgggaacactgaaatttcaaaactaaactccctcctttcctcctacattgttttagagaaatcttcattaatgaccacttttatttttttcagcgtcttgctttaacatgcattgtcagttccctctgtcttcaacatacacacatttcctgtcttaaaacaacaaagcaacaacattcctaagttaattttgcttcttccaatttgcattattccatttccttctttttcataaacagttctgtttggaagaattggtttgtggagccactttcaagcctagtagtagagcttaaacatgttgaattaaatagaaaaacatctataggttctcgaataggagactgaaataataaaagccttctataaaagaagttattttgatggcatattaaaggatgaagtaaaaggagaagagactaaccctagacaggaagaaaatatggggagtcatttcagttatgatgactgtgaacaccgtgaagaagggtgagaatccaagacattttaaagggggaaaaactaactagaattggtatacggaataaatataacatgaagaagaaagaagagatatgtcaggttcatatgaaatggacaatatgaactttttctttgaatgcattttagaaagaaagaaaagagaggaatagagggaggaaggacataaaaaagagaagagagagtgagggaaagagtagattgcggaggagtactgggaagagatccacaagaggtgatcgaagcattgccaaacagaagcaaaagccaggttcgataaggcacaaagagaacacattgagcctgctgtgttccaggcactgtgctagatgctcagtatgcaggagtcatcaggacatggtgctggtcttcagagagcttatagtcccacggttgagatgaattgcatgaaaatgaaatgaacccaacttagcaccgctccacttcatgtttcgtctgtattctgagggccaggggcaattattagggaagatggaagacaagggtagaggaagatccagaactgaggactggtgtggctgattggggtagtagccacagaggaagtcaaaggcactaaggagggcagcactgaagtttcaggtgggaaagtcttcagcttcaccagtaggctaggaatgagagaaagaaaggagggagactgagtcaaggtgtgagtgaaggcaaggagcccagttggtggcatgatgaggtgggagggatgaaaacatctcttttcagctctcttcatctcttcttgaaaatcttcacagatttctctcatcaaattccactcacttccagtgccccagtatgaggccaaccacggtccttcattctctgtgcttccttctcgaaacactgacttgagtttctctcagtgtttcctattctttgtccacattagagctaaagactagaatctaggatcaaatgtaaaaggaaaatattagagatcaatgaccaggaacaatgtttagataccttttatcatctgcaattatgtgtttacttaaacttaggtctccttgtttattttctcattactacctaccagtaaaacattgtttccttggttttcacatggaagtgggaattgagtatgtcttgcttttctaaactgggaaccacaaaccttcctcagtgcttatatggaatgacagtctcaagcttgtcttcagcccagccatcctttaagttaacagagtcatcatctttcatgatagaacagcacaaagaccctgcttccttatctgctaataacgcttccttgtttttgacagtagctggagctgagctgcatctttaacagtgattcacatattacacatttcagtgtctgtcttgtttcctgcatttctctcttcgttagtgcatcaagacacatttattaacgacacatcatatgccttccgggccccgtgttaggtaatgggaatacaaagatgaatgataatagtaattgtattacataatacataatactatataatacaatagtaaatagtaatatttattgaccacatactatatgccagactcctttctaaatactcagtaatcttattcaatctgcccatccttgtcattctcactttccagatgagaaaatgcaggcttggggagctgaggagcctgctcagcccacagagctgggatttgaaccccatcatctgactccagagtactttacaagctgaatacattccctatcttttcatggctcattgctcctaacctgtcctgtgtggtagtcctattgagtcctaccgagggctggctgccttccagacaatgtgtgtgactacaccagtggtgaccacaccaatggctggctcctgtacatgccagctacccactccccctttacacattaactgctgagtgttatttacttaagaaaaagttgtctcaaaaagcaaatatttttcctttccaaatgctttcacaccttttcatcagtagctgatcacagccagagcctgagccacggggatatgagggaccagacccctccctgacttgctttgtcattcctgaccttaacatgtttgatgagttgaatgctcttcaatgtggatttgactcaggtttccatgtgattagacctgcttagtattttatgtcctacttagtattttacatcagcaagcacatgatgtcagggaagtttgtctcatgactggcagtgttcactttgttaaggtgctgccctccaggtttctctggtgtaaaattcccttagaaattaataggccgggcacagtggctcacacctgtaatcccagcactttgggaggccgaggcaggcggatcatgaggtcaggagatcgagaccatcctggctaacacagtgaaaccccgtctctactaaaaatacaaaaaaattagccgggcgcggtggcgggtgcctgtagtcccagctacttgggaggctgaggcaggagaatggcgtgaacccaggaggcggagcttgcagcgagccgagatagtgccactgcagtccggcctgggcaaaagagcaagactccgtctcaaaaaaaaaaaaaaaagaaattaatagttactctgtgggaagaagttttggggctgtgtaaatattctgctcctcgttcaacttttaaccaacaaatataacatccattgatgatgcttaccagattcaataatgatgatagctgcaaaatgatgattttcttactccgctattctttctgcatttactagttgacattctattctaagcaagagtttcccctgctgttctatttatttatttatttataaatgtgtttatttatatagtataagtatggattcatggattccataatgcatattattatgtattctggtgttcaaactgtcctaaatttggccagtgcgagtctcctcaagctttcttttctttccttttgacaggacctcatcatttttttgagcacttctttattttctgacctaattagctattccatcttcacccatccttgcactttccttcctagccctggaattagacttttctccaggaagctccctggctgtatttaggagtgtaatttgaaaccaggatctggacagttgtccaaaatcttgatggcactatggaaagcccttttaatgaacttgaacctgctactcacatggaaaacaggctcaccactccccaaggaatcaacaaggaatgggcgtgaggagagatagctgatttcttttcattcaatttgtatgcttctcttacccataccatacctgccaatgccttcaagtccatacaataatagggctaattaagaatgtcccagacactttcatgcaggggtagggaagcattatcctgctaatcctaaccctagctcttaaggagacacagggaccatctttgagaggaagattagccaggccttttgcatttcttttttttttttttttttgagacggagtctcgctctgtcccccaggctggagtgcagtggcgcaatctcagctcactgcaagctctgcctcctgggttcatgccattctcctgcctcagcctcctgagtagctgggactacaggcgcccgccaccacgcccggctaattttttgtagttttagtagagacggggtttcaccgtgttagccgggatggtctcgatctcctgacctcgtgatcctcccacctcggcctcccaaagtgctggggcacatttctttttgaatgaagactcttatgggtaggatctgcccccaagatctcctaaagaattaaatgatgctggctttacctggctgatggcacagtggaactctgccagagctggctgacagtcccaccccatggtagtagctctcaggttcttccacactccatccagctcaggcagctgaaaacaatggtacacatgaagaagacatgtcctcaccccttcccggccttcccagctctaacaccagctcttcggatattctctgcctcaggagtttttacgttcacagaaaggcaaccacagactgtagagaatgagcctcacagcaatatcctcattcctcaaggaaatgatctgcaagtctgccttttctcccttccgatattaaattgatttattccccaagtgagcaggagatagaggctgtagccagtactggtgtttttggtagtagaggctccttcactctggcaccgcctccttgcatagttgaggttgggcaagagatatgcattgtaaattgcaggtggggtagattttaatgaacgtgaaaaatgatgaagctcattcttggcatttgtcattttcaattccaaatctatcactaaaaataagtctttataagtggacagctcagaggatacatgttgtataaacttgttccttaccagaactctgtggttgtctttgttttttttttttcttaatgtcagagtattttatttagaacaaaacgaatcacctcttttatacatcattttcctccagataaaaaaaatcaaataaataaaacaacacaagtaaagcccccccccaccgccaccaaatccccttctccctttctgccttcaggttaagtgttctgtcttttataatctcaatagaagggaaatctgttgagcatgtgtctgatattctagagctcattgaagcccactatgtgtttgaaatacagcaatgtgtggaaacacttacacaaactgtggtaacagagccctgccccccgacccaacataactttcctttctgccaagaagttttttggcagtttttaaaaggttcactctattaaaaatgttatagaccaaatggttttccaattgtcttgactgggggcactgacttaacgccacagacaaaatggttgcagaagtcagaatgtctcgtttatttacacaggggattgttgttaatagtcagacgctactctagagagcagtttataaaaagggagttagatacaaaaataaatgagataaaatcatttgttttaaacaaaggctgttcaaagtgaggagatgggtttccagcacccttcatgttttaaaatgtcgtatttccctgtttatgtgattgttgatgacactggtgtgcctcagggcattgcagaggactttattaaaagccgaaccaccaccagctttactcttgtggtctatctttctgacacgacattcctttcatctagttttgtttccaaaatatgcgtatgcaaatatctaggggacacaccaagtattgcttttaaaatagacattcaccaaatttgatccatacttctgcattttttgttttcttttctccccattctagaacaagaaactcctttacgagaagatgaagggaggagagagacgaaagcggagggtaacacgtgcctggctggattgttgcggggatgcttggagctttctgagtggggcagtgaacaggctgaaaccctcgcttgttgggaagtcacagaatcctcccttgtgtagtcctgagaaacactggtccatgtgacaagggccacacccagaaagtctgtccttggtttctgcgatggcttccccaggctttagcagatgatttttagtggaacgcgcagtctgtagcaattctagcaactccattccgttcaggaaatgtgtattgcttcccccatcagtgtgggacatatctggggggacatgagggtctgtctgccctcccagggtctgtaggccagtggggaaaaactgatcacacatctgcatcaattctataaaaacacaggacagaaacagggaagtgctgaactgcatgctccaggaaataactttgaaggaattcgggagcaaaagatgagatgaacaaacttaatttctcctatgtatctttttttcttggcctagccagactgatgtaaaatctactagatctgtaatatttgtttgctgtctgttgaatttactgcaggcttagtttttaaccatcccagggctgcccaaggtaggaacttggtctagatactccacatttagctacttcatatacagtgttgcctcacgtaaaactcaatgtcacatttgctttggctttccagggtattttatagcatcaagacttgataagtgatcaaggtccattctgctaatccactggtaccttactagtcagaagggcctggccacctacctccttctttatctgatcagatgaaagtgggagaaaaaacaaccccactgttacatggtaaaatgctatgagatagtgaccattttagttaaaacatacaaacctaagcacgtactcaaagccactgactatttattcagaagagcaagtgcctggatcctcacaaaatttgggaatctgggcagtggtaattgtggccattctgaagggttttgccaaatccggtcagagagagcttcaagaggtgtggattttctggcctcagcatcagtcctcaggcccccacaacagaaggttccaagcccctgtactgcctgacaaaacacagaagacatacagcaattttctacgcgagaagtagaaaatttttacctctggaaacaaatcttttttgaggagagttaacagagttattaggggtttttcttggtgattacagcttccaatagcagatggtgacagaaagggtccaaagggtataatgtggtcttgagggaacatcaagaaattctattctaggaactcaaaatacacataatttaccagtaacacggcttgaatatctccctacaacacaacaagaacatttccaaataagagcaatgactgacccaaaatcaataacttagcttgaaactttaattgtctctacttcctggcccaccattccttctgccctgactcagtgaatgaccatggtcacgatttaggtcatttttccgtgagactagtgattaccaaaactcagaatgctggctaagacacatgctataaaggattttactttagcctcaatttcctccacataggaaaggcttagaatttaggaaaagaagggtcactttgacccagagatatcaagttcttcctgttcttgggcatctacaaagacccattctcatgccataaaccatgggcctctctggattgataaggaagcacgttggccctgcccatcatgaggtctcagatgatgttcccatcttgattaaagacattaacactgccccaccaccacccccagtacatgaatcaatataaagaaactatacgctttcttttttgaacaatgaagtcttccttcagtgaagctcagcatctgctgtgagtttccagaggacattgtaagcaaagatccaatcccagtggttcttccagttgtgaaatgggaatcatgttctctgtgtgccctacccaatctcttgcccaagtgagagaagacaaatatagcagtgccttgagtttttcagagcacaattaaagccaaggctcagctaggcatggtggctcacgcctgtaatcccagcactttgggaggccgaggagggtggatcacctgaggtcagtagttcaagaccagcctggccaacatggtgaaaccccatctctactaaaagtacaaaaattagccgggcgtggtggtatgctcctgttatctcaggtactcgggaggctgaggcaggagaatcgtttgaacctgggaggtggagtttgcagtgagccgagatcataccactgcactccagcctgggtaatggagtgagactccatctcaaaacaaagcaaaacaaaacaaaaacaaacccaaagctcattattattattcctaagtgctggattcaatactcagttaaatatttatcaaaaaagttcacctgattcctctttttacctcctcattaatttttcccctcccctccaacctttgcatgttgtaggtctgggcaggacttctcccatgagagatagattctcctcaaagttgcaaccaagccccatatggctttgaacaactttttgtactcacccaaatccaattgaattcctcattgcttcacaaatgaaatgtcaatctacctttaaatgactgtgaacttttaaactcttaagctgtatcttgttaatatttgagctctactattgatcttatttaaacagtttatgaaccttttaatctcatatttgataaacttgaacctctcatatcctcctttaacatattagaatttttggaataaatattactaaacaaaattctgatatgatcccctggggtaggccaaaccactgtaattgataaaaggaatttttattattttaaatatttctaagatgaattctcagcaaggtgttgtcttgtggcatgtcacttttcaagtgtctgaggacattgctcactttgtaattctcacctactttgtgatgcatctttgtagagtgagtcggacctttcacgattcatgcgtttagcagtcagaatgtgaaagaacatttgtaaatgctaaactcaggtttcattccttctcttttgaagaatgtctgctcacctttcaagagtcatggcaggttatttcatgggcaagagagctccacctgtgaacagactccattcatacatggggattgagcatgcaacagggattgctgatcgtttgtaactacagcttctttctttctttttttttttttttcttttttgagatggagtctcgctctgtcgcccaggctggactgcagtggcgcaatctcggctcactgcaagctccgcctcccaggttcctgccattctcctgcctcaacctcccaagtagctgggactacaggggcccaccaccacgactggctaattttttgtatttttagtagagacggggtttcaccgtgttagccaggatggtctcgatctcctgaccttgtgatccgcccacctaggcctcccaaagtgctgggattacaggcgtgagccaccgcgcctggctacagcttctttcttatatttttgttccattattggaaggcaacttcaatgaacaaacatcttccaaaacttttgaatttttcttctgcttgctaaatactattttgtaaagtttcaattactagttcgaatccacacctcaataaatagatatgtattagagaaggaatggaaaaatatttactcattaagaataccaacacatgaaagtgatttcagagtatggagtcttgagtcaaaaacaaaggacccttcccggaagcttccttttttgcttcagtttttgaatttgactgaaggaaggtggaaatgatcactcgagcccctaatgaattctccttagtaaaatactggcgaggaagaatcaatcccagcaacaggatgatctgggaccagtcttcagatgttaattcccacttggccctactcttctcctttagaacgtttttcttgcaaaatataatttaatgcatttcagattccccttcctacctaaatagggccatagaataataattatctttcttatgggtcttggtatctaaattagtagcaaggacttatgaggtggtttactgcacttctttgcaccaaaaataataatttttaaaaagaccacattgtatctgataaagagctctatagttgtgtgaaaaacacaattagagacatctatcagtcagaaaatgtttcataggccactgaggtattaattagtacactggagtaattgtttggtagttggtaggtgccactggttacattgttgttaacctaataggccagaaacaattcttttcttttcttttttcttttttttttgagacaaaatcttgctctgtcgcccaggctggagtgcagtggcatgacgtctgctcactgcaagctccgcctcccgggttcacgccattctcctgcctcagcctcccaagtagctgggactacaggcacccaccaccacgcccggctaattttttgtatttttagtacagacggggtttcaccgtgttagccaggatggtctcgatctcctgacctcgtgatctgcccacctcggcctcccaaagtgctgggattacaggcgtgagccaccgcgcccggccccagaaacgattcttgttcatttcttttctgagatgtctgtatctgatgttcacatataacaccaaaccacatggtttttgtttgtttgtttttcagagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagcattggcatatggagttttctttttaaagcattataaagaacaatttctttgtttaatagaacaacctgatctacatatatgatagtatatgatccaaacaataatgctgtgaacttaatgggtctggtattatccccattttacagatggtagaactgagatgcattcaacacactgagatacgttcaacacaccattgggaatcatcagcaaaatccagcatgaagagtctctacaggataagtagcctagatttttccaacaaataaatgataggagggaaaaatggtggggtactatcatagattttaaaaggcttaagagacatacgagccaaatataatgtgtgtgggtcttatttgcatcctgactcaaagaaaagcattgatcagacagtcagggaagtttgagtagtaactgaatattttggtatgattcaagtgttacacagtattatattatggctatttttttaaaagagcccttatatcttagggataaatattgaattatttacagatgatatgatgtcttggatttctttaaaataatccagtggtagtgatgaggtggagggccaggagggaatggggatatagataatcaagactggccatacactgataactgttgaagctgggtcaagggtacttgggagttcattgtacttcttatatctttttttttgttgcttttttttttgtttttgagacagagtcttgatgtatcacccaggctggagtgcactggtgtgatctcagctcaccgcaacctccacctcctgggttcaagcgattctcctgcctcagcctccggaatagctgggattacaggtatccaccaccacaccctctaattttcgtatttttagtagcgacttggtgtcatcatgttggccaggctgctctcaaaactcctgacctcaagtgatccgcccaccccggcctcccaaagtgctgggattacaggcatgagccctcgcatctggcttgcacttcttatttctatgtttgtatgtatttgaaaaattcaacaatagaaccacagttaatggttaaaaagtaagagtagatcatggtaagaactggcctggagtccaggtgtggtgcctcatgcctgtaatcccagcactttgggaggccaaggcaggcggatcacctgaggtcgagagttcgagaccagcctgaccaacatggagaaaccctgtctctgctaaaaatacaaaattagctgggtgtggtggcgcatgcctgtaatcccagctacttcgaaggctgaggaaggagaattgcttgaacccaggaggcagaggttgcagtgagctgagatggcaccactgcactgcagcctaagtgacaagagtgagactccgtctcaaaaaaaaaaaaaacaacaaaaaactggcctggaaatagcaatgttggacaaggtagaataaggctacataaggctgtggacaatgtgaggaagccaaaaaggaaggtgaatgaagagttgtcccaaggtgctagggaagtagcagagggatccacgggagagaaaatctggctggggctagtggtgatgaactagatagtgaagtcagagtggctggaaggagaagggattttcctggaaaaaaaaataggaaacttagaggcaggagacaaggagaacctccattagacagactcagaaaggccctttctttctgaatggagtcagctgggcatctgcagcacagacagagggatttgcctgtgggctggagagggtcattactcctatctcagtcttcccacaatgctccagctgaggatctttgaaaccagaaaggtggttatagtcaccccagagacatgtggagaacaaaagaagaggatggtgctagcaccacagccattcatcctgattgaactcccactgtggacacagccagctggagcctcagagcagtcacacagcatgaggaggggtttacaatggagtcattctagaagagaatttcctccgttcttgctactgggagagagaaaatagattgttgagtgtttcctacagcgtttgtgcaaagccatcctcccctcccactgccttcaaagtgagtcacgtgccaggtcaccaggctgagtcttctagggatggctcttccaaatgtgtttacacccaaagatgcagtgttccggaacacacctggaggtcctgaagggagcaattcagagttggaagtgtttctgccagtgagttgggggtctgtctgggttgggcagctacctggaggtgatatgagcttggaaaactgagtcatccactcgatccacagttccacagtcactgccacacaatgaggagcagcatgaccctgactccacacttcccaagactcctggaacagaattctatttctttggcaaggctgcgacgaggacctttcctatttactcagctaggcacaaaggaatagcagaaacatcttttctcctcctctttcctttgaaacctttgagagataccaggcttcacatataaatctcacagataccagccacagggttaggtcctggagaacgaaaccctccagatcccctatctgtcacaggatcacatggtgatcactaaagtgccactgccttggccagggggacaggagagccaggaaaatgggaacatttattaaaaataaattgtcggccaggcacagtggctcacgcctgtaatcccagcacttttgtgatccagccaaggtgggcagatcacctgtgctcaggagttcaagaccagcctgaccaacatggtgaaactccatctctactaaaagtacaaaaaaaaaaaaaaaaaattatccaggcctggtggcgcatgcctgtaatcccagctacttgggaggctgagtcaggagaatcacttgaacccggaaggtggaagttgcagtgagccgtgatggcgccattgcactccagcctgggcaataagagcgaaactccgtctcaaaaataaataaataaataaaatagattgtcagctagaggaactcattcttctagctgcgagtgggtaggggaggacatggttaattacttctctcttatgatccctttttgtgttcctgtgggaccccacgcatactttcatacagtccctgaaacggggcataatgataagagttactctatatacataacaagctctgtatacattgttcatttaaacatcccgccctacattttatagatgaagccattgaggcagacggattccatgacttaaccaaaactcctcaactagtaagtggcagagttggaacttgaatttaggcctctgggactccacagtagacactctcccctgtaccacactaccacctgttaaaagagaaaccttagacagattaaactgaacagactttgagtaaagagcaatttgcaaaacaggttcagagagactctgcactgccgtgtggttgaagacaaccgatggacagcaaaaggaaagtgaggtacacgaaaagtgagggacagaaacagccgtattggttacatttcagtgtttgccttatctgaacatggtttgaacagttggccacctttggccgaatctcagtgattggcacaagagtaggttacagcctgtttacacatccagctaggttacagtttgctatgtacagagaaaactttaggccgagctttcactatgtaaggaggcagctttgggctgaacttaatttggcacacctaatacttgtttacttattatatatgtgcctcattcaactgggttataagctccttgaagccataggctgtgtctcatttttctttttatcttgatatcttgcacgcggcctaacaaaggcaataataactgctgaatgaatgagcatgatggaatgttttaaagacgtcataaaaggtaaatcatcttagactgtgtacagagggaaaggtggaattacctctcactttggtgggatttacagattgatgtgaagttgtgaacatggttctcaagtctttcttttctttttttagacggagtctcgctctgtcgcccagactggagtgcagtggcacgatctcggctcactgcaagctccgcctcctgggttcacgccattctcctgcctcagcctcctgagtagctgggactacaggctcccaccaccacacctggctaattttttttgtatttttaatagagacggggtttcaccacgtttggcaggatggtctcgaactcctgaccttgtgatccgcccgcctcggcctcccaaagtgctgggattacaggcgtgagccactgcgcccggccctcaagtctttcatagaatcagccagtagaactacccgcttcttttctgagtcactgctcaagtgtcggtagttcaggaagtgtcaaggcacagagttcctgccaaatatctcagtttgctgcacaccatgacggttgtgcatgattcatttattagggagacagaccagatgcgtgggacggccctgctcaccatcaaggcagatctgtgggcagacagagcattgggttctgctgtgggttttcatcgaccagtgttccctctctgaccatgggaaagccacatgggcagtgcagaaggcatatcccagcccttcactggtatcatgtgctgtggcaacagccttggggattagaacagagaaacctggggaaacattggccactcaatgagaagcaaacttggagggtaggaggaaagtcctaaggaggggtcagggaagtatccaggccatcaactttcaaagtgctccaggacataatttagaaagtcaattggcacacctagccaggagtatatcttgagaaagtagtattctttgaagcctcctgaagcctgggttttaccaacagcccagtcctggcaagattcggggagcttgtacttcacatactcaactttctgtttctaaagggaaaggagactctaccaagcctttttggccatcaggctgctcttccaaaattgtctggtgacttaagtgtaggtgaatcagaaacatgtggatcaaatttcctgctaaaatacacatgggtttggcaattaaaagaaaatgtgtagaatatggcagatttggtggccagaaagccccgtgagaaggcaagggccactgaaaattatcgtaactatatagtaaaagaaaacttgattccaaatgggcacagaggaatccatggagaaagttggtaagacatttatgggtgtcacacatcggcttctgaaggccacaagtaaaggcagggtgtttgcaaagattcttgtagaaccatgtccttgaatttgggtttaaaaacttattaacttataagttgcaaaagaaaggctcttttagaaaagagctgctataagatgggctgagttagaaaaacctaacagcccatcctaatagactgaatgttctattgtttgatgaatgttatgtgccagtagaacttgttgataagccattcttctgaacagaaaccataactatacacacaggaaacaaaaatatttgtaatggcttttagcagtggcaactgaacacctgaggagtgagacgcatcttaataaagcccatttggaaactatagtgacttccccacaaggtgtcaccttccttgttaggactcatcacgataccattcatttattcattcagcagtaacttatcaaggatctattctatgtgccaaatactgagctatattctgggactggggagtcttactaaagaggtataagatataggctcttccttcatggagtttaaagcacatttgcaaccataaatattcagctatttgtacactattattacacacttgatcccatggcatcacagtttaacagagtagttagatacaaaaactttgtaattagatttgcatttgacgggttctgtgacttacaagttgtgtggccttgagcaaataattccatctcactaaaccttagttctttcatgtaaccaatgggaaaggtaatacttaccttatcatattgatgtgaagatcctgtgatgtgaaattccctgcaatatggcacctgtgttaaacctctatttagatgccaaattcagaattcatcagatttcagggcaagaaacaaactctttactctggatatttccatatgaaagggatttaatgcaaggaattatgtgcttacaaaattatttaaagaagtggaggagcatgaggcagggatccacagttcagtttaaccagttcaaggtcacgcacatagctggaatccagaggtcaggaaatagtggttggtgtcactgccaccaccacatcactaccaatgatgtgtgatactcccaaagtcattgtcttgacacaagaatggtgagtctgcctgcagctaccatctctcatagcagaaacagcagcagaaaaatagatgtttttctttctcttccaacttcaacatctgtgggagtgcatctatttggtgttccagtttgcttccaaaagcctgtctcctgaggagtcaggtatcagctacatcaggggttcccaacccctgagccaccaaccaatactggtctgtggtctgttaggaactgggccattcaggaggaagtgagccccggtcgagtgaacattacggcttgagctccgcctcctgtcagatcagtggcagcattagattctcataggagtgcaaaccctattgtgaactgtccatgtgaaggatctaggttgcacactccttatgagaatctaatgcctgataatctgaggtggaacagtttcatcccaaaaccatatgccccttgccatccacggaaaaattgtcttccacaaaaatagtccctggtgccaaaaacgctgaagaccactgatctatattttccatatagggatagccaaaacccaggtaagctgaagctctatgaaaattcaaagtagagcccagctgtcctgatctcagttttaccatcaatttactatcttataatagctccaaaggagaaaagtgaaaaaccgtagaattttagagatcattttttcccgccttcctggttgataaagtaagaaatagtgcttgaaagaagatgaataatcgcagcacagacgtaaaccaaactcaagctttatcattaggattgacataggaaccatccccatgacatagaccccaaaagtacaatggtatgaatgaaaaaggtgacagcggaggctgatctttatcatttttcactatgcttggcttttttgttattgttgatttttgagttggaatgtgagcttatttatcctccacagcttttggaagatttcagcctggctcatcctacgttagagtgtctgacaggggaataacgcgtggtatttagatggcaccagttatccaagaaggtcaaatttctttgcaattagtctgtcgtactccagaaagccctgagagatgagacgttggggtatgagagagggagttatcttcatttaacagcagatagacttaggaagcggcaggggccaatgaaaaagcaggaacgagaatggaaaatgtcccaacactatctcccttcccccaccaacaacccaggaaaaattttccaaatcactttctacatatgccttgactgttgattcatcaaagatgtcttcaatagattcacaactcaaaccacattgtggtatttaagtaaaggggagcattgaaaatgtgaatatagtatttcttctatttttgcaaatggatgtgtttgataccaaacactgtcagcagctaatactattactatgtttgctaatatgctcagatcagctgggcacacaaccaaaacccataacattcctgagtgaagtatgatcagatgctcccaaatgcaatttgccttcttccctcgcatcgtaagagaaaaggcttttgttggatatgttttgtgaacaccaaagagagtaaatagctttttgaagaagccaaagtgttttcctcctgattcattgtgaatgcctgcaagagtgtttccttttaagttaaaacaatttacgaattcttcctactaaatcaatctacatatttttatcactgctatttttaataagtaacttttctttctgaaaatttatttcactttgccccaacctttctgtgattcttgggagacaagaaacagagttcatgtaaaacactcttgtttatgatggatgaaaccacaaactttgtgtgatgttaacccactcacagaaggagaatctgaacttcagagtattttgtgtttggagagaaggctcactaagggaaatgggctcacttcaattcaatatattataggaaggaaaggatcaaggaagagctggtcttaaaactgtcaaaatataagaatttgatgggaagaaagaaggaaaacagagcagttggaaatgcaaagataaaagaactggatccagacatgtctatgtaatttcccaggaatggaaattgtactggcaatttggaaagagatatcgaaaaacaatatacattaaatgttgagcttttcttgcagcaatgcacttggaaggctcttagaacacatggcataatggtattatgattcatctacatatggcctgatccttggtgactgatgaaaggggaaaccaagtttcataaggaatcaaacacagaagaggaagctaaacacttttttagagaaaaaaactcttttaagcttctaggtcatcagcagagtattaactaacgcagcctactaaatttgcattgggatagatcacatatgtaatttcctttaattcttcaataaccctgtgacataggcatcattttctctgtttcctgatagcccaagagttgccatctctaaagttgcttaggtagttggtggttgagcttagatgcaaacagaattctttccaccacaccagtgattgtcaaacctggctgcttatcagaatcatctggagagctttgtaaaaatacagattcttggcccaggaaattctgattcagtagtctagagcaagctctggggatcaattttttgttttgttttgtttctccagtgactctgatacacagtgaatttggggaaacattgcacacaattgcaaccagaaatggtgtgagaatgggtgaatacaaaagccccggagggaaggttgtagaacacagggactccactgctctacgagaagcctgctaaactacacccagccataaatagtctcacaaaaatctaccagatctgaaaaacatgcttcgacttcacctgaatttatttctaaggccccagacattcctaatcagcccatctcctcccagatggctctgcaaaccattcctatcgtttggaattatgttttcagaagcctcacaaccatgataaaatgctgttgccataagcattttcctatctcctcaagatgaattagatgagctacttagtccttcatcaataaattgtaaagggagaggcatttggaactatggatgcccttcaaatgtacttggctagttacttgcctctgtttccaaaaagattaaaacgtaaaagaaataagtggcaaaacgtgcatcattcctggccacatacccaaatattctttctcttatccaatatgactttttcctttgcatgctttttcaccaggctaagaaaactaaaatatctttctacaacaaatccttaaggtttcccagaaacacaaagtaatggtgcattatttatttcttaggaaattttaccatgttatttttagcagagtgcatgttaccctgacacaggccataaaacttactcacttctttggggtctgaggaatgtcatcttgtgactggttttacagggagaacttatcggggtgcagttgcagtttccagagtgagtcagtgccatcattgcctccgctgttattcagtgggtggggcacctggagcacaggaatgtgctctctgattccacgacaaaactaaggactgaggctcccctaggctcagttgtagattttgaggctcttgagtttcagttctccaatgagttccaggtaaaatgcagaaaccaggccaggcaccaatggctcatgcctgtaatcccagcactttgggaggccaagatgagtggatctcttgcccccaggagttcgagaccagcctgggcaacatggtgagaccccatctctacgaaaaatacaaaaattagtgtgtgcctatagtcccagctacttgggaggctgaagtgggcgggtcatttgagcctaggaggtcaagggtacagtgagctgtgatctcaccactgcacgccagcctgctgggtgagagtaagagcctgtctcaaaaaaaaaaaaaaaaaaaaaatgaaggaggagaaatcagaaacagaagcaaggcaaaaagggggctagagcaagggttataacaggaaggaaaataagaacagctgcacttttaatctattcattcaacaaaggtctgggagcatctatgtactccaagtgccatgtagaggccggggattcagtgagccacacaaagacggttcttgcccccacagagcttacaggcacgcggaggaaacagacaaaaaccaagcaaatctacaaattgcataatttaaaaatttggtaagagccaggaagaaagggcgttagtcaaaggaaggacatggcttagtatataagttaagaaatgtccaggctgggcacagtggctcacacctgtaatccagcactttgagaggccgaggagggtggatcccaaggtcaagagattgagaccatcttggcccacatggtgaaatcccatctctactaataatacaaaaaaattagccgggtgtggtggcacacgcctgtaatcccagctactcgggaggctgaggcaggagaatcacttgaacctgggaggtagaggttacagagagctgaggttgcgccactgcactccagcctggtgacagagcaagactccatctaaaaaacaaaacaaaacaaaacaaacaaaaaagcaaaaaacaaaaaagaagaagtgtccagtggctttgggtcagcatcggtgaaagtggggagagcaataaagaagcaattgcaaccttttaggtgagaaatgaccgtgacctggacttggggatgggccgcgaagagtcaggatggactcaagacagctactggactgccactggccgcgacactttggagaaactctagcagttagttcttccgacacagttcctacaggtgacgggataaaaatagaagacagcaggggaaatgatgaggagacctggagcactttagttacgattcaactcagcctgtgctagggccacagggactcaaagaggaggaaggagacactttctccatgcaaggagtctacatttcattgaagaagatgtgtccagcatacatgtaactacaataaaggaaaaatatgacaagaataatagaaaaggcagaaggctctgagaaggaggcttgaggtcagagtaggaattcaaccagaagagagaagggtgggaacttctgaggggagggaggagcaagagcaaacgtgtgaacatggtggtctgtggtatgtgctcagctcctgctgggctcaaatgttgcatgtgcacagagaacattagctggagaccatcaggctggcactgaacaccaggggcaggagtggatgcttgctactcagctgtgcactcctctcatgttcttttctacatgtgtgcaattgaatgtctgtgttatatgtgcgtattaaaagcgaactctcaccttgaaattcttcttagtggcaagattcttttctctagattgacagtgcagagctcacatagtaatcactgctgttaaaatagatatttaggactatagagttaaagcttaaataccatttaagggaagctgctgttatctgaaataatttgtctttcttattgaaaagaaccaataccctccctccctctttccctccttccctcccttccttcccttttttctttcttccttcgttggaagagtggaaacataacgaggggttctggctagtgtcctgaggtgttggctaggtaaactttctggagttgctcgtgccaagagaccagcacatacatttctctaggggaagtacatcctaattattccacagacatccatggatcactctggctagcagagtagcactgcaaaaatcattacgatttttttttttcagaaagttgttctactttggcttaatgtccacatgaccaagaatcacactttacagtctttaagggcctatcccatgctcagccactttcctacaaaatcgtggcgacgtggaaaggcagatatgtgcacctgggagcttctaagatcctgtctgctctggctgatgcagtgaccagagtcaccagaaaccctctgctccatctgggagacccaagagagatcatctggaagctggtatctggggacacactgctacattgtccagtccaaagtccatcagctttgttttctttctctgtcacacgaacaagtaaaacagagtgtagaaacaaacactgcaggcaaggttacctagtctccttgaaaaggtttccttcctactggctaactttcaacctaagggaaaatgcagctcgatgctcaactggtagattttctttcacattttattatacatgtgcatataaaggaatttctcttactattggtttcttccttctctgatcctctctccaaaggcaccacatttctccagagagtgtgtcccaaatgcctcatgtctacggagttctttgcaaacattaatagacaaatggttagtttatataaagcacacatgtattgctctgacataagcagtgaggagcccacagtttacatttttcatctttcttttaaaaaggaatgagaaatcgtattccagatgatccaacctattacgctacgaagggaagagtggagagggaaccaagattgaaaagagatttaaatttggaccctttgtgagccaagtgcaaattggtgtacaagttcacattgatctttagaagggaaagcaggtattgaatttgctttccacctttagctccatccttctctaccttgagaagaagcccaaaatactgaacttacttataagctcctaattttaaaggtagactgatacaggttaggtgcaggggctcatgcctgtaattccagcactttgggtggttgaggcaggcggatctcttgaggtcaggagttcgagacaagccgcggtcaacatggcaaaaccttgtctccactaaaactaccaaaaaaaaattagcagggcgtggtggcgagtgcctgtagtcccagctactcaggaggctaaggcaggagaatcgcttgaaccaaggaggcagaggttgcagtgagctgagattgtgccaatacactccagcctgggtgacagagtgaggctccctctcaaaaaaaaaaaaaaatgtatatatatatatagagagagagagagacagacagacagacagagagagagagagatagacagagagagactgatacagtcattaataactaatggcaataaggcaggctttggtttttgtaggaaacctcaagacaggccatatgggttttctttttttctttttcttttctttttttttctttcttttttttttttgagatggagtctcgttctgtcacccaggctggagcgcagtggcgcaatctcggctcactgcaaactccacctcccggcttcatgccattctcctgcctcagcctcccgagtagctgggactacaggcgcccgccaccacgcccagctaattttttgtatttttagtagagacggggtttcaccgtgttagccaggatggtctcgatctcctgacctcgtgatccacctgccttggactcccaaagtgctgggattacaggcgtgagccactgtgcccggtggcatatgggttttcaatggccatgtgttcagcattctttatgagtaaactcatgtgatatcgaaacccatattcctcatatgtgtgttcatattttacacaaccaaatgttttgacaataccaactatcaaattatttaagtcatttcgcacttaggaatagttttctttcatgaaaaaatagtggtatttgaataccagttctaacagtgtatggtgtagactcttgttcacagtatagagggtagaagctcagtgtatggggctcaggggtcagcagctgtcactgcttcatatagctgtgtgcccttgagacagtcatacaacctctctagacatcagctttctcatctttaaaacagaacaaacaatagtagcaatttcgtaagagtgttaaggtaattaaattagataatgcatataaagcctcgtgtttggtacacattaagtaattaataaaaggccactttaagaaatgtatgtatacacacacacacacacacatacacacacacattgttaatcctataagaaaaaataaagtgttatagtatgttattcatacaagagaatattatactactcttaaactgatatttttgaagaattttaataatgtccgcaaaaataatcaaaatattaggttaaatttaaaagttaaataaagcatcttattatatacagcatcttctctctctctctctctttctctcacatacacatgcacacacatacacatgcacacacacatatacacacactatataattagaaggaaatccatatatgtacatatatatacagtgtgtgtgagcaaacagtggttatttggggattgtgagattacggcatacttttattttctttgtatttttctctatttccaagttttctgtgatgagtttgtaatatttttacaataacttcatgttataaaatattttataagatgtaatgaatcagtccaagtgacatattaggagagcggcagcaagagcaaaatcacacgtatacttccatgccttcaaaaaaggacacaagagtgaaaacgtgaatcctaaaatgacttctggtaaatagcagagacatcaaggaaacaaagactgggaagggactaaataagccaaaagtcaaaaaaaaaaaaaaaaaaaaaaaagtgaggagcaggatagccagagacagcggggtaaaaccttgcaaccttcagtttaataggtactttcaacagatcttccccaaggcactagcattttaaaattgcattaaaatgagcttttttcaaagagaaaccctccaccaaaaaaaatttagaaaatgaagaacacaagctataagggaaaacacaaaattattaactgaataaagtcccatcacatttttttcccaagagtgaggtcacatcaaagagctcaaaacaaatacattcggtataaacctttcaaacgtaacaggttaccctgtctgcagacaaaggaaggagccttgtttcacacagactctgttacatttaggcactgggtatgtgaattttggctaagaaatacattgctgtctctgtctttctgtcttgtttcactccccagtctcttggatgggagtttcagcctgtctgactacacatttgggcatcttctggtctcttattcttagcttctatcactgcagtggaaccattctgagaagggtaactttaggttagcatgattcttgtagtgcaggcaaaaaagagccagaagtgtttggtaaaactgtttactggttttacaaaaaaaaaaaaaaaaaaaaaaaagttgttgtgccatttactggaaggtatcactcattttctttcctgtcttcctccttccctttctctcccttctttccttccttcctccctccatccctctctttatctcttcctctatctctttcttttccccttattttcttctcctctcttcctcccttccttccttctccctgtgcaagtactcatttcatagctttgtcaagcatttgccgtgtgccacccctgcgttacccagagtgaatataaagatacataagacccggtcgggcgcggtggctcacgcctgtaatcccaggactttgggaggccgaggtgggtggatcacgaggtcaggagatcaagaccatcctggctaacacggtgaaaccccgtgtctactaaaaacacaaaaaattggccgggcgtggtggcgggcgcctgtagtcccagctactcgggaggttgaggcaggagaatggcgtgaacccgggaggcggagcttgcagtgagccgagatcgcgccactgcagtccagcctcggcgacagagcaagactccgcctcaaaaaaaaaaaaaaaaaaaaaaaaaaaagatacataagacccagcagacgctgatattagacttactgttttattgtgttagctcccagttgaactctagtatctatgcagacactgatgtttattaggtgcctggcactttcacagagcttgttttacttaattccagcatctacccagaagtgggtgttatcaccattcctataatacagatggttgaatttcagcccagaggctttaaatacctaattgagacattcagcttctaaggggaagtatcaggaatttactctgactttcctgactccgagttccgtgctttttcccactgtgccagaactattgactgtgaaggattatgttcacagtttgaagccttcaccttttgatactgcactgcacgtggagtatatgcaataaatatgtgcatgaaatagggcaagaattgtattacaatggtcctgaataactcattccatatacctgtatttggcaacattgtccagaattttcacatgcacgtgcattttccatacacaggaaactggttaggcatacacctcagacaggtcagcagacatacacacttacataagggcttgtttgcattctgaaagcatgcctactcagattggagcttgttacaaagaacacatgggaagcaaaaatgttcagtttacaaatgatgctcaaaatcactcttgaaatcataatagaaacatcacatttgttttaaatttgagggtttaaaacattatcaacatgtagagagagttatctagcaaacacatccatgtacccatcacccagaaattcaaattgtccacattttgtcatatttctttcaagattttttttaagacataagatttttaaatggtttgtaatgttgaaatttcttttgtcgtccatgcctgatccacctcctcccctcctcattctggtgaacatcattaaaggtatggattccaagtcactatttatccatgcacatgaccatatgtttcacaagcaatttatgctatttttatatgtttactataaaatacacataatggtatcatactacttatatcattctgcagcttccttttttttttaaaaaaaagcatctctatgttttgagctctatgttaaaatataaaaatctaatcaatttcttttattagctatgtagcattttgccatatgaataaaataatttcttatgccttctcctatatttgttgatggacattaagattgttacaaacaataccttgataaacatgcttatacaagtttctagtcctcatacacacgttcaaatttttctaaggtgtttacctagaagtgtaatgtctgggtggcatactaagtgcatgtttaatattaatgcaaattgacaaattactttctgaaatgatggtactaatttaccctctcactagcaatgcatttgcttgcttgcttctctctaccttttccattgctggatattgtcagacttttagatctttggtaactttgtagataagcaacagtatcttctcatttcagtttatatttctctgatttactggtgtaatgttgcatctttttatatttactggctgtccaggtttcttttttgtgaattacctgcccatgtgctttggccatgtgcaatttttttttcctattgggttatttgtggggatttttttcttactaacttataagaaaaattcattctgaatatgatccatttaactggtatttgactcttgtaaatatgtttttacttaatcattatcaagtttataggttaatactttttttctttagaaagggcatacaaggtcagttccaactgtgtaaagggctttattcttttttaatcctatgcaagacagcatacgtagtctctgcaattggatgaacagctgtaaatagcttttgcagatctaagtaaaaactcttctctaaaggtcttcaaagttattctccaaacctggggagtagccctcttttagcttcttggggttacagagaggctagcacattccaaacacaggtgggcaaaaaaagaggaaatggactttacttttacgaaccagtggctgagcagaatctactcttctcacaacctcaaagtagtttgaaagtactttcattaaataaaattaatcatttagtgatcgtggtttaggcatcatggtttaggcatgactacatcgagtcattctacttcttctccccttactaaaagcaggttttagttatgtaaccatgtttagagcggtctagggagtttttatccttatgccttcctcctgattggacaatggtttgcaagaacttgttaggagctgtggaaacacaaatattgggcaaaaaacttgtgtttctatataaatatttacaaacatactagactataaattctttgaggtgagggcctgtgtttatcctatccacgatggttataccctcagcatttggttcagctgacaatcttagtgggaatgtgctcaacattctcaatccacaactatttattgaatctgagtgctgtgttagacaatctatattctatgtgcttcatgtaatcaaagtgacctagacaaaatccctgcccttatgaaccttacattctagtggcaggaaatactataatgccagggagaagggagagagaaatgagaatgaagaaaaatgatgcagtgatgcatagccctctctatctctttgggatacagagagggggcgtgtgttgtggggaggaggtgggggctctattataaaaaatatggcctgagaaactgcatgaggaagagtcatcatgatttgatacatggagatagagaaaaccacagtgtcagggctccaaaaaaaaaaaatcacttccattttgggaggtaatttcagcttctttgtatttgatttggggcagtatataagtcttgggaaaaaaagaagtgactaaagcttttattttagatgaggaggacttaatgaatttgtaaaatatgctcccttttgtggggagaagtacagcagtttgcacgttgggagaacagctggctccaatacagcttggtggtgggcttcgactgaactggtcatcgcctaagtattttgtgtatttctgattacctatctctccaggagcccacgtgagcaagacaggtcttcaagctggttcaatgctcccattctgtaggcaactacaaactgtggctcactgcatgacttaacaacaactgattgagaattgtaaagtgcagcctcgagttcatgtgtagaaactgccatctgcacaaacaaaacattgagaggactaagattttaaggatactaatgcagacgtccttcttgcttcatttatttaaaaatatctatttcacgttcctaacagcatctagtagatgtttcttgcttcttccccctaacgccggactaaagagaaaaaaaaaataggctgttttctggtctggttttgttttcctagtcaagtacttaaattacgggtgtttcgtaagtatcttttgatggatttcattgttttgtttatttcgcgttagacaatacagacaccttcatatttccttctgtagcaaatctttttcaaagtcttcatttgacgtggctgatggagctggtctgcagatcttgcagacgtgttaatttttgcacggactttagcttcaacacacaaaacttacggcctctttgaggaaccaatttttcaggctaagagaacaaatgaaagtgttcgctcatctttcgaaaactatttatgtacttggtatccggaatgtgacattggttttacacgtcggtaggtttttgtcctaaatttctgggaagttacttcctcatctaacgttttattttcctgacttattcgtctttgatatgctacagaaaacccctctcgcccagtggctgttttctctctgtctcttaagataatttaggaacagaagccttgacttttgacggtcatttagttttattctcctcccgtgactcccctctgtacactcacaggggaggccgccggcatctgggctgaaagaacccttggcgggcgaggagagcagggtgtcatgttggcgacaggctcctgctggcggccagcgagcccgccaggttaacgggggcgccggggtcagcgccctcgaagttgggggcctcgggcggggccgccggggagccacgacggccgctcgaccagagcatcccgcagtcccgttccctccagaggggaagaatggccgaatctggcacgatcccacggagatctcgctcttcccagcgcagtctccgctactgagcgcgggaccaacgcaggcgatgccgggcggccgacagggaaagcccagacctggggcagagaaggaatgaggggccgccagccggggggatttcctcccgctcttccctctccaacgggagcggaaaatgtgatttgctgtgcattccaggcgcggttccctggggtgacctctcccagccggcccgggcggggggagcagacaaagaggcgaggcgggcggagaggggaccccgcggggaagcaggaggggtgcggggggcgggggcagtaccgggaaagggggcggatagcgggtctggcggcggcggcggcgcctggccaatggagaggcgcggccccgggcgccgcgctctgccgccggcatttaaacgggagacggcgcgatgcctggcactcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacaggtgagcgcggacgcacccggcagggatgtgagtgggcggagggaagagggccgcaaaccaacccaggacccgctcagttccacgcgcggcagccctccgtgcgcgcaggctcgggtgcgttgttcgcgggggtgaattgtgaagaaccatcgcggggtccttcctgctgaggccgcggacaccgtgacctcgctgctctgggtctgcagggaaacgtaggaaaaaaagttgtcaggagcgggcaggatgacccccacatcccgtttccacctcccggaggcccccgaacacgctcctggtgctggtggcagcagcgcctggcagacgcgcccgcttagcgagggcgcgaagtccaggccgccagagcgcaggagcatccggacctgctagtcggccgctgactgcgcggcgagttgccttgagagggtcccatgtgcttggggcgccgcgctgggtctgggggcgtcttggggcgcccattggagtccgcgggttggagcatccggagaatccatgatgtgtgcatttgccgatccccgaggtgagatggagactggcaagggcagagccgctgtgttcagccacagcggaaaaccgaacggtgggtaatccgacagctgcggtgcggggcgcggccctggccgcggggtccagcgaacccgcagtgctcacaaggcagacaccacacgcgctcgcggaccggccacgcactcgcgggcgctcgcttctctactccagcctcttccccgccccgcgcacgcccgggctgaatggtagacgttctggcgccgggcagcggccaccggctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccacagcttgcggagcaaggccatagcaggggagtgggaggtatattggggctgtcacctccttgctggccggagttatttgtagactacagactccggaagaacagacgcgccaccgctctcgcttggcattgccttcggatcgcagctcctccttgggggtgccccagcttggcgtttatttgcctgcgccaggctctggcgacggtcaccgggccaggcggggagggacggacggcaggtgaccagcctctgctgtgaagaaattcctgcgcgcccggagctgtccctaatgcattcccgggtcgaatccgtctactgccttcccctcctcgaccgactccgaatctcggctcttatagacagaaatacagcctcagcgttaggggttaaaatccccctcttaaacggtccgagggcagagaggtgaccaccgataggtaattggatctcctgctggaaagagcaaatctgagcggtgtgcgcgtctgtttatgttccccttcgagatggtgccaggacacgaactgattaaaacaatctattgtgttaagtgggtcactagggttttaagctgtcccagggaccccagagtagtggcttccttctggctgtacacacaagttaaataaatagcgtagaagaggttaagataaccccattctagggtgaggagtcctctttcatccctagggcttccccctccccttttctctttttttggaaggagggggagcatgagagtcttgagggggggatgtacttttcaaagcaaggagggaaagatcttaagaaaactatatattctcactgccccccaagccaagtctataacagtaggtgatttgattactatctctggataaatggcactgtcaaattgttaatattaactatttcagggatttttagcagggtagtggcagtatgtgtgcgtgtgtgtgtgtgtgtctgtgtgtgtgtgtttaacctccaggtcattgtaggaattagagtcttttgtaaactttgtaatttcacaggtttcctattttcttaaaagttcatttttagtgaaatgttttggtaacccacgctctgtaggaaatccaggttggctaatgcggtctttatgtgagtagttacacagggaaggataaaaaccttttatgtcctacatctctgaatgagggctgcctaccctgtctttgaaactaagccgaagatgccttcagtctgaatggtcaagtattaaaagtgataaaatgcaaagaaatttcatgccgcagacacctcccccaagaactgcttgttgacagcaaagctgtggaacatgttccacaacagagagtaaaggacagccaggaaatataaaccttttatgtaaaggaaaggcaggtgggggacagtggttaggggaggtgactgcagcctctaaccaaaaggcaaccatcaggcaagtgctaccagcccgtgtcttcgatctgcaaggaattttctttagttttaacatatgctcttagaaattcaaagtacaacaggaattcctgggacaagagaaatctttttattcacatgtgaacatgaagatacaaaatagataattattttatttatagcactcttcaaattgtattgcattagaaaacatatccattgacccactgttaaggacagcactgggtgtcaataggacagtggttaaggacctgtgtttggggctagatagaattgggtttaaactgctggctgggctaggcacagtggctcacaccggtaatcccagcactttgggaggccaaggaggacggatcacctgaggtcgggagttcgacaccagcctgaccaacatggaaaaatcccgtctctactaaaaacacaaaattagccaggcatggtggtgcatgcctgcaatcccagctacttgggaggctgaggcaggagaattgcttgaaaccgggaggcggaggttgtggtgagcccagatagcgccattgcattccagcctgggcaacacgagtgaaaactccgtcaaaaaaacaaaacaaaacaaacaaacaaaaaaatgctggctttcccacttatgagctgtgtgaccttggacaaatttccaacttttctgagtgtagattccctgattggtaaaaggaagatgatattatctacctcatattttgttatgaaaaataaatgataaaattgggtcagaaatcagcataatgcctggcacagtaagggcttcaaaataaaaggtagctcttattattagtaatggtgttaggaaaagtagcaatgttatacagaaccaggatatatcacagggcagttctgaaattaaatcctgaatcctggccgggtgaggtggctcacgcttgtaatcctaagcactttcggagactgaggcaggcggatcacgaggtcaggagtttgagaccagcctggccaagacactgaaatcccgtctctactaaaaatacaaaaattagctgggtgtggtggcaggcgcctataatctcagctacttgggaggctgaggcaggagaatcacttgagcccaggaggcggaggttgcagtgagctgatatcgtgccagtgcactccagcctgggtgacatctcttaaaaaaaaaaatcctgaataccacactacgcagtgactaacacatctttcactacagaacagaacctgtaacttggccgtctctcagcagtgctgctcagtgaacatttaataatttattactttctaactcgtttcttgttgacctcaagaattgtacatagtcattaactttcctaagaaaatctttgacaaacatagagctcctgagatatttcacaaccaggtggtctcctccctgtcctatgcaatgttgggccccagcctgatttagccgacctggtcttcagacttgagaggctgtttagggttcttacaacacaaaggggatgagactttatcctctacctgtctgccaacaagggattcttcttatctccttggtgcaacttgtctgaaaaagaaagtcaacacaattatcttcttaaaagttaaagatcaaattaaaaataagctatagttttcccaaagatttagacctgagaaaaaggaatagatctttctaaaacctggcctgcacttagagcatttgtagtcacttccactatttcttatgctgagagaataatttgatgtcatgcctattgaatgtctttctaaagcttgattcatcaggaggaactgaccagaagtccatgcacagacatttggctttcactgtaattcctactcaaaactccctttcactgattatgagcaggttgcttagctaaaatgagaaatacagcaagaagagggatggaaagagctggcttaaactttcccaaagacatcatgaacactgggaacaggtcatacatataccatttttatttctcagtcctcagtattagaatattgtgttcctagaggctttgtgaaaattggaatacattgccatgacctgcacaggatagaggtggttaatatggcttaccttgcttgtagatgtttactcttgatccctaagggaaactggaaggaaagcatgctgtagagaggacctgctttgagagtatgtgtcctctgggacaagtggaatgaaagagaggatagaggcaaagagaaaaaaaggtggagatggggtgagacttgctggtggacagttgcaaagaaaactcatgatgagaataacatcacatttcttgaagaagctgaactgcattgatgggaagttgaggcagagtttgaaaagaagatatactgtctgcaaaaaagaatcaacggagatgtcaggtatcttgatgcaccctgagtctatgagatgcagcttaatttaatttagtgatatgagtaggccatttcataagtggtggaaattaccataaagtgtttgcagctaatgacggcgcatgaatgatgtcataggaacctaagtctggatgagctatggattgaatttttactatgggacacccttctacatgttgctgtggaaaagaattgtcctcaagaaatgtacatcttctgcatttcctctacatctctgatatttacaaagtgcacattatttggtgatactacaactgggatttcaagtgcacatcactactatttccttcactgaagaatcaagagcagtctgggggtggggagagcttgagtgattgacaaggatgtggcagagccctggttccactatgaattatagttcttaccctgcttactgtcactcatgtagagcagctagtgtgcctcagagcactgctgttctctgagaagctgaggtctcgattgacattcttgaagttggtgtttacttctctctgaataaacaaaggttggcaactcagacatcttacaataagtactaaagatttttgaagaataggtttttaaaaaatgaaaaaacatttcactttccatagctaataaatcttattttgaggaaaatgtacttttctttaaaaaaaaaaaaaaagcctgtctgtcactctagaccctttggcttagaaggtaggcacactcacatagaaacagaaagtctgtccaaattaaaactgaaaaccacagttgactaattttgaatttatagctctgctgttggcttctgcgatagtattaatttcaatggcttcaattagaaaatgaaacccatagcattccatatgagaacaggtaaaaagtcagggacatttggagttttccaagaaaaagaaagacaagtcttaggaagctctctaggatggaaggaatttgccacactgagagttagacatccaaaggatagcaattggctcttctgctcatgggcactggtgaaggcattttaaaatgcgaagaatggtacctctgtaaatcaatgaggttcataataatcatgcatttaccaaatttttataagcacctgccttgtgccaggcactgagggtaaggtgatgaataagccctcatcaactgtcagactagatatttactcaataacagatgtgaaaatgccaagaaggaaaagttgagtataaagaaagccttaagttggttcagagaaataaaattgcatttttcggatagatgtttatggaatcggccttatgaggtaaacttgtcctatgcagtgaacatacattcccagttagtctcagattggcctctgtgatgacaaactcagagggtcctggtctaggaggggtgaatttgtctggaggccattttcaggaggtatggaggaagactggggcataggcctggggccatcccatgtactcctcctctgaaatggggagcaactgaattgtgttttattttagatcttcgtccaacttgaataccagaaattcgtgaaaccttctcaaattcacactatattttgagaccaggagaaggctccttgagaaattgccacactgtcttatcctagtctctggaaaaattcagtcctgtattataactgggcgtttctcataagtgctttttttttttctttttctttttataatactttaagttctgggatacatgtgcagaatgtgcaggtttgttacataggtatacacgtgccatggtggtttgctgcacccatcaacccatcatctacattaggtatttctcctaatgctaccccttccctagccccccacccctcgacaggccccagtgtttgatgttcccctccctgtgtccatgtgttctcattgttcaactcccacttatgagtgagagcatgcggtgtttggttttctgttcctgtgttagtttgctgagaatgatggtttttggcttcatccacgtccctgcaaaggacatgaactcatcctttttatggctgcatagtattccatggtgtatatgtgccacatttgctttatccagtctatcattgatgagcacttgggttggctccaagtctttgctattatgactagtactgcgataaacatgtgtatatgtgtctttatattagaatgatttataatcctttaggtctatacccagtaataggattcctgggtcaaatggtatttctggttctagatccttgaggaattgccacactgtcttccacaacggttgaactaatttacactcccaccaacagtgtaaaagcattcctatttctccacatcctctccaacatctgttgtttcctgactctttaatgacggccattctaactggcgtgaaatggtatctcattgtggttttgatttgcatttctctaatgaccaccgatgatgagctttttctcatatgtttgctggccccataaatgtcttcttttgagaaatgtctgttcatatcctttgcccactttttgatggggttgtttgcttttttcttgtaaatttgtttgagttcctggtagattctggatattagccctttgtcagatggatagactgcaaaaattttctcccattctgtaggttgcctgttcactctgatggtagtttcttttgccatgcagaagctgtttagtttaattagatccaatttgtcagttttggcttttgttgccattgcttttggtgttttagtcatgaagtctttgcccatgcctatgtcctgaattgtattgccctggttttcttctaggatttttatggttttaggtcttacatttaagtctttaatccatcttgaattaatttttgtataaggtgtagggaaagggtccagtttcagttttctgcgtatggctagccggttttcccaacgttatttattaaatagggaatcctttccccattgcttgtttttgtcaggtttgtcaaagatcagacggttgtagatgtgtggtgttatttctgaggcctctgttctgttccattggtctgtatatctgctttgataccagtaccgtgctgttttggttactgtagccttgtagtacagtttgaagtcaggtagcgtgatgctttgttctttttgcttaggattgtcttggctatatgggctcttttttggttctatatgaaatttaaagtagttttttcatagacatctatagaactctccaccccaaatcaacagaatatacattcttctcagtatcgcatcgcacttattctaaaatgaccacataattagaagtaaaacactcctcagcaaatgcaaaaaacagaaatcctaacagtctgtcagaccccagtgcaatcaaattagaactcaggattaagaaacttactgaaaaccacacaactgcatggaaactgaacaacctgctcctgaatgactactgggtaaataacaaaattaaggcagaaataaataggttctttgaaagaaatgagaacaaagacacaatataccagaatctctgggacacagctaaagcagtgtttagagggaaattgatagcactaaatgcccacaggagaaagcgggacagatctaaaatcgacaccctaatatcacaattaaaagaactagagaaacaagagcaaacaaattcaaaagctagcagaagacaagaaataactaagatcagagcagaactgaaggagatagagacacaaaaaacccttcaaaaaatcaatgaacccaggagctgttttttttttttttttgaaaagattaatgaaatagactgctagccaaactaataaaggagaaaagagagaagaatcaaatagacaatagacacaataaaaagtgataaaggggatatcaccactgatcccacagaaatacaaactaccatcagagaatactataaacacctctacgcaaataaactagaaaattgggaagaaatggatacattcctgaacgcatacaccctcccaagactaaaccaggaagaagttgaatccctgaatagaccaatagcaagttctgaaattgaggcagtaattagtagcctaccaaccaaaaaaagcccaggaccagacagattcacagccgaagtctaccagaggtacaaagaggagctagtaccattccttctgaaactattccaaacaatagaaaaagaaggactcctccctaactcattttatgaggccagcatcatcctgataccaaaacctggcagagacacaacataaaaaaggaaattcaggccaatatccctgatgaacattgatgtgaaaatcctcaataaaatactggcagcacatcaaaaagcttacctgccatgatcaagttggcttcatccctgggatgcaaggctggttcaacatacgcaaatcaataaacgtaatcaatcacatacacagaaccaatgacaaaaaccacatgattatctcaatagatgcagaaaaggccttcgataaaattcaacaccccttcaatgctaagaactctcaataaactaggtattgatgaaacatatctcaaaataataagagttatttatgacaaacccacagccagtatcatactgaatgggcaaaagctggaagcattccctttgaaaaccgccacaaggatgacttctctcaccactcctattcaacatactattggaagttctggccagggcaagcaggcaagacaaataaataaagggtattcaaataggaagagaggaagtcaaattgtctctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataatagacaaacagccaaatcatgagtgaactcccattcacaagtgctacaaagaataaaatacctaggaatccaacttacaagggatgtgaaggacctcttcaaggagaactacagaccactgctcaaggtaataagagaggacacaaacaaatggaaaaacattccatgctcatggataggaagaatcaatattatgaaaatggccatactgcccaaaacaatttatagattcaatgccatccccatcaagctaccactgacttccttcacagaattagaaaaaaactactttaaatttcatatggaactgaaaaaagagccggtatagccaagacgatcctaagcaaaaagaaaaaagctggaagcatcatgctacctgacttcaaactatactacaaggctacagtaacaaaaacagcatggtatagtataagtgcttttttttaaaagacaaagtaaagtaatttttttgttgttggggtaaaacaaaagctctgcataaagagcagggatgttgtaacatacactgaccaaaggtgggaaacctacagttggagcagaagctgaatgtcacattatcagctccgaacttataatggtctaaaagtactaggttaatgttggaaagatggtgccatttaaagatatcttaaattcaatatttaattattttaatttgacattatcctagagttgaatggtgtttacttaccatgtgctgttcattagaaaatctagatcctacactgcctttgcgcaaggtagttgctctaataataccaacctgtccagttttggtgggagaaataatgttactgttaagttgcacttagtggttattatgtgtaatactggtattccaaagagagaaggaaaatgtttgctacacagctgtgttcttaggttcagaaaaccacaggagtgggacaggagaaccttcaggattcaggtccgattgttgtgatggccgcaggagggagactgtgaatttgaaactgcatccattgaaaagaaaatccctccacactttaataattctctccgtgccccatggcagcaagtgcttataggccttgctactcaaagcttaataaaaaggcagacctgctgaatcataatctgcatcttaacaatatccccagatattgtctgcactttctttttttttttctttctttctttcttcttttttttgagacagagtctcgctcagtcacccaggctggagtgcagtggcgcgatctcggctcactgcaagctctgactcccgggttcacgccattctcctgccttagactcccgagtagctggcactacaggcgcccgccactacgcccggctaatttttttgtatttttagtagagatggggtttcaccgtgttagccaggatggtctcgatctcctgacctcgtgatccgccgcccatctgggcctcccaaagtgctgggattacaggcgtgagccactgcgcccggccaattgtctgcactttcaagtctaagaagcactgtcccaggaggaaaatctttttagtctgtctgaggcttctctcttgcactctcctttttaaaaatatgctgctccttctccacctttccctcttcttccgccttttctgtctgcctttactacctcccctgaacattcaacttgtagaagagttcccctttctctgaattgcattcttcacttcattcattcttttctctctctgtctatggtttcctattttttgtcggttttccctcacctcacctccttgttattttttgccattgttcacatatcactgccctttcagacccatatctagcttctgacccatccactaatccattgccactaatttattcagcatgcccatgccatttattaatgtaaatatttgcacatacttgttctatcatgcccatttttctaccttttaaattgtatatacacagacacatgtgaatgacatatttcactatttaaaaggtagaaaaatgtatatcgtggtacaaagtgatacattgagtatctgtgcccagtttcaagatgagaataagtgagaggtgaagcctcatgagtcacgtcacctacacgctactgtctttcattccatctgcagtactgccacacatttggttagttctccaattgctgtcacattgacatcgagttggatctgaacagcgtacctggggagacgaagtattggtatctttgcttaaatggagtgatttactgagagacaaagtgacatctttaagatcagatagcaagttactgcaccaggagcgcgacctttcctgttttgttgttttccctctgtcaaatgccttctggtctccatgaatctctccttccacatatgataaaaatgcaaagtctcataagcattcacagctcaggaagcctcaggctagttggggagaaaagactgggaggtttccggaggaatgaagtcctctgagcagagaggttaattcatcttgctgtaaaacaaaatagaaaataagttcccctcaataagtgaacgtaatacaaagacaaatgtggttggtgccagaggccaggaagaagttcttgtgagaataggtgcagagaagagctaggccctggctgagtttaaaccttgacttagtcactgtgggactctgggtgagttactccatggattgatggctgggtcatggagataatagtacctaattcatacaggtactgtgagaagtaaatggaatatttcacgttaagtgtttaacggtgcgtttaaatgctaggtgctattattattaatttttaaattaactttgccatgttttgtgtcttcccctctctgtgcttcctttctttagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtgtgtgtgagcgtgcgtttgtgtttggtagtgttcctagggcagaggtggagcagggatgcacttatcatgggaagggaggtagaaaagagaattggatagcctgtgatctttggtggaatttattccttttgcctaggcctttcagaccctgcttgatttccgtaggacacttcaggttgtggcaagggagagctggtctgcaatcggaagtaccagcctcttccctagagcacaactagaaagaagaactatagagtgttataagggaggccctgagatggaaggaccatcacacagaaatgataatatcttcatttcagggtgttccaggggaaaagcaggagaaagatttggggctcagtagaaggaaaagcttcctagtggtaagagtgattggcaataccatgaggtacctttaaaagatagtgaactcctgtccttggaaatattaaaccacaggctagatatcatttaatagggatgtgaagtagagtaagtcactgcccttggtgtgcaattgtgaacttgtcaatttctgaggtccctttctacttagatatataatacaagatttctattaggtatgggtgctctgatgataatgaaaatcccagcagctatgtatgggatggttacaccagacactgtgctaaggattttctttgaattgtttctcactcaatcttcacggtagctcagtgaggtaggtaccattatcactgctagaaagcagtgaacttatatggtcttactgtggcactgggtccttaaacattatgcaaaactgtgagcaacttttatcggtttgttcttttaagaacataacacagcactctaaaaatagatctaactagattgttcacatctagcgattaaggccaccctgagattatagctgcatcatcaggaacccaagatctgaagcattcagtcaaagcctcttggccacctctctttttgtcatggccttcttggacttggagggggagaatggaagcaagtaccaaggagaaagtgttctcagaaaagccacacccattagaaaaatacaaggcctgaaaggtgtgagtgggacttgacacggaagagcatttcaagcttaagaaaaaaaaaaaaaagaagaatgtgggaggatgtcagcaacaatgcttgagattccctggtcccccaaagagtctctcctccataaaactaatgagaatgtgacaaaaatagattcaacttcttatagctctggaaattaactgaagatgtatagcaatttgcagagcatttattcaagaaaaagactaaatctctgtgagcactgtgatattgtaacttgcactactctcatctccccctctccagctccacaatagctttgaaaccaacagcctgcaattaccatgaaaatcagcagtctggcagccactgaaggtgacagaatggagttggagttctttcaaagtcccattcctagacaattgtcactatttgacctgtttggcaggccctggaagctccacttgcaaggctatatttgacctgactggaagcttcccagggtaaaaaactttgtcaaaacaactagaggcaattgattctctttgtggctgcctggggtaatgtataacagttggggaaagcaattggctaaataaaaagcctaaaaggagaagctggaaaaagagattttcatagggactttgaaaagctccaaagtgttattggcaatctagactgccaaatgcataaataggactccatccatgcccaggactgtgcagatgctcaggaaaaacccaagaaagccttaagctctcacttcaagctgatcttgaggctctgcacaagccataagtaaagggaatgcagagttgtcaattgcatggcggagtgttgagtgtgcctcagcattcacacagagctccttggcagagactggttgaattattgattccaagtgtttgaggaaatccgtgtacaactattagatgactactaaccaagcagagacttcagtgtccacacacaacaaaaaatacagactttacagaattagttcagaaaagtcattaaacaaagaaacaacaacaaaccctggggaaatgacagtacgatcaaaccatgcatggccctgcctgcatgtgggaatcctcatccaagtcatactttctaaacatcataaaaagcccaaaccagtctcctttcctggctctctcaagtcattttcagaccaggttaggagacgtgagctgctctccacaaaaagcctcatgtgagtaataaatgtttcatactctcttggggtgtgtgtaacatcatcagtctcagcatctaaaccaaattttggtgacatttcatcttgtttatgcagatgtccaccacacctataaataaacaaactactgaaactgattcaagaaaaaataaaaatctgaatagagctatcacaagtaaagagattaaataagcaatcaaataacttcccagaaagaaaagcccaatttaggatgtcttaactgattaatgttagcaaatatttaaagaagaattggtacaaattcttcacaaactcttccagaaatggaagaggaggaaacactttccaccttattttctataactagtattaccttgataccaaattctgacaaatacatcaaaaataaaaccatagaccaatatctcttttaagtgtaaatgcaaaaaaattcaacaaaatgctagataactgggtccaacaacatatggaaaggattatataccttgaccaagtgggatttgccccaggaatgcaagattgatttaaccatcagtgtaatgcatcatattaatagaataaagacagaaaccacacaatcatctcgatacacgcagaaaaatcatttggcaaaattcaacacccctttgtaataaaatcactcaacacactaggaagagaagggaacttcttcaacctcacacatggcatctatgaaaaacccacagctggccgggtatggtggctcaagcctgtaatcccagcactttgggaggctgagccaggcggatcacctgaggtcaggagttcgagaccaacctgaccaacatggagaaaccctgtatctactaaaaatacaaaaaattagcccggcgtggtggcaaatgcctgtaatcccagctgcttgggaggctgaggcaggagaatcggttgaacccaggaggtggaggttctggtgagccgagatcacgccattgtactccagcctgggcaacaagaacaaaactctgtctcaaaaaaaaaaaaaaaaagaaaagaaaaacccacagctaacatcatacttaaaggtgaaagactgaaagctttcccccaagaggaactaacaggatatctgctgtcactatttttattcaatattatactggaggttctacctagggtaattaggcaaaaaaaaaaaaaaaaaaaaaaaaaaaaaaaaaaaaaaaaaaaaaaaaaagaaaagaaaaaagtcatccagattggaaaagaaataaaatgatttcaattttaagatgacataatattgtatgtagaaatcctaaggaatttacaaaagaactattagagctaatacatgatttcagcaaggttgcaggatacaagatcaacatacagatataaattgtattctacacacttgtaatgaaaaatctgaaaataaaattaagaaaatagcaccctttgaatagtatcaaaaagaataaaatacatagaaaaaatgtaacaggaagtgcaagactggtacattgaaaacaataaaacattgttaaaaaatttaaaatcatcaaaatagatggaaataaaacctgtgttcatggatgaaaaaaattaacattgctctacagattcaatacaattcttatcaaaatcccaggtggcttaagaaattgacaagttaatcctaaaattcataagaaattgaaagggatccacaatagccaaaataatcttaaaaaagattttaaaaagttggagaactcacacttcctggtttcataacatacaccaggctgggcatggtggttcatgcccataatcccagcactttgggaagttgaggcagaaggatcacttgagcacaggagtttgagaccagcctggacgatatagtgagaccttgtctctactaaaaatttaaaaaggaattagccaggtgtggtaacatgcacctgttgtcccagctacttaggaggctgaggcatgaggatcacttgagcccagaagattgtaccactgcactccagcctacatgacagagtaagtctctgtctcaaaaacaaaacaaacaacaaaaatactgaaagctttccccatacaggaactaacaggatatctgctgtcactatttttattcaatattgttctggaggttctagctagggcaattaggcaaaaaaaggaaaaagaagtcatccagattagaaaagaaataaaataatttcaattttcagatgacataatattgtatgtagaaatcctaaggaatttacaaaagaactgctaccctgaaagaattgttgtaaggcaaatacccctgtaattaccattaggggaagaaatttttccatgcttcacagaaactctccttataccccacctcaattttaatctttttctgtaccactacagttataattctcctaaagcttaaagcaattacctccttgtttatatttatagtttcatcactgaagtgtgcattcctaaactcaacaccttagtctggttgcaaacagtttaaatgagaaaagataaggcctgaattaaggcagcagccctaaacctttttctataatcctgatagtgattaccacctaggggattataaatgtttgcttcttcctctggcaccaacaagtttactgagcagaagtttaaaataattggataatggggcaggtgacatcagcaagatgttgtattagcaaatgctggacccttcttcaatccacaaacacatctattctgcaaaaattcatggctaaattcctttgtgaggaatccagaaactaaaaggctcctgcactcccagcaaatgcaaaaaccagactcaccaaagctggtagagagatttgagataccaccttgtccgaatccctaaccccagcacagtgccatgtagtcagcaagagactccctagcactcagtttctcccaggtgagaggagttggttcacatatccaagacctccaacttttctgaggagattcccagaggactggcttctatcttgtcagtcttggagctctgacagaattggtactatctagctacctggggaaggacagagacagaggtttagaccagtagatgacatggcaccctgccctctactgcctcacctcctggctcagcacagacaggacaaaaatcatggctacctacatttccctggagaaggaatgatttgttaaaggcccccaaatcactgggcagacttattggtgggggtcttctcctctgaggcccagctgtgaggactgggacaggtgactgctttgtctaatgtgcagacaccaacacaaagagtcaaggaaaatgaataatcatacgaagatgttccaaaccaaagaacaagataaatctctggaaactgagctaatgaaataaacttatgtgatttacctgacagagaattcagaatagctctcataaagattctcaccagagtcaagagaacaatgcatgaaaaaagttaagaattttgacaaagagatagagtatatttaaaagtaccaaaaagaaatggaactgaagaacacaacaactgaactgaaaaaatttatgacaggacatcaacaggagacaagattaatcagaagaaagaatcaatgaacttgaagacaggtcattggaaataattcagttagaggagaaattaaaatgaaaaagagtgaaaaaaagcccaagggtcttatgggcaacatcaagctgaacaatatactcattattggcatcacagaataaaagagagaaaagaactgagaacgtattcaaagaaataatggctgaacacttcccaaatatgaggaagaaaatgaacattctgatccaagaagcccaaaggtcataaaaaagtgatcccaaagcctacaggcatattataagttgtcatcctagagaaagaaaaatatctttctcccagcctccatattcaaatcttaaggaaaattcttatggacttagcttgagtttcaagttcatttctaaaatcaatcatggtggccaaacggaatgagcattctgatttgccagtgtggtctcatgttacccctgtgcctagaaaggaaacaggagatgaaaagcatggtgataagaagactggatggcaccacatgggatagggggaaagtagttgaaaaaaaatagttgtaaggaaaagagatacaaggagtcaaaaataacaaatatctacttaaaagccttttccacatttaatgttttttgttcactgtggtgtagtaataaatgtctatacttaaggggtgaggattgatatatttaaagtgaatggtctggaaggcaaggaagctcattccaacagattcatgctacattgtttagtgacaaataaggggaacagaacagagaaagtgatttcagctataaatataggagataataaaatcctttagtaaacagtatctaagccttgtttttatgatattggggaacagtaacagatcaaagtactgtagtcttcagtatgcagacctttcactttcttagtttattccagggtcttttttttttttgctgctattacaaatagcattgttttcctaatttttgtttaagatagttcatcgttggtatagaaatgccattgatttttgtatgttgattttgtatcctccaactttactgaatttattagttctaacagttttttgatggagtctttagggttttctatgtataagattatgtcatctgcaaacagcaacaattttaccctttgttttcaacgtgagcgtcttttatttatttttcttgcctaattgctttagctaggacttccagcactaaattgaatagaagtgatgagagtgggcatgtatgccttgtttctggtcttaaagaaaaacatttcagttttccattattcggtataatgttagttatgggtttttaaaaatatatatgacctttattaggttgaggtacttttcctctattcttagtttattgaatgtttttctcatgaaagtgtgttaaattttgtcaaaaccttttttacatccatcaaatgattatgtaatttttatcctttattctgttaatggattatcacattaactaattttcatatcttgaagcatacttgcatcctaggaataaatcccactttgtcatagtctttgatccttttaatataatgttaaatttggtttgccagtattttgttgaggatttttgcatctatatattcatcaaggatattgggctgtaattttcttttcttgtggtgtctttgtccggctttagtataaaggtaattctggcttcataaaataagttagaaagtgttctctcttctttgatttttttggaagagtttgagaataattggcattagttttgttaaatgtttggttgaattcactagtgaaattatttggtcctgggattttctttactgggagttttttgattacttgttcaatctttacgctagtcataggtctgtccagtctttgtatttcttcatgatttagtcatcatgtattcatgggttgtaagacttaatattcttaaaatgcccatattacccaaagtgatctatagattcatgcaatccccatcaaaaatcccagtggcatttttatttacagaaatagaataattctaaaattcatctgaagccacaaaagacaatgaataaacaaatcaatcttgaaaaagaagaacaaagctggaggcattatacttcctgatttcaaaatatcctgcaaaggtacagtaatcaaaacagtatgttaccagcataaagacaaacacacagaccaatagaacagaatagagagctcagcaacaaatccgtgaatatacagtcaactgacatttggcaatggtgccaagcatactcagtgggagaaatgataatctcttcaacaaatggtgttgggaaaactgaatatccacatgcaaaagaataaaattggaccctatcttataccaaaaatcaactcaaaatggattatttaaatgtaagacttgaaacagtaaaactcctagaagtaaacagaagagaaagtttcatgacattgcccttggcaatgatttcatgtacataacaacaaaagcacaggtaataaaaacaaaaatagacaaatgggactacctcaaattaaaatgtttctgcacagcaaacgaccaactgaatgaaaaggcaatctatggaacagaagacacggggtgacatgagaccactttggcaaatcagaatgctcattccatttggccaccatgattggttttagaaatggacttgaagctcaaagaaagcccataatatattccttaagatttgaatatagaggctggaagaaagatttttttctttctctaggatgacaagttatatataataagcctgtaggccaatatctgctggcagccacctttcccaggtatatggatgaaactatctgaaggatgaagcctccattcacagaaaatcagagctgtaaagggaagaggatatcctgatgaatttttttcttggattgagccatgtctgaagtcaagccaacttttgaagtatcctatagtacttatatattgcttggtaacaaattatgccaaaatttagtagcttaaaacaacaaacatctattatctcatgcatttctgatatagatataggagtgactaatctgggtggttctgggtcagaatctctggtgagtgtgtaggcaaggtgtcagtagggggctgcaattatctaaaggcttgcctggggctggagacgcactttcaatgtggtgtactcacgtggctgttggttggaggccaaatgtgctaggcaaagcctcatgcacatttctctgtaaggaaacaaagctggcttacttgggggcaggatttttttttttcccagttgttcttcaaaatgaagtttcccgctccaagtcccagccagatatgtgaaaaacaatccttgcagaacaaccctattagcagttctgcaaggatttttaggaaccgtattagcaagttcctcagttcctcaccatgtgaacctctcttcacgacttagtaactggcttcctctagagtgactaatccaagagacagcaaggattgacagccatgacagcacagtgcctttcatgacttactctccaaagttacaaacctttacttttgctttatcttatttgttagagcaagtcactaaatttgcccacatctaagatgagggtatttgggcttcacctcttgaatggagaagcacccaaaaatctgtggcctttttttttaattacactctcagttacatgaatcaataaattccatttttggcttagcttctattgggtttctatcacttgcaaccaaagtgccctaaccagtatctacatctgagtcattaagaaagtttcagacagggctgggcgcggtggctcacacctgttaatcccagactttgggaggccgaggcaggcggatcacgtggtcaggagatcgagaccatcctggctaacacggtgaaaccttatctctactaaaaatacaaaaaattagccgggtgtggtggcaggtgcctgaagtcccagctactcgggaggctgaggcaggggaatggcgtgaacccgggagacggagcttgcagtgagccgagatcacgccactgcgctccagcctgggcgacagagtgagactcagcttcaaaaaaaaaaaaaaaaaagaaagtttcagatattattgtttattgcttttaatctagtgaattcataaatcgtcacttaactcaagcaaaacaatgttactctctttgtacattgtacagatgcaggataacaatgcagtgttatcctgcatctgtacaatcaagcacccaaactggttctgtagaggcaggaccttagcatatagcagagataacttatcttccagcagatccggagctccattttgtagacagaaatgaatgctctgtgccacagaaggagctgttgcactattcattcccgtttcctcccattcactctccacatctccaatcctggcattgtctgctttgttacttgttaaaaacttgatttcgtagattgctttaaaataagaacaaaatgtactttgacacacatcattttgtttggttctcattaattttgagagaaaggcaagatagatatttaaatgacccctattttagtggtaaacaagctgaaattagataaataaaatgatttgcctaatgcctcatgagtgatttgctttcttttaaatactttaggagaatgtttggggattaagtctcaagataataagggcaagtcagaaaatacaacttacctgtcttttcttttcaaaacttttttgagagaaggatataatgcgtggagttcagaaaacccataatttgtatagcattgatgtagcccattcacaatctaggatttttgatatacgtgagcagtcatggtggagtgggtcagaccaggcatggctcagcttcgtacttcaggccacactgttcaatctgttcacttgatccacatgctaggatgtgagaatttttctcttacatcctttcgctggagccattttggctgtgcttatggtagtgacagagtttcaaagaagaagagcccataatgtctcccaggcatactacaaaggaaatataagtcatcaaatagttgaatctggatctgggccaggataactcgactcttcttatagaaggtgccatgggatctatagtgatggcaggtgatggaagaagtgggtcccctcagctttatgtcttgtctgaaagatgataaccatgctaataaatttagtgccacattctttacagtgtgctcatccgacccctagaacaaggccataaaccataatggagtccatgatgctttcaattattagacattcatttctgcttttcactttctttctcttctgccaaaatttggctttattgattacactttatggaaggatggaagagggcaggggtagaaaaaaggcccactttttagaaatctgagaagaattatatgtctgtcaaaataaaatcccggctctctaatggaggaatacaaaacatttttgctattgtatctaccataaatacacagatataatgagcagagcctggttgggggcattcttgagtcttttcagagccacaggttattttatgttaacaccctcattaagaaaatcattaagtttttcttttagtagttagtagtgaggatatgtacaaccccacttctggcttttttttgagagcaggaaggcatacagaaaagtttatggaatgtggcattgagctccagagagaggctctgtttgtcaaggaaaaagggaacagaatagaggtgggtgttaaagaatattttatttggatttcttgccctgatacttgacaccgaaaacttgccgttccagttgttggaaggaagactggaagagctattttattccctgctggtctattcttttgtattttattaaacattttaactagtcacctcctttccagacacactgttaacaattgaatgccacatccataccaaattctcacccatgactcaagggaagctggacactattctcaaaatagaagtaacgagccattagtggtgatgaaatactagatggaaaaatctcaattccaactccctccaggaactgaagactctaaaatattcttctaccctgaaacctgtcttgcaatcaaattaagatctcctcactaatttttacctctcacctgagattccttgtatttgtgaatgaaagtctttcatcagcaataaagggtatgcttagtgaataatgaattaagattgtggaagagaatcatgtcttttggagaagacgatcagtctaggatgatgcaaaatctcttggtgatttttctttttttaacttttggctggcagtgaaagttttccctgaaagattaaggtaggtgaaaataggtgaggagaggaaaaggctgaggtagtaagtaaagagacaattttgatttgttttgtaagtttccagaaggtccctaggcaagtagagaaccaaaatcagtagaaggaaattgcaatggaagggaaatatacaagtgggactgagcagcatagcaatttgtgaagccctttaatagaaaccttatccactatattggagaatgagtgaaccatgtcagtagtcaaagaatgctgccaagagctctatgtgatattctaaatacagaatccatattgccattgtctgcattcctttctagactttttggagtgaggaattagtgagcgttgtaatgaggaagtactgagtaattggaaaatattgttaattgtggcgcttccttctttgattgctgtctctgaaacagtctgaaaaaataatcctatcctgcgtttttgcgatttgttcattataacaaatgaagtcagagccatgtgcgctgtttctggttgtggatattaagaaaggcctttaaattgaatcatgtctatatttttgttcgtttgtttgttttgagacagagtcttgctctgtcacccaggctggagtgcaatggcgcgatctcggctcactgcaaactctgcctcccaggttcaagtgattctcctgcctcagcctcccaagtagctgggattacaggtgcctcccatggtgcccagttaatttttgtatttttagcagagatggggtttcaccatgttggccagtttggtctcgaactcctgacctcaggtgatccgcccatcttggccttccaaagggccaggactacaggtgtgagccaccgtgcccagccatgtatacaatttatacagacattaagcaaattcctagtcgaagagcacaattgaccttgctttcaaagcttccattagaaaaaaatgtatggtaagacaaatctatgtttttataaccaaaatgggagaaaggaagcacacaagttttcaactacgtatttggtgactcagtctcacattgtgatttgggcaaaaacagagtcaaataatctaacacggatgtgtctcctcaactaagttagctttgcaaaccagaaagttctagctttgggggatgggcctatacaggaggggtcagtggacggggccatgtgacgacaacatggccgtggctttgggttcttgaagcactcacagatgaccaaagaggcacaggaacaaactcatcagtacatttttatgtgatcctgtagagcttgtttctttttgagagtgtcgggaggtttggctgattcacccaatatgcctcaagtgggagctgaaaaagccatgttctctagacaccaaaaatgagagtggatgaattcagcaattggtaggtaacatgatctgccttttgtagcaagccagaagccagatgtcccctcccctttgatctgaataacactttaggctgcagacaataagattggttttaaatttattgtctctttgatttctgcattctaatgctttttaaattctttacacaagacagggctatatataggcaactgggatggttcaatggaagccaaaaaaataccagtagcttatgagaagtgctaggcaaagtctcatgcacatttctctgtaaggaaacaaagttggcttacttgggggcaggattttttttttccagttcttcaaaatgaagtttcccgctccaagtcccagccagatatgtgaaaaaaaatcctcgcagaacaaccctattagcaaagcagtaaagcagaagaatctgatttaaatgaaatacaccaaatcagaatgtcttccttctctaagtcctctatgactttcatcccagttaaagttttattcctgtccttgttgatgcagcctgtgtcgggcaatcagatgacgaggccaagagtttgatttcattcattctgttgatggtgaagatgcaaatatctgaacccaatctcatcccattgacagaaggtaaatggcatttggaaatctcctttttttgtctgcaacagagtcttactctgtcacccagtctagagtgcaatggtgtgatctcagctcacggcaacctcaatctccagggttcaagcaattctcctgcctgagcctcctgagtagctgggattacaggtgcacaccactacgcccagctaatttgtgtatttttagtagagatgggggtttcaccatgttggctaggctggtctcgaactcttggcctcaagcgatccacttgcctcgctctcccaaagtgctgggattaagggtatgagccactgtgccagtctcctttaattaatcttcagtgaatactactgatgaggcattcaactgaatctgtaaaaacatttggccacgattttgccctcaagtggatcaaaccacggacaattgccccaagatgtgagcctgctctagagaacaccagttccgtagcaggagaaagggttcaagtctcaatacatcatgttttcactgcagctatgtgaccttgagtaaatcatggcttctcttcatctattttctcttctggaagagtaggtaaactcagattggcctaacattctattaaattaaaaagtccttctacaaacagaatgttattggagccaaataaccgcactgtaagggagccagggcagcactgtccttcatactttaggatgaagaagccgagcccaaggggtccacgagtactggaaagccttgtgactggttggagacaaaggcaatactgtgactcagatctcctgacatcttctatctctctctctctctcttttttttttgagacgtagttttgttcttctcacccaggctggagtgcagtggcgcgatctcagctcactgcaaactccacttcctgggttcaggagattctcctgcctcagcctcccgagtagctgggattacaggcgcttgtcaccacacctggctaatttttgtatttttagttgtatagttagggtttcaccatgtcggccaggctggtctcgaactcctgacctcaggtgatccgcccatcttggcctcccaaagtgttgggattacaggcgtgagccactgtgccccgcctcttccctccttctgtccacttagtaagactcactctacactctgcctctccacctgtgtactatgaggaccagaggttttgtctgtaagaagcgtttgcaaacacatgctgccattacagcacaattctgattcttctcctcaggaatcccctatgaacttctagtggaaagacaagccatgaaagcagtcattgaggtgaggactgaaaaaacaaacagcaaaggctgattttatttttttctgtgccagtggtgcagctcacctttgcagcatgaaagcagagttcggtgtgcccctttgtgtcaacacatctatcagattttccagtcagttttcaatcaattccttggatatcaggtattaggccataaagcatttctttccactttatggttctaaaatataaactatggccacagctgaagcttttaagtctgatggggatggctcccaagagaggctcttcagaagcctaaataatagtctgaagtgggtataaatttgggaggaaacacagaccctcactgcactgacactcaagtctccctaggatattttcttagtgctcacaaaggactcccctagaggttttgaagaaatatgaagaaactataagacccaatctgtatacccaagggtattacagacaatatggtagcaaaagcacttaaaaaagatctgtgaagtcagcacctgcaacaatctatctgaacaactctacatggagatatactcacacacagtggtggaagtgcagatgtggctggatttgctcatgttttgaatagaggtctcttaaaatgactgtttcaaggtgtcctttcagacctgggggttacctgcttcttctctatatttttctgcttttcagaaaaattcatcctatctgaatgaagactttcaatatgtggaatgaatgccatacaggttctgactacatgatcaaaattacttatgtaactttgggcctgagaaagaattgtacaggggactacaggattttatcctaaaggaccagaatccctctttttattcacttcctgagaatgagcatgatttcttagttcaaatacacaggctgtcccgctgactcccaatcacccagatggaaatgagtggtgtcagtgctgtgtgcaggaagcaggatgttactttagactctgtgtgcaggagagatggccgtagtaacaaatttatgtgggtctggcctttcaatcctggaattcaaatgcgcatgaggttgcaaaggggcctggaaattcaattgccatcccttgacctagcccaaagcaaaacatgaagaaggtaaccaggagacaccactgtaaattgaaatcatctggtgtacatagcatagggatatataaacatgaagtttaaagcatatagaattctccagtgccactatcttatagggtatgacatttgttctttctaaagtgctactgatataatttgattcttataactttgtgaagtagggaggtgaatgtacatttggcagattgagaaaccaagattctaaaaggtcaagcgacttgcctaaagtcataaatgagagctatgacagtaccccaaccttccaatgccctaggatctttttctttctttccttccttcattccttccctccttcctctctttctttcttttttctctctctctctccttccttccttcattccttcctttcttccttcttttttttccccgcataatttgatctgcattagcctccaaaactccttggattggaataaaatatggctcctgtattttgttttgttttggtcctttaaaaaatgtcctttctttatcatgctttatcatatatatacagaaaaagacacaaaatgaagcagagcttattgaattattttcaaagacttttgtaacatcgccagcacggtggaggtcctttgagtgtactgagccaggagggcttcatggacatgagacaggatcctgtgcttagcagacctcacaccttggttagtgttctactgaaactgttttaaaattcctaataatttatgaacaaggaatcttatatattcattttgcactgggcctgtccaattatgtacccagtcatgctcctacccaatcacatctccttctccctcacaaatacccattatcctaactttcacgggtcccttttttgctcttctgtattgttttatcacctcggtatgcatatctgcacattatagtttacctgtcagaattttctgtaaatggaattgcatggcatattatcttgtgtgtcaaccttgttggtgagattcaaccatttgttatttgcacttgtctcattcctgtataacattttcatctgtgagtatatcataattttaaaaatatattctatttttgatggaaatttgagagatttctagttttggctattatgaataaggttgttataaaaattgttgtatgtgtatctccgcaccaaagtgcatctgctcccattgagcattttacctgtgagtggaattttgctaggttataaggtgtgtgtttgctcagctttatggataatgccaagtgttttccaaagtcattgtctcaatttacactccctccaacagcatcagaggattttcttgtgccacattttcaccaacgctggatgttgttggttctttcaatttcaaccattccagtgggtgtgtattaaatcacactaataatctcattgtgatttttttttttttttttttggagacggagtctctgtcgcctaggctggagtgcaatggcacaatctcagcgcactgcaacctccgcctcctggattcaagcaattcttccgcctcagcctcccgagtagctgggattacaggtacccgccatcgtgcctggctaatctcattgtgatttttatatggtcttccctgatcagtaatgaggttgagtatctttccaaaaatttattggccatttggctatctccttttgtgtagtttcttgctgattcttttattagttggggtcttttcttattaatttatgagttctttatacattctgatgacagttctttatcagaaccatgtagcaaatagcttctcccagtctttaccttaataggagagaagttcttacttttaatgtagtaaaatttatccaattttatggttggtaactttttgtgtcctaattaaaaatattttcctttcacaaatcatgaatacagtctttaaaaaacttgattcctttgctttcacatgtagacctacaaagcacctggaaactgatacttgcacgtacatattagctagaggtcaagttttttcttatataaatgtaccattatcccagaactattcattgcaacagcttttctgcatttctctagagtggcatttgtgtaatagatcgtatagttatatataggtctgtttggggagtctttattgtattctatttgtctatccttgtaccaaattcacactgttatagtagttatatagtttcaaaaaaatcatgatatctggtagaacacatttctgacaaacttgttctcttcttcaagatcatcttggctactcttgacactttgcaattacattcagatattagaatcagcttgtcaagttttacaatgatatttgctgggattttaatatgcaactgcatcgaatctatttattagttggggggcgaattaacatcctgaaatggactgaatgtttatggccccccaaaattcacatgctgaaattctaatccccaatatgatggttttagaaggtgatttgggagggaattaggtcatgagaatgaagccctcatcaatggggtaagtgcctttataaaagatacatcagatagctctttcaccgtactttcaccatctgagaatatgagaagtcagttgtctgcaccctgaaagagggtccttaccagaacctgactatgctggtcccctccctgatcttggacttccagactccagaaactgtgagaaataaatatttattgtttaagcctccccatctgatataatttggatatttgttccttccaaacatcatgttgaaatttgatccccaatgtaggaggtggggcctaatgggaggtgtttgggtcatgtggatggatccttcatgagtagattaatgccctccttctgggtgagttctcgctctaatagttcccacaagagctggttgttaaaaagatcctggcacctgccaggcgcagtggctcacgcctgtaatcccagcagtttaggaggctgaggcaggcggatcacgaggtcaggagttcaagaccagcctgaccaatatggtgaaacctagtctctactaaaaaatacaaaaattagccgggcgtggtggcacccgcctgtagtcccagcccaggagggagactgaggcaggagaatcgctggaacccgggaggcagagttgcagtgagccgagatcacaccaccgcactccagcctgggagacagagtgagactctgtctcaaaaaaaaaaaaaaaaaaaaaaatcctggcaccttccccttctccctcttgcttccttcctctccccttcaccttccaccataagtggaaacagcctgaggctctcgccagatgcaggtgctggtgccatgcttcttgtacagcctgtagaacaatgagacaaataagcctttttaaaaaataaatcactcagcctcaggtattccattatagcaacacaaaagagactaagaaaccatttttggtaatttttttctttctttcttttttttggagacaggctctcactctgtcacccaggctggagtgcagtggtttgatcacggcttactgcaacctctgcctcctaggctcaagcgatcctctcacctcagcctcctgagtagctgggaccacaggtgcacaccaccatgcctagctaatttttgtattttttgtagagatggggtttcaccatgttgcccacactggtctcgaactcctgggctcaaacaatccacctgccatggcctcccaaagtgctgggattataggcatgagccaccacacccagcctatggtaatttcttatagtagcccaaattgactaagacacatcctacatactcaatgtataaatatgcttatatccctctatttgtttaggtttttaattgctcacaatagtgatttataattttctatgtagaagtcatgtgtatacttcatatgtgattccaaatggcacttaaacattttgtggttggttgttgagatatatatatgtgtgtgtgtttatatactatatagtttatcttatattcaaaacctctcttatgtgcttattaattctaacactttgtctatagattatttcaaattttgtgtgcatacaatattatctgtgaataagttttattttttcctttctaatttctacaactttaatcttttctcttagattattgcactgattaggatcttcattcaacataacagtgattagagataataatagcagcattcttctcttgttctcaatctcaaagagaagctttcagtatttcatcattcaacataatgctcaattaggttgttttatgaatacatatttatcagatgcatttattctagtttggtaaaagtatttttccattattaattcatgatgcattttatccgatgtttttggggagcatcaattgagatgataatttttcctctttactctgttaccatggtgaattaaattgcttgatttctcaatattaaacaaaaccattgagttcctggaattataaagccaatttaatcatggtatatcatctttttatatattagttgaacccaggttgctaatattttgtttaggatttttggatctaagcttatgactgagaatcacctgtaattttcctttgttatgtgcctttatcaaattttattatcaagattatttgatcatctttcttttttattctcgagaagagtttgtgtaagtttcatgtaatctcttccttaaatgattgatgaattttttaagtgaaagctttgggtttagtttgattatgtttaataattttagaaagattcagatattctatttttttgttagttttggtgaattgaatatttttagaagaatgtttcgatttcatctaaattttaaaatatgttgggttaaaggtttttaaaatcatctttttaatcttctacaggctctatagtgatgttccatgggtcccttctttcaccctgatttctttttttgtttgtttgtttgaaccattcccaccttcaccccctccccacctcctggccccacactacccttagagcctctggtaaccatccttctactctctatgtccaggagttcaactgatttcatttttagatcccacaaataagtgagaacatgtgatatttgtctttctgtgcctggcatatttcacttggaataatgatctccattccattcatgttgttgcaaatgactggatcttgtccttttgtatagctgaatagtattccatcatgtatatgtaccacattttctttatcccttcatctattgatagacaattaggttgtttctaaatcttagctattgtaaacagggctgacagtgctgcagcaaacactagagtgaagacaaaccttcaacaaaactggtttactttcttttcggtatatactcaacagtggggttgctgggtcatatagcagctcaatttttagttttttaaagaacttgcaaactgttctccacagtggttttactaatttacattcccaacaacagtgtacaagtgtttccttttctccacatcctcgccagcgtttgttattgcctgtcttttggatataagccattttaacttgggtgagataatagctcattgtagtttagatttgcatttctctgataatcagtgatgttgagcacctttttcatacgcctgtttgccatttgtatgtcttcctttgagaaatgtctgttcaatttgcccatttttggatcagattattatattttttcctatacagttgtttgagctcctcgtatattctggttattaatcccttgtcagagaagtagtttgcaaatattttctctcatcctgtgggttgtttcttcactttgttggttgtatcctttgctgggcagaagctttttaacttgatgtgattcacttacccatgtttgttttggttgcctgtgcttgtgggataattctcaagaagtctttgcccagaccaatgtcctgaagattttcccaaaagttttcttgtaatagtttcatggtatgaggccttagatttaaatctttcattaattttgatttgatttttgtatgtagtaggagatgggggtctagtttgcttcttttgcttacggatatccagtttttccagcaccatttattgaagagactatcttttccctagtgtatgatcctggcacctttgtcaaaaatgagttcactgtaggtgtgtggatttgtttctgggttctctattctgttccactgttcatgtgtctgtttatatgccagtaccatgctgttttggttactatagctctctagtataatttgaagtcaggtaatatattcctccagttttattctttttgcttaggatagctatggctattctgggtcttttgtggttttgtataaattttaggattgttttttctatttctctgaagaatgtcattggtattttgataggaatttcactgaatctgtagattgctttgggtagtctggacatttcaacaatattaattcttcccttttatgaacatgaaatatttttccattttttttggtgtcttctgttcctgctttctgatattcgttctcatgctctcatttgacttagtcttgccaacggtttaaaaactttattagactttaaaaaatcatcttttggtgttaattctgttttctactttaattatttcattcttccctttcttttgattctacatgttgttatttgtctaatttcttttttccccctaaggtagttttgttatagcatgcctaatttcttgagattaatattttgtcttgttttgtaattatacacttaagattataacttccctgctaaacactgattttgctctattacgcaagtttttccacgaaaaatattatctctcagctcaaaatatttttaaattttcattgcgatttctttttacccactggtcatttagaagaacgtttcttactgtttataaatgtagaaattttctagtttaaaaagctatttatctccattttaattgctttgctttcacagaacatattttatagtttcagttattttaaattcgttgagacttgccttacgatctaacacatagtcaatttttgtaaacatttgtatgtgcttaaagagttgttgagtgttgtgttctatatatgtagattaggtcgatttattaatcatggtgttcatgatcctacttccttctaatttctctccgtgtgacctgtcagttactcccacagtgttgggtggctttttctgtttctccttataattctatttttctattaaatattcagagactatgccattacataaataaaaaatgaaattgttttatcttccgagtaagtgaagccttttcttaatgtgaagtgttcctattaatgtaatgctttttttcttaaagtatactttagtgaatattaatgtagctatatcaatttagggcagggcttcaggtgacaaattttctcttttgtgtgtgtgtcatttgaacactgaataaatcatataattatcttctgaatttcatgctttcacttgagaaatcagctaatgatctagtttttgtaactttaaatggtatatttatacactttttatcctttcactctcaccctttctgaatctttgtatatcccatcagtagctgtaaagatttttggtcttcccaagaaatccattctcacagaatttgtcttttaattggggtatataatttatttacttttaacataattacaaatatgagtttaaatctaccatcctactataagttgagtttttcttatccaaaatacttgggactacaagtttttcagatttcaaatgtttttggattttggaatatttgcacatatataatgagatatcttggggatgagacccaagtctaaatgtgaaattcatttgttttatatataccttaaacacatagcctgaaggtaattgtatatattttaataattttgtgcatgaaacaaagtttatttacactgaaccatcagaaagcacaggtgccattatttcagccacctgtatggacaatctgtcattgtttggcatcaccatctttactgactgaatttatatgcaactgagaagcaatcattttcttacacttactcacacaagtacccaacagtaaaaactaggaggtaccatgaatccagtgaaaaaataatgttcagggtaactaagcagcacagtagcgtcaccagaatacctgtatcagtttttaaacaatagcaaccacaaagaacggcaagttttcaatctctacttttgatgtgtgtttcgatgaaaaggttactatacactgaattttacctttctagatgagaagaaacattagaagcagttgagagacgaggaagtgggtcctccaggaatgaggaggcattctgctgcatggctatttttaaatggctggagggtctgttttcccttggaaatcctgaataaactgaggttgtgcgtctgcattttgactacaacccatcacatgaggtggtgtggaattttccacatataacatcatatcagtgatcaaaagtttcagattttggagcatttcagattagggatgctcaacctgtataacaactctttgattttaatgtctttttttccctggatgcctttaagattttatttttgtttctgttttcctgaagtttaattaagatgcatctaggagtgaatttcttttcctttatactgcttgggtttccggcagcttcctgaatctgttggctgatgctttgctttagttttggaacattttgccatcaaccctgctaatatagctttactacttctgttctcactgtatcctctacatttcttaccttctgttcaatgtttcatctcttttgagtttcattttagattgtttcttcagacctgcttttcagtttaccaattctctattactttatttctaatttgctgtaacacctatcctgggcattttttttttttttttgagatggagtctcgctctgtcacccagtctggagcgcagtggcgcaatctcggctcactgcaagctctgcctcctgggttcatgccattctcctgcctcagcctccccaacagctgggattacagatgcctgccaacacgcccggctaatttttttgtatttttagtagagatggggtttcaccgtgttagccaggatggtctcgatctcctgacctcgtgatccgcccgcctcggcctcccaaagtgctggaattacaggcgtgagccaccgtgcctggcccatcctgggcattcttaattgggattactgcatttttttggttctagaatttttctttctcccaaatttgccctgtaatcttttcatggttttcagttctttgccaaaatttccaatcttttcattttttctccctgaacattgcaagctgatagcttcaatatgtcaagcctgtgcatgttttgttctattgagcatgtttcctactaattctcattcatgattgttgtttccttgtatgctggtttatccttgtgtgacagaaattttatttgaaaaattggtttgtttgtacagatgtaggatgacattatatacctccagaaaggattgtgctgctgttgttccaggcacttgagagcactagccatctggtatcgccttatttcaggactattgaaatttctgtctgataattgtttattgtggaagggatgtcctatgccttgtaggaagtttaggagtttccctggcctctccccactagatgctaacagcatcccttcccagtcctgactatcaaagatgtctctagacattgccaaatgtccctggtacttgagaaccactcccttaacccaaaacaaggtgattttatcaggtttaaacataatggtgcctgatctcacttttgtacctctaacacatcaaagtttcccagccgctcagtaatcttttttagaatccctgggtggaaagcaatgccaaatgtcatctttatctctttgatcttctctcaaatcttagttcagtaatttttactttgtaaagtctttcaagtaaatttttaaaaattgtctttcttgttgctctcagtgaggagacccatattacctaccatgcctcaacataggatgaatctacatacacacattactgctgcctggacaacaccctgccatatcctttgatttatctgcaaatgtggttatagggcttccgtatttactgtctgcttcccacatgggtcattatgctgcttggaataggctttctcttttttgccgttcttcaagagaaatgtctaaagagccagtcttcagctctaagtgtcaatggcctcttcccaaatagaatgtgtttagtgtaaatgcccattcgtttttattagtggtgtgtttcctctttggtatattgtaggtcttgaagacaggagctcatacggtgctttctacaatagctgcttacagagcttaaaaatcttctggtctaaacagatgtggaaattgaaatgcaaaaagtccaagtgaataaataaagtactgttgtgggctaactagaactgaaagaatatctcacccctagaggaacgggaaaggccagaatgaatcaactcacatgcagactaagtaatcgagtggcaaggtttgggttcaggaaatgagacagtaatttccaattgtgaagttcaaaaggggatggtcccaggaaaaacagtattggctgtttgtgtagagcacctcggacataactaactccatcttagaaaaagactttactttatatttcatagggcactttgccaataaggataacatgttttgtttaataaacatataaagaaatgaagattgcatccaaccagataagttcacaaacaagcacactcttccactatcagttttcaccagaggactctgtgaccataaaaaaaattaagccttcaggagcttcaaacagccatcttaactgacacagtcttgcagtcacttgtaataaaaacttggtatctaccactgaaggctttgccacctcagaggctcttccttgcaagacctactgtattagcccattttcacgctgctgataaagacatacctgagactgagacataccttacatttccacatggctggtgcggcctcagaatcacggcgggaggtgaaaggcactgtttacatggtggcagcaagagaaaaaggaggaagatccaaaagcagaaacccctgataaacccaccagatttcgtgagacttactcactatcatgagaatagcacgggaaagaccggcccccgtgattcagttacctctccctgggtccctcccacaacacgtgtgaattctgggagacataattcaagttgagatttgggtggagacgcagccaaaccatattattccactcctggcccctccaaatctcatgtcctcacatttaaaaaccagtcatgccctcccaacagtcccccaaagtcttaactcatttcggcattaatccaaaagtccacagtccaaagtctcatctgagacaaggcaagtctattctgcttatgagcctgtaaaatcaaaagcaagctagttacatcctagatacaatgggggtacagatattgggtaaatacagccgttccaggccaggcgtggtggttcacacctgtaatcccagcccttttggaggctgaggcaggcagatcacgaagtcaggagatcgagaccatcctggctaacatgatgaaaccccgtctccactaaaaaatagaaaaaattagctgggcgtggtggcgggcgcctgtagtcccagctactcaggaggttgaggcaggagaatggcgtgaacccgggaggcggagcttgcagtgggccgagatcgcgccactgcactccagcctgggagacagagcgagactctgtctcaaaaaaaaaaaaaaaaaaaaaagagtgcctctattccagagaggcaagacaaacatgtctgtgctccaatatgcagattgagggagggaagatttggggaaaagtaggaaaaaatttgaaaaagaaatctaaaacctagatttaggacaaaaattagaacaagggaaggaggagaaagactagagagaaaaaacagggcaagctgctgtaacagattgtattttccaaagatggtctcaccaatatacatcccatcttacatgctcttacaatgtggcattgacattcttccatcaagaggcagagtctagttccccacttccccagtctgcacagatcatttataaatagctcaatatgaaagtgactgggtgtagcttctgagctttggtcagaaagcacattacatgtttcactttggaccactcaagacgcccatgtggagaggaactgaggcttccagcttagagccagcaccaacttgccagctgagtcagctaactagaatgggcatcttccagtcccactcaagccatacagttttcagatgatgacaggctcatattaataattttttagatgacagatatgttaatgaacatatcactacaaccttatgagacactccaagtgataacagcccagctgagcctttctcaaattcttgatcaacaaaagccaagagaagtaatattgttgctttaatacactaaattttggggtattttgttatacagcaattaataactaatatattttctcctacaatttatcattgcacaatgatgggcatgaagcaaacattaccttcagaagatttggattcagtggcatctaatgtgcatgaagggccagtggagaactttaaagtcttttatttccataatgacaatcacagcaaggtgaaagtgggcagccgatctgggggagaatatttagcctcagggatttataacctgtgctatggtttgaatgtttgtcccttctaaaactcatgttaaagtttaattgccgttgtaacagtattaagatatgggacctttaagaggtgatgaggctatgagggctccactttgatgggtgggattaatgctgtatgaaaaaagctaggcccccccttgcctctgtggcctgacttctgccgtctgatgatgcaccaagaaggtccttgccagatgctggcaccatgatattggacttctcagactctagaattgttagacaatgcatttctgtttataaattgcccattctcaggtattctgttacaggaacacaaaacgtactaaaacagatgttagttggaccatcagcttcatagactatttaaagactaggcaaagatgtatactcattagctaagcaagggagggtaaatcttggttagaccagagatgagattcttcctatggtgtgctggtattttttcctgggtccttatgacatccaggcctctaccctcacataggtgttgtaattcagaacacaaacctaataatgtttctcaaaaatgttagcggcctttggattcttcttttcaaagaatagttctagaatatttctccatgatagagtattttgaaggagagagcggtctaatttgatgaatgaatccatcagttggaagggctttggccttagtgtcaagaaatctgggttctagtcttgaagtgttcaccaacagtaagtgtgatttttagcaattcccttgaacttcagaagttttactgagatattttctccaatgtccaaagatttttgcagctcactgactatgatttagaagattttgtagtggtgaaatgtcttcctagataataactatgtatgttcattaaacattgctatacataatagggtatattgcagcaaatatctagaactgtagcgtacggcattcaggaacaccaaagaaatgaattaactaaaaagcacaattacatttgtatttaaatagaagactgttttgcttaaagtgttttatgtttataaaatacctgcatgcttcatattattccttgaaaagaatgtgtaccttgtgcttagtaaaagaatccatacaattatgtttctattctgtttctccagtttattattttcaacctatagcctgaagtcaccaatctctttgtgccccgtcccttgggcaatgtatattcaggaagtgttgcttttgggtaagccttgttgagacaatgcctggctggttttgtctgttggttgttagccttgaatgtctggccaagttgcccacagttgataggggacaaatgggagaaaaacggaaataccaacgatagacttcctcagactcagctcttgcagctcagaatagtgtacccgagtggtaacgcaagttagaaatgactggtgttctccacattacagtactactgggatattgctttacatgcctcctgaaaacaaatctgcattgcacaccagatggacatgaaaccaagatttattaaaatacccttagcatatttacaattgaaagccatgaatgcaattctctgtaaattccaaaaaatataattctcttaaaacaaattaacagaggtatcaacagattaggataaatataatctatcacagagatagaattttttgaatagacaattgacgtttttctaatcaatatatattatgtacaaaaatacacttgatattgtgaccaagtactgtcaaggaggaaaaaatatatatatataatacacacatttttattatgtacaaatcagtgttggttccttcactctctttttaaaaataaatacttcatttggttgcaaatgacatttataaattcaactcatgagcatttctcagctttgacaaaattaaatatgcaaacaaattagaaatacgtatttttaaaaatgcaaagggaaaaatacctgaatccaatgagcttattatgcttaaaaatatcccaagagcgtgtaaggtttcatgtctttaaagggccttctcctttccccaactgtcttcattactgcctacaatcttttcagattatatctacagactggtctaatacttaattaaacagaaaagcctatgttttaccaggttaaatggctatttaggacatgcttgcacttttaagtgctttcaagagtgtagcagttactgttcatctgaaaataaccaagaagtgtcaacatcctgattcagaacaggggtagatgtttgaatcatgaatagtagtaagaatggagcggcaataaaaatccttatgattcaaagtgtttgcctgcacagaattaagtcaatttgtccagcaccacagaaagttacttgagattcaaaaatctggcgttctgcatcatagctggtgacccggtctgatgtacaaatttatcaagagaatggccttaattagtttaaggtaaaatctatgagaaattgagaaggcctagaataagaaccccccccccaccccgcccaatcttcttaaaataaaataaaaagagacgtattttccatctcttttatggattttcctttttgcttaagtgatgaggtgatgctgacattaacaagaggcagtcacagcagtgtgtctcacatgggctccttggtgacagcggagctccctgtccaaacggctgaggaacggagcacagggtgtgagaggatggaggaggggccaagggagctactcagttgtctatgatgcagaggtgtgaaaaaatctgggtctgggggaaactgtaaagtaggaaagaaatagccatggaatatgaaggaaaaggacgaggaaacagaagtattgaaagaagaaagtgaaacaaagctagaagtcaaaatgacttttgaacaggcatggagtaaacagggtctatggtcaagcagccccatggatctgaaattgttggagctgttaaaccaagcacagaccagtttcactggggtacctgctttcccagtacattggcactgatcaatacaagatcaagggcactcacatttgcctaatacagatgccttgaatttccacggaaaagctgtccacgatacgaccatggcaaaaaatcaccagctccctaacaatgtaatctatcagcaaaacattgcactagcctcgttcaaatttttctcctccatgcgtcctttttttcttgctcatcccattgcttgcaaactcacaagataccagttatatgaagacataaaactgcatggatcaggtgcactttagaaagcagcatccagggtccagggtgtcactaagaaaactaaaccctgaagtacttgaaataatttacatttctgctaggtctgattcatactaggatgttgactgccttcactcaggttctaggcatgcaggccagtgcttattttccaggccaaagcacgatcccctaaatcaaagtccaaggccaccctgcttgccatgctagtctaaatgaaaactcaatgaaagaaaaagactatgataaaccaatgttttctctaaagattcttaaaaattatccaatttctaattttaaaagtttctgcctttttagtattttagattggttctttaaagggaagttctttttattaatgcatactctctttgaagataagacatctagctgacagtagggtcatattacttatgccttgggaaattacagaattgcacaattataaatttaataattttggagtagacctatcccttaggtagatccccaaaacctatttgtgtcattgcgagcaaacagaagaattgatactagactttccctctcactcatggatttgttttcaatggaaatggaagccttccaaatattatgcagaacacaatctcagtggcgctgagctaccttctttatgccttgtggtccaatgtatgaagaaataagattttatctagagacaagttagcatgaagcgaggaaaaaggagatatttataattcacaaaaacatctaaaatgtaaagatttcaaatgtccttttagtcccttactgggaagagcagtataatttttgtatgctataaactcctttttatacatctcctataaagaaatctggaattcaaaatccatgctaagagtttccagagtgttcatccctcaacacttatcatccatgtcatggggaggtagagagtaatttccctgaatagccagtggtctatgggactaacctttcatttgggaaagacagatctggaaagcgaacccagttaacagtcaaaaacacattcgtttcataagaggaaagtggaagaaagcccctgaagagaacaatgaaggaaagcaggtacacgtttgccaaggacattaacaaacaattgctaatgtgtgcctgaaatctgatttccttcttgatgtattaagataatgcattggcagctcacactatacatggagagaaatattcatattaatttaagacgttctcatagtttcaaaggtagagagcccctcagtgtctgcacaggtagaatttaggaaaatgttcagcctatgtgagagctatagtgtggtagaggttgtttaatccatgccaaattctttggacgtgattttctgcctgaaactatagtcttctttgcattttgctggcccaatgtcatcaagtttcacacaaagcttggaaaaatagcccacaagtgtagttggatcagcctttagaaaaggagactagagattctcagtatatttaagagaagatttaaaaatagaaaattacataagcgtagagggaatgtagaaaaataaattgatggctatatctaacaccttcatataaaaatggaataaaagtcaatcttccccacatcaagaacttcagagatgtaatataaagtctggagttcacatgagctcttgactgaaggacacgatcctatcagagaaaggtaagagagaaaaggtcttctatggccctggttatcaccatagttaggagaagggctggggatagaggaggaaatgagttccgtaagttccaccagacagcagacctactgaatgaggcttaatttgcttccctaatctctccattggtagaaattgcatagtggcttaagagacagttagccagctgccattttaatatcttcatgtttccaagttgttaactacacgtttcccaaatcctaactttatatcacagtattggttaagagtcttggaacaaataaggatactgaattggcttcaaatttgacatgttaaaactctcttaaattcatcactttccaacaaagcattgatctggaagttcagtagattgcccattccttgggaagggagatgaagaattgtgaaaccaaaatgcagtgcctctaataaggtgtcaacagcggacaggtgtgcagaaatgacacaaaatgggcttcccagtcacagacaagctgtgtaactgagcccggttatgcctggattcaattgctaatggagagatgaatatcattatgtaagtctaaagaagaaagatatgctaagtcaagtatttgaagatgcttttctttaagccacttctatactaataacagtttccaggcagctggattgtttctctctatagctggaaaatggaaatatatccaagttatttgcattttggaaaggctaaaaattatccactcttttcaaatcccatcagcttggccacacagactggtttcatctgtgttgcagatttctttatgaggtcaaagtagcagacatgaatgaaagttcacttctttattctctccactctcttcagttgtagggtccctaaaggtaaaataactaatacaaaacaaattttaaaaagtggaagctttttctttcctctccactttttggccatttttgtttttattaggacagacaggataaaagaaaaatgaagctcaaatataactgatgcttgttagcaatttaaaaagacaatttaaactgttttataaaatcagatatttaatatttggatcagatatgtgggaggggggaaggctatatatttttggacttcttcctttttgtcatataaagctccaaattgattttatctttgttgtttttgtggatggagatgagtactacaaaattgaccaatttagtatgtcagggaatgaagaggttccccggtcaatgttacagcctggttcctggaaaaagagcctgcaagcgtgcattgctaattcccattcacacactgacttggcgcaatttgctgtgctgttgtatgcaatgatctgcatcaatgacactggccaagggagaagcagaaacagaaatgaggacatgtaactttcaagaaaggaagagtatcattaaaatgaaaatttctctgttgcaaacatcatagagaaaatgtgcaatcccaggccaataagcaaatctttgcccaaaataaacatatttcttctgctacatctcactgcggcccttagaaaaaccgtaccaatgacttatcttactggaggtgttaataccaccaacatattttattccttccttcagtttttccagtttctttaccagcagtatctgaacttttcatttaggaaacaccattcttcatggtgcttatgaaaacaggaggtgcctgaaggaggctgagaagaggtttgcagcttctactgtccttgataggggaggggaggggagactgcatgccatctgatattcaattcctcaaccatactggcaatttgttttggctagaacatttaaaagtgtaatagctccactgggtttccttattccacttctcagatttcagaaaatctttataattcctgagtagttgcagtgagtgtgtagaaagacaccatcatcaacataaggattcaaaaggcaactgttgggcagtaggaccatcacctatgacctctgggcccccaccgtcatcataaacatccacttctgcttggccacactttttcttatttctttttccccagtaagctgccacttattgagataaaagccatacagcacacctcctaacctggtttttgatacttcatgggcctgatgcttttttttttgaaacggagtctcactgtcgcccaggctggagtgcagtggtgctatctcggctagctgcaagctccacctcctgggttcacgccattctcctgcctcagcctcccgagtagctgggactacaggcgcccaccaccacgcccggctaattttttgtatttttagtagagatggggtttcaccgtgttagccaggatggtctcaatctcctgacctcgtgatccgcccccgcttggcctcccaaagtgctgggattataggcatgagccaccacgcccggcccgggcctgatgctttttacctaacgtgtctgtagtgtaatttatgatgtactttgtgtaatttatgtaacttatgatattgtgtgctctgatgctgtcaattgctcatgcaagaatctgaactactgtcaaactgtgtcctcagatttaatgaatattgtctaagaggagacaaagttgtttgtaagttaagggttcttagagttactactaagtcaggtgtgtctggttagatgcagcatagcaaactggttactctcctttctagttcagggagggctatgcctagaacagccacttaaagcctgctggcaggatgtgcttaagctgccaaatggcatcccgatcacctcctctccaggaaaagttcagatcctcctgctacactgaacacaagctcaacagcattttagagggatcattttcaaggcctccagattattttagatgaacttccttgaacaaattgtcattgacctttactgagcatcaatttgagttaaaaatgaaggctgtgtcagcaacgtggtacattggtggacttgggagggggcatcccagatacatgatgcagggttcagaataggtgagaataatgaagattctgccatggtgtcttacaacactaacatcatacatcgactagtgtgacaaaaccactaggtttccccaaccgaggcaggcaaaccttgctttgtagaaataggtattttactgcaaagttttagtctgttcactaggatgaaatccaaagtgggctgtatttgtctaactctcaaattaagtgttctcactcattattcttcagcactggttcctgaagggttacgtggccacagtggcagccctgcttaccttcactgatttctcgtaagcatcctacttacagaccaaagtggactgcaatgagtacacctcaaacctcccgctgctctcaccatcaagcctataaggattgagacttctgctggccccacataactcaaaagagctgaattatatggcatgggtaaaactggcacttttcttgtgcatgataacactagaaggagcatacaatggttataagtggaatcagtttttaattgatccgttcttttggttgtcttcagagttaagtgaaaatgaagagaaactatgtaagaaagcagcataaaaagcttcttgctcacaagcaacttcaagcctttttagtcatgcatgttccttctcggcttttctgttttgcttgtctcgttccttcattgtgaattttaaaaatccaaccatgttaccatattcctttcagttgcaccagtagaaaaggcggttagcacctgcatgaatatggcttctgtgacttgatttgatcctgactgcagtcttcattctcgaagctgacattagattaggatatggtgctgctttcattactggatctattatagaagcattcctgaggggctgctggctggcaggcatatcctgggaagatgctcaggcacctggcaagtccaggggttctggaaagatgctggggcaaggggcaggccacatgtggaggctggatcaggaaggaatttaagatttctgctcatctctggactgtcctccaccaattggggggagaaagctcggcctcttcaaggcctaaaaatgagtctttgatcatattgtccattcatctccagtcctctttcttcacccctcacaagatttcagagacgtggcttaaagacaaaagtgtcagagaggtcaaaggtggtttccttatgtgactcaagagccagggtcagaaagagctgcctgtgaacaatattccacttggaagttttctattaatgtaattactttcattttgatgtaaggaaccttttttctgcccttcagtttttttgacattaaagagtcctgcttcatcctacttcacatgcctatcagccaaggtcatgagcaggtgctgtgagttgcatttgctctcctgtctggaaactgcctcctggggatgggggtcgtccagctgcacagtcacagcacataacgtagaactcggctgcgtatcaacacaacattgcccattcatgaacggtccaaaatgtaaaaggtgctctgccgctgggtctcttgtccaagcacacccaaggctgtgcttgctcaggtattacattttctcctgggagttggggtgcagaatctctgctggcccagaaaaaccacaaaggaccgatgtaaaaacaagaatgggcctcacttaacaactgatgtcaactccttgcatggtaacttgttctccaggatgaagtttatggctatttgtctccctctctccacccaggtatgattctgttttttctccttttcatcacgtaaaccataacaacaaaaaatcatttttttagtctggataatacatgttcttggacctcttcaagaatagttttggtgagttgcaacattattggagagaaagatgctgcaggattttgctgcaacaggatcaaaactaagaccaataatcaaaacagcagtgtgtaacgacaaagacttgaactctcccaaggcaactgtcctcaatgatcttttctctcttctgtgacaatgtgacatatatcaagctttggttataaagctggaaatctcagcttttaaaaaaattttggaaacattttggtatttcttctgctcttagagtggactttgggcttccacaagaaacagtcatcaaatatttctgcaatgttcccttaaatagttttccattgttcctgcggcttaatgagggacttcttaaagaaggcatggggcactctctgcagatgacctcagaaagagatgagcaaaaacaaacatttagtgacacatctttcaagaacgtcctgcaaccctgtggtcacaaagagtatgcgtgcaaggtcctccacctccagtgccatcatttccatgtgtcttcatcttagttagtggtcacactggcttccttctgacgcagtctttctttctgttaaggaaaaaaaaatgaatgtatcattttctttcatctttctcaagttttgatacatttctcaaattttggtctagaatgctgagtttccggaattgtgccaaatggcctagaaatgagagtacctctactgctttccctaagctcttagttatctgcccctccctacctatcacccttactccccagaaaaacaaacaagaaatcaataaccagccaatctaccaactacatccatctaaaacacgggcctttaccatgccagggtggtcttttctgttctcttcttttgtgacaaagaccctaactttgtagtgttactcaaggaccccttccgtccctacctttggctcattgatggaattagagaatgcccaagaagatatgaaaaaaaaaattactatttccaatgatcaacttggcagaactcaacaaaagccatgcaaaatgggagatgaccagatttagtctctgcagaatggcagaagttcccgatttgccatggatgttatgctcttcattctccgagcttcctcctcagagactgccttctaaagggaaggacatggacatctgctgggaagacgtaagaatacacaggagcacactacacagaaacatggacccccatggtatctgtgacactagggaagcacacatatcagtatggtaaggatggtgtgcctgctctgggaggagggtaaatagaaggctaaaatggaaaagggagaagtatactcttttggaatgagcagatgcagagagaagcctttgagaatggatccttagctgcttatgagctatgagatatgatgttgcagtgaattactaaattggcctagatataaacttaagttgatgatttttcgacacccatcctaaatttggaccccatccctaacttgcgaaattgaatcaggaatcagtttacaagctcttccctgatttccacccacccacccacacagacaataaaataagcagccccaacaagcccaggatcacaactgggagcttgctcacaggggaggtcgtaaacccactgtttcccttttgtctatatggctgaccccattctctctgccttgggggaacaagcttggctgtaaaagtctggatagaggcccaaataaaaggtctgaggaagagggagaggctcatgaaggaagaagacaaaaatcagggttcagccgactgccactgaaagtcatacaaatgaatgtcataaatataccatcaaacgggtacaaaggacatgtccggttaggtaggggccatgtgctcaaccatggctttccccgaccaaaaagtatagcccggacttctccatttctcattcatcaacctcatgcaacattcatttagctgctcatggggttgttgggagaaacattatggtcaatcaacagaaataatctcactttgtaacttagaacccatttatattttcaaaggatttgaagcatccagcaaaaaggtactaataatctaaaaggataaagtaagtagttgttggacatcagggcccagagaggacagagtttgaaaaatccgagagaggagggtgatacttccacttcccactcattgccattccccattgcagggtcaaccaaagcagctgaaattcacagcaacaaggaaaacaactaatatttattgagctcttattatgtgttaggcattttacatgtcttttctcagttttctcaaaataaccccaaaaaaaaagtagtatgttcttttcatggaagagaaagaaacaaagtaacttcactaaggttttacaactatttaagtggcagagctgtgatctgaacccaggccatttcattctcggcatcctgggatcctaaccatgtagctattctgactattgtccgtaacacctaggtggagattcattgtgatctctactgaaaactggactttggaggacaacgcaatctcacatataggaaggctggggagactgctggtttccagcatagggagagatgtcaggagacccagaatctggtcctggcttttgttatccacttgctaagtgaccctgggtaggctgtatctttctgcacttcaaattttccaactatcaaaataggagaatccctgcctctttctttaatggggaaaaggaactgaagagaatgaatatatttaaacattttgagaaaaagatactttgagataagggtgactgtactgcgggtagggtgtggaaggatgtgaaatggtaagtgactaaatttggtttatcagaaatgacctatgttgagtttacaggaaaaacatataaagctatgttttgtacctccacccacacatacttttttttttttttttttaaccatatgctactctgggatgggaactgagaatctggatactatgtttcatctctgagctttagcccttcctgggcgcacctcaattttcatgacaatcgttagattatgttgaaaaatatatctcaccaggctagcagtgggattgattttctttgtctccactttcttctctgaagtcaacttgctgactgattcctgagccattttcaatctgaaatagaaatagggaaaagacaggggagagagggaaaagaaaggaagagggaaaaggaaagaagaaaagagttaaggcaggttaaacataaacccaaatgcttttgaattaatccatcagcaatttgaaaatactgaaatgttttttcaatgcttgttattaaattcaaatcctaattaggtgtgaaggcttctctgctttatcaaaatttaattttcttcaccagctgaagcctgtttttgtgaacaatgtggtagtttctgatggatggagtactatgtgcacagagcattatttacttcagtgttatccggcttgtgatccacttagcagataatgagatgattttgaagaatgaagttctgaggaaatgtgaaactacaaatactaaaattcacgaattcacatcaattaagatgtgataacctatagaatgggaaaaaagataacctacggaatgggaaaatataaatatatgtatttttcattctgtaggtttttttccattcaaaaaatatatttatatattatatttatatattacgtatatttatatattatatttatatattacgtataacatataacacatttatatattacgtataacataacatttatatattacgtataacatataacactttatatattacgtataacatataacactttatatattacgtataacataacacatttatatattacgtataacataacacatttatatattacgtataacataacacatttatatattacgtataacatataacacatttacttatatattacgtataatatataatacatttacttatatattatgtataatacatttatatactatgtataatacatttatatattatgtataatataatacatttatttatatattatgtataatatataatacattaattatatattatgtataatatataatacattatatattatgtataatatataatacattatatattatgtataatatataatacattatatattatgtataatatataatacatttattatatattatgtataatatataatacatttattatatattatgtataatatataatacatttattatatattatgtataatatataatacatttattatatattatgtataatatataatacatttattatatattatgtataatatataatacatttattatatattatgtataatatataatacatttattatatattatataatacatttatttatatattatataatacatttatttatatattatataatacatttatttatatattatataatacatatatgtataatatagaaatatatattttatatatatatatatttttttgagacagagtcttgctctgttgctcaggctggagtgcagtgatgcgatctcagctcactgcaacctccacctccagaatgggaaaaatatttttaaatcatatacctgatagaaacttgtgtctggaacacagaaagaactcttacaattcaaataagaagacaaattataccccctcctctaaaaatggacaagggatttgaatagacatttctccaaagctgacatacacatggtcaataagcacgtaaaaagatgctcaacatcattagtcatcagaaaatgcaaatcaaaaccacaatgggataccacttcacatccactaggacggctagaatcagaaaggaagacagtaacaagtactagagatgaagatgtgaagaaactggaacccttatacactgttgatgtgattgtagaattacacagttgctttggaaaacagtttggccgttttccaaaacgttaagcacagaattaccatatgacccagcaattctactgctaggtacataaatatatctataactaagaaaattgaaaagatgtctatataaaaatttgcatatgaatgtttatagaaccactatttatagtaatcaagagtagaagcaaccaaatttccatcacctgatggaaaaattaaatgtggtatatccatacaatggaatactactgagccataaaaaggaatgaatttgctgatacatgctacaacatggatgtacctcaaaaacattgtgctaagtgaaagaagccaatcacaaaaacacatgactctatttatatgaaatgttcagaacaggcaaatccatacagaaagtaggttagcaaaactatgggtttccccatgctggggaaaatggggagttattgctaaccagtcaaagatttcctctaaaatcagatagaggtaatggttgtagacccttgtgaacatactaaaaaccactgtgtagtgaagtgatactaatgtgtatggaattgtacactttaaaagggtgaattttatgatatgtaaattctatctcaatacaacttattaaaaattcattaattcagcatgatagtatttcttacccatcaggttggcaaatgtaaacaattagacaatattaactgtttgtgaggatgcaggggaatgggaagtgccacacagtgcactaaggagaagaaattggtctagttgggtttggcaatatcaagtaaaactgaaagcatgtacactctacgagccatcaagttttcttgtagggagataccaaaaagaattataaacagacacagagctttcactgtggcaatatatgcaatcaagaaaaactacagacaacctaatgaataggttcaacagggtgatatatgagaatagcaaataacaactaacatttattgggtacttaatctgtaccaggtgctgttctacctactgtatttgaattaaacttaattttcacaactctgtgagataggaacttctactattcccatttcataggtcttaaccaccatgcaatgtgcaatgctgcttatgtactgtattcattcaacagaatagggtataacagtgagaaggaatgaactagatctacaaattcaaaaatcacaggaatcagaggcatgatactgagagtgaagaatcctgcagtgatacagtgaatagtccatctgtgatgatggtcaagagctcaggctccaaagcctgattgcagaattaattctcagccctatcacttattaactgtgtgaccctgcacaagggaactctctgtgtgccttatttcctaaaaaacatgacagtaatagtgcatgctacataggatcaataagaggactgagacagtatcagaagcatgtgaaccagagcaactccatcttcaatagaagctgggtaaaatgaggctggaaccttttgggctgcatttccagatgactaaggcattgtaagacacaggaagagacatgaggtcagcacaagatacaggtcataaagaccttgctgataaaataggttgcagtaaagaagctgacccaaactctccaaaaccaagatggccacctagtgacctctggtcgtcctcactgctacactcccattagtgccaagacagtttacaaatgtcatggcaatagtcaggaagttaccctgtatggtcttaaaaaagggaggcatgaataatctatcccttatttagcatgtcatcaaaaaataaccataaaagtgggcagccagcagctctcaaggctgttctgcctatggagtagccattcttttattcctttactttcctgataaacttgctttccctgtactctacagactcaccctgtatcctttcttgtgtgagatccaagaaccctcttttggggtctggattgggaccactttcctgtaacatctttctggcaaccacagaagggactatagtgaggaaacccctgacccaaaggctagctttgggtaaccggtggggtcctgtatcagcagtacagctccaggcaggcggtaatagcagaataaatgtaagctgctattgttactttgcatgcagtatgctacactgtgcgtataattttaaattgaacccatacatacagacatctatctgtatttatatatggatacacacatatgaaagtattcaaaatagactagaaagatactcaataatttcatgatagaggttattgctagaaagatctgggaagagaatgacactggcaataatatgccaagtagaatttcattttatctgtaatacttcatttttaaacttaaaatcttaaagaatatatgatgcatgttaatagttataattctaggtagtgggaatatgggtgtgatatgctatcttttatatttttatttttaaaatttcttcaaaaaatcttcaaaatagtaaatacttaaagatctatcaactcagacatttaaaaaatatgctttttcttccatgcttcaaataaaaatatcttacttaatattaatcacatacttgttggcatctgtaagtggctgagtagcttagctctttatttagctaatgttatacaatttgcttaaaacacacatttagtaatcccatctccctgcccacatgcacacgttagttacaatgaattcaacattcttacttgtgcactggacaataaattaattctactgttgcagtgggaaagcagccatctgaaaaatgcatcaacgaccgggctatgctatgttctgatagattttattgacaaatactggtagtgggccagatccggctcataggctgtagtctgccaattcctggactgtatcataggattcaaaatcttatgcttttggactggcaatacaatctccctgctataaacccagtttacttatcttaccttttcagacccagatctgttgttgtattcgtagtatgctggtttaattagctgagtatccttggataagtcatgtaacccccaaacctcaatttcctcatctctttaaagtgtgaataataccacacctaataacattgttgctataaaaattaaagaaaatactatatgtgattactgatcaagcatcttttccttcacctcactccacgtgttccatgacccacccaaacgacttacattctttgtacatggctttttctcacctttgcatcttgcttttactgttccctcaatgacggtctgagtcatttccatgcatgcaaattcttcccattcttctatttacagcttaagtgtcaaagtcatgaaagcttccttcatctctcttagccagaagtaattgctcttttcttaaatgacaaagcactttgtgcctctcttaaggtacttaaggcatttcatcttagaactgagtaggtgtcttatttttcttaaaccattggaatgacttagggacaacgagcaggatttatccatatttgggacctctccttgttcctttacccagcactgtaccatgctcaagtcagttcttagtatctacgtgacaaatgacatgcattgataacttttgtttttctgacttaaacaatttaaatgtttagtaaatagttataaaatgattgctttttgcatttatccttgggaaaaaactataaaaacatttagaagtgtagttccagttactgattagctgattaagtcttaaacaaggaaaaagaaaagatactcaaggccacccaaatgtgctaaatatttacacgtgtcatcttatgtatagattccaagatacttaaaagtatccacattactttgcccacaaggagactaagactcagtgaggttatgtgactttgtcccaagtctggaatttatttctcccacttaggaggtaagggctttttgcatttaatcaaagaaaatttgctggttagacagtttctagctgcatacacgctcaacctcctcattgtttgtggacttgtttttgtttctggcctaaatgttggctctaatgtccatcagtagatgactggacaaagaaaatgtggatcacatacaccatgaaatactatgcagtcataaaaagaatgaaatcacgtccattgcagcaacatagatggagctgcagatcattatcctaagtgaaataactcagaaagagaaaatcaaatactgcatggtctcacttataagtgggagctaaacagtggttacacatggacatatagagggaaataacagacgctgggggtggggagagtggggaagacagtgagggtcaacaaataatctactgggtacaaggttcactcttcaggtgatggatacagtagaagcccaaaccctgccactatgaaatacatccgtgtaacaaacctgcacaaatccatgtacctcctgaattgataaaaacaaaaaaaaataaaggttatatggcaatccttacaaaagaatttggaaatataggaaacaaacaaacatatcagagaaagaaaatatatattctcaattgataaacgtctcagtaaaatttttgaaaactttatcttttcctctttctcattatcatgcatatgctccctaaggagttattgggagccccagtaaataccaagtgctgccaaagactactgaggaaagacacaagtgtaagatgggaaagtgagtcatgtcctctgatgttcttgcctagtcttgactctgtagaagttgactgtaacctggccgggtgtggtggctcacgcctgtaatcccagcactttgggaggccgaggtgagtggatcatgaagtcagatcgaaaccatcctggctaacacagtgaatccccatctcgactaaaaatacaaaaaattagccagatgtggtggtgggcgcctgtagtcccagctactcaggaggctgaggcaggagaatggcgtgaacccggggtcgggggagcttgcagtgagctgagattgtgccactgcactccagcctgggcgacagagcgagactctgtttcaaaaaaaaaaaaaaaaaaaaaaaaaaaaaaaaaaaaaaaatagttgaagtggcgtggctttccatttagagatttaggctccccactgttatagcctcatcttttgggaaagcctatgggcatactgtgggctttctacaggttagaggcatacagctgcagctaaatcaagtcaattttcagaatctagccatctgtgagactgaggaagtaccaagtctttattcttttgacattcagtatttcactggtttgtgttgtacaaggcagaagatactgaaatcattatgaagtttgtaataacagaagtgcttttatttttgaccacagggattgagcacaccagccaatcaagagataaatgagatatggaggaaatggggcagataagagtgttcaggctgctttacactccttttcactattggaaaatccaatagtttggagcagtgtttgtaaactatttttcaaagagctttaaccttcagcaaaggtgtttcagggagaagaggcagaattaggggatcctccagatgccaatgttggcaagctctgcttcagttagaaaagctttactttgttttatacattgatgatttatgtatgtttttagacaaaaagaggtctgcttttttttttttaacagaactttttgaagctcctagggggaaaaacaaaacaaaacaaaacaaaacaaaacaaaccttcctcttcaggagaaagacaacagaagccaacagaaagcttcttcctaaagaactgtctatgaatatcttagaggtagacaactgatttaagaagaccaaggggatgattcttctgacagccataaccacaagatttcagattttgggctccagtaaaacatcaaatctacaaaaatcacaacatggccagctttcccactctcttctgcttattactttccaggtaagttctaagcctgtgagatcaccagtgtctggcaaatacagacaggcacagtggggacagatccagatgaaccagactgtggaaataagtggggcacccatttatttccctctcataaaggcagagattgcctcacatttcattatgattcattttatttatggtcttttctggaattttgcttgagttccctgatttctgccctatgcaactttccaatgtctatttgcctcctttgcttttaatagcttcagaatgaaaattaaatagagctatcttattacaccttgcctatggcttctcccaacttaattctgtgactgcaattaactttttttggaggggggttcatctgctcatcctcgtttcctttctttcccattcaacgtatctgtgtgaactgtaacaagactgtcaacctgttaacttttgagtaactcttaagtatgatgctaggggtgtgtgtgtgtgtgtgtatacgtacgtgtgtgtgtgtgtgtgtgtgtgtgtgtgtgtgtgtgtgtatatatatatatatatatttttttttttttttttttgtagagatgaggtttcaccatgttgcccaggctggtctcaaactcctgaactcaagcaatccacctgcctcagcctcccaaagtattaggattacaggtgtaagccatcaagcccagacaaaggctaagttatatttataatgaaaaaaaggaatttaggctgatgactggcgtctggacacaacaggtctcaaatcatggttcaggtttgggtttacactctaacctatggaattaattttagtgtttaaaaataggtaactggcccctgaaaattagcgttatcttttaaacacctatgggtgatatgttagaaattctcctaaataatatgattggttcatttcagtcagtacagaaaatacaatctggtaatactatcagggcatttttgttaatacattacttgcttttgtattgtagacaacaggaccaagaagtgacttcaggagcagaggaataaacttttggcctctaatgctactagctttaaaaagaaagccctaccagctacctagtacagtgtgactaaaattaatcaccgctcgactcagatcatgtatgtttcttgatccaagccattaaaagttaatggctttggaaatattggcagacaaaggcaaagaaaagagacacattgagggaatatggttcatgaaaggcatcttgggaaacacatgagatctgaccagctataatatgaatctctttaaaaaaagattttaatatcactcgttgctaaagaaagaagataaaaatggtctaaaaaatggatacggtatgctctgtgtgccaacaggtaatgtgcctttaagtcagcatgccacaggaaatgtccacgttccctaaaaagtaggatgataaaaactgaaggtccaagctgctgcaccactggacttaccctaaatgtaaagacaggagttcagaatctctctaataaatgcaagagctcttcattctcatgactgttcagaaatacatggacgaacatgataaacaaaggaacatgcaaaaaacacatttttaccactggctcagtcaattctggcctatggtcctttggaatggtgaataaggtttccgtggtataaaaaaggtattggccctcactgtagatcacacctgtaaaataaatgactcaccagtctgactacccaatatagctttgctctaccagtcattatcagggacagcttctatgagcaaataatgacactcttatggtctcccttcagaagaaaaagtcagaaaaggggtatatagagcttcaaggatgaaatacaaaaaggagtgaatattcactcctttgccatgatctccttgcagctttgaactaagtcacatcaggccaaggcacaaggaataacatatagactttggggcatcagggaaatggcttccttgcctcagaaagctcaatatcacatggtttatggcattttgaatagagaagattgagggcaacgttttgatctttttctcattaggcttacctgaaacatagatggtattaacgccataagggctgttttaaatatgctttcagagggatatggctgtgtccagccatccctccaaccactgcctggtggcctgaacatcagaagtaaggctctgtccactctatatagtttgttcaggtcttttgatactactcgagtctatacaaggtacagcccccagttcccagagcgaaattgtttctccaggcgaaaacgggctaatgtccaactttgattctaaataagtgagatcgtagagacctgaccagggctgtgaggaccactctcatttctatccatcttgacaacagtcactcacgaggcatttctgaattcctgacataactatcgcacgaggttaactgctataaaagtcaatgaaataagtaaagtcactccctactgtaagaaaaaaacaacaacaaactcattaatttctcaatttaaagggaaattttttccttgctgcagcagctgatgaaaacatcattgactaggctatgtggaatgtttccaaagggtagaaaaataaaactaagagaaaagagccataaacagtaagaaagaatgggtaaccccaagttcatttatcccaggcaggccaacaaggccacatacttagacagacacactcttccatgctcattttctcttcagagtctgaccttcggccctgaccgctctggcaccgaccacctcctgtgcctcccaggtcagtttcactagcagccatgataaaacagaccagcaggaaagtaagaataccagcagaaagtaatcttaggcttagctcctaacacaccagaatttagcctttaaaagttattccagttgggcatggtggctcacacctgtaattccagtgctttgggaggctgaggcaggactgcttgaggctaggagttcaaggccagcctgggcaacacagcaagaccctctcaactaaaaaatgctttttaaaaaatgagttgggcatgatgatgtgtgtctgtagtcctaactagtcaggaggctgaggcaggaggatcacttgatcccaggaattggaggttactatgatgacaccactgcattctagcctgggcaaaagaatgagaccttgtctcttaaaaaaaaaaagttattccatgataaattagcatatcacttctactttgtccaattgtgtactttgtcaaatctaaatctgacaattttccctactctattcctaagatattttcctatttaaaagtaaaaaacttctcttagagactgcatgcatttcaccagctacacagatcagccacttcatagtttttgtgagctatcacttgtatacccaaacatactttgacttcaagtgattaattgcagaacaaagtcctcttccgtttgcagagcttctcccccaggacacaggggagttgaagttggggagccctggacttgccctggaatgcatgatcagttaaagccaatcactctgcacttagtagacataacacccagagccgacccggcgatttaggtgcagagtgaaaggtaacagcatcgcattcatttcctcatttagggagagtagtctgggagacagtttgaaaactgaaatcagccctgtgtcataaatttgcaaatttaattgaaatgcattagtctttggaagacatttccaatcccgataatgaagacatgcatgtgctagcagatgcaagctcccccttttggttttgaaacctctaccacctactgagtctcaccaaaaactagcactgagagcctgtttgcatgggtgactggaacaaaagggtgaggaaacagggaagattgtctggagtaaggagtctctctggcgcccctcaaatcattctacccaggcagccccctgttgcatctctgcccaaggcaggagctgtcaggagtcccacagataagtaatttagaaatattctaggctgaatgaaggagacatactttaggtttccattgttctctgccaagctagggaaatggagtgcggacagatgctctctaaggttttgatttgagctccaaagaggtttgaggcttggcatagccatgaatccaaaggatctccacttccttctttttttctaaacaaactgaaagtaatacagtcaagaacagagctggcgattgttttattccattaactaatctttcttgttctgaacatgtctattctctttaacaaagctattaagattttagattcttgggcaaaagcaacccatatgggatacatttagggacttctaccaccaaaacccaaataaacaagatttttcatctatcagcagcagacagcaaatcttgcaatcaatttcaacatggcaaaaggaaacacaatgattatttatttgttcaacaaatactaactcagcatctactatatatatggaaaaacaaggtgctacagagaaaacaaagtggtacaagacattgtaattatcttctaggggcctatgatttatctaaaagagaaagtgcctataaccaaatgaataaaaaaccaaatcattaaatgacaaaactgaagatacagtaaacccccaaaattctggagatacgatagctcacacagattggagaaagcttcatgaaggacaccgtatgtgatcaataaatttttccagaatagtttcatagtctgtatatcacttgagacataatatttttagattataccattatgtaaatattatagtagttttaaagtagagtcacacactgcataatgacatttcggtcaaagacagacctcatatatgatggtggtcccataaggttataatggagctcaaaaattcctattgcctagtgaagtcatagccaccataatgttgtggcacaactactttattataaaaataaatttagtgtagcctaaatgtacagtgtttataacatctacagaagggtacagtaatattctaggccttcagattcacccaccactgactcactgactcacccagagcaatttccaatcctgcaacctccattcatggttaagcgccctacacaggtgtaccattttctatcttttatactgtatttttactgtaccttttctgtgtttagatatgtttagatacacaaataccattgtgttacaattatattcagtacagtaacctgccgtacaggtttgcagcctaagaacactaggttatgccatacagcctaggtgtgaagtaggctacaccatctaggtttgtgtaagtacactctataatgttcgcacaatgatgaaatcacctaacaatgcgtttctcacaatgtatcccgctagttaagtgacacgattctacgtgtttaaattaagtgctgcaaatttatattataggaatgtgcaaatacacaagagactggagtagaccaagcactcaaaggaggaagcacagaaaagaaggcagttaggctgatcccaggaataacactgcatgattcctccaaacgcatgttcagtcacccaggtccgcctctttatgtctatgtagccaaattcatctgctgtcaatgcccagctcattttctacttaaaatcacaggaagtcagggttggaagagaactgcaagatcacctgagcccaggagtttctaaacttggctgaaggatcactaggaaggtgtcaatctctgatctccaaagcctacctggtacatgtaaacaagaggatggtgaagccaaggcatttattaaggaaactaaacacaaaatgtgttcttgctctgccatctctgtggggagtttctaaaaccacagatttctagactctacactctggtattctgattcagtggatctgtttacatttttacaatgacctccaggtgacttgggagatctgccaggtttgggagctgctgatctctaacactgccctactggcttctgaatctcctctaaaactatctgcttagggtggtcctgattatggctaagtgtcttctcaaagctccctgtagcttccacatttcctttggatcatttcttcctccaaactcttacaccagccaagatcttcaatgctctttcaatatccagctgtgcgctggagaatgcaccatacaagacacagcaaagaacaggcttgtgtcctagaagtggaaagatacacataaactgctaaaataacaagttggaatgaattaaatactaaaggatcgtaagaagaaaatgctgtcagagcccacaggaaaagctaattcttttattaagggagatttcagaacatttctacagaacctggtttctggaggcagcccttgaaagacgactctattttgatcagcaggaaataatggggggaatgcggtatgaagaaattatccagtgagaacacaaggaaagaaagtgcaggtgtgagacagtgagtggtcatagtaggtgcagggagggatgaggctataggaaatgaggctaaagagtgagtttagggcaggttctcagagggccatgctataatttgggagagaatatgaagttcttgaaagaactcaagctttagtgtaaaaaaaaaaaaaaagacctaggttcttatcctcattctgtttattaatgaaactatgacattgaaaattcatttactctctcatgcttagctgtgaaatagcaataaaccttttttttttttccttcagggctgttgtgacaacttaatacattaataaattaaagtaccatccatggctaattatctttcctttatttcatgagcaatggaaaaccacagaatatgtttaaagagataactatgatctaaattctgttttggaaagataattggatgcaatattcagggacacttcaagaggaaatagaaaacctctaggcagagagaagagttagaaggatgtttcaataatccaagtgagagatgatagagtcctgaatcagagcagagacacctcaaatacagggtaaagaacaatcaccattaagggggcaaaactataaagagtcagaaatagatgaaaaataaatcttgtagcagtaaaaataattctcattccagcctgccttttgctaataggaggaggatagtgttgcaattgaaagttagggagcctaagaggaataggccttagttgagatggaataatttccaaccgagacatattgaattgcagatgaaggctgggtatacagtttaatgtgcagtaggaaatgtaggtctaaaacttgggaggccttggcaatgaggtgataggtgaagctgtgaaaatagttgggactaacaaaacagagaatagagcagaaaagaggaacactgagatttaccttggggaaggcccacacttaaggaacagaagaaacagaggaactaaggagggagatgaagaaggggagtagtcaccttcgcagagagacccaatatattatcagagcaacgaggcatttcgagatggaggaaactaccattggtgtcaaaaactagcagtggcacactttgggaggccgaggcgggcagatcacgaggtcaggagattgagaccatcctggctaacacagtgaaacccagtctctaccaaaaaaaaaaaaaaaaaaaattagccgggcgtggtggcagacgcctgtagtcccagctacttgggaggctgaggcaggagaatggcatgaacccggaaggtggagcttgtagtgagccgaaatcgcgccactgcactccagcctgggcgacagagcaagactctgtctcaaaacaaaataaaacaaacaaacaaaaaaaacccaaaaaaactagcagtggcaaagaattagttagaaggagtcatctgatttcagttaggaaatgtgacacagtctagtaacaatctcaatatgcagttctcctgcttcctttagtaaaggaaaccatgagtctttagcagggacatggctcccagctaagcctacatttcctggtctcccttgtgtatggccatgagactaagttctgtccaatgggataaagtggaagtgatgtgtgcaccttccagctcatgctatttaatattaaaaggaaaggttgtgcagtccccttcccactggcaggaactcagcagcaatggtagcagtagacctgacgtgtgcccccttacacgttgggaataaggaccttaccttaaggacggcaaccacaaaagagaagaaaactgggttcctgacatccaaactccttgcattcagattgttatacatgaggaaaattgatttttcctttgtttaagcaacagttattttggcctctgttatggcagccaagacgttatccttactgagacaggaaggagtgtgtggtacgaaaaaggaaataaggaaatgaacgtaaatcattcttttaaaagaagttagaagggaaaaggagacggaatgatgctttcagagagagggccaagaggtgtgtatagttttttaaaccaatgatcctataattcttacagttttttagtttatcctctctccttattcatggcatatttttaattttgcagatgtagttttaaatttattgcttggggaataagcagtttttattatttgtgatttctttttttcttttcttttttttttaaagacagtctcactctgttgcccaggctggagtgcagtggcgcgatctcggctcactgcaaccttcgcctcccaggcttaagtaattttcctgcctcagcctcccgagtagctgggattacaggtgtgcaccaccacacccagccaagttttgtattttttagtagagatgaggtttcaccatgttggccaggctgatcttgaacgcctgacctcaggtcatccacccacctccgcctcccaaagtgctgggattacaggcatgagccactacgcccggctgttctttgtgattatgacaatgttgtttatcagttaggtcttggggcatttactgtttgtgtatttgcacagaaccattttcaaatgtgatttaggaaaattcaaagttttgacaattaattagggggtgattgtattattaagggatttttaaaaataagcagctctttagtggttaaatgaatacaagtcatttaactacataacacagggcaaggaaaagaaagtta

SEQ ID NO: 158 - DNA, 109324 bp, Homo sapiens
acaaaatttaacgtcaagaaaaagtatcagccacagtgataaaagatacatatcagactctggcattatggctaaacaagctgcagctctgaaagttcaggagaggctgggcatggtggctcacgcctgtaattccaacactttgggaggccaagatgggaggatcacttgaggtcaggagtttgagaccagcctgaccaatatgctgaaaccctgtctctactaaaaatactaaaattagctgggcacggtggcgggcgcctgtatgcctcccagctattcgggaggctgagacactctggacaaagtgcacatcttttaaaagcaactagaggccaggcacagtggctcatgcctataatctcagcactttaggaggccgtggcaggcggatcacgagatcagtagtttgaggccagcctggccaacatggtaaaaccccgtctctactaaaaaaatacaaaaaatacatatatatatatatatatatacacacacacatatatatgtgtgtatatatatatgtattttttgtattttgtgtatatatatatatacacacatatatatatatatatgtgtatatatatgtgtgtatatatatagctgggacatggtggctagcgcctgtaatctcagctagtcaggaggctgaggcaggagaattgcttgaacctgggaggcagaggttgcagtgagccgagattgtgccactgcactccagcctgggtgacagagcaagactccatcttagaaaaataaaataaaataaaataaaagcaactagagagtagagaacaattacctgcaaaggaataaaagtttggatgttagcagacttctcaaataaatggcttctgtactcacctaacctattatgcaagaatgataacgtaataaagatattttagacaaagaaagtttgaaaatgtttacagttaaaagaactatttttgattctacatcagaaaaaataaaactgtgcccaaaagaaagaggatgaaagaagcaatgatgatcaaagtacttgataaacatatggttaaatctaaataaatatttatgacaaaaataataatgaccacttttaggaacataaaagcaaacttaggctggacgtagtgattcatgcctgtaatcccagcattttggggggccaaggcaggaggatcacttgggcccaggagttctagaccagcctgggcaacctagcaacaccccatctttacaaaaaaaaattttttttaattagctgggggtggtggtgcatatctgtagtcccagctactggggaggctgaagtgagagaatcattctagcccaggaggtcaaggctgcagtgagccatgatggcaccactgcagtccagcttgggtgacagagtgaataccatctctaaacaaagaataaagaaataaaaataatgtaactttaaatcttgcatataacttacataccatttgagagggggagaaaataaaaggcaaccattctaacagaaggctggaaaagttaaaaacacacaaagattgtaagaaattaggtagaaataagtagtgatccccccattatccatggggatacattccaggatcctcggtttcttcctatacgactgcattgtataggccaggtagcttatacagcatggatacactggacaaagggatgattcacatcctgggcggagcagtacagccaatttaaaatttgagcatttaaaaaaaaagggctggacacggtggcttacgcctgtaatcccagcactctgggaggccaaggcgggcggatcacttgaggtcagaagttcaagacagcctgatcaacatggtgaaaccccgtctctactaaaaaaaatacaaaaacagctggtgggttgcacatgcctctaatcgtagctacttgggaggctgaggcaggagaatcgcttgaaccggggaggtggatattgcagtgagccgagatgatgccattgcactccagcctgggcaacaagagtgaaactccgtctcaaaaagaaaagaaaagaaatgaaaactaacacattttttatttatggaagtttccatttaatatttttgggtggcagttgactgaaaccacagaaagcaaaactgtggataaggtgggattactgtgttcttatcctatcaaacataaatggattattccataagaaaattcttagatcagatcactattttaaagatacactcctaaaactttacttttatttttttgagatagggtcttgctgtctcgctctgttgcccagactggagtagactggtgcaattagggctcactgcagcctcaacctcccaggcccaagtgatccttccacctcagcctcccgaataactcagaccacaggcgtgtgttaccacgcctagaggaattttacacctaaaactttgaacaacgcaagtgtaaaagtaaaaaggtggttgcatcaaaaagcacaggagtcgccttgaagggttgtcaaaggtaggaagtttgagtataaaaaaagaataattactattttcagcaacagttacactatgctctaagcatacttatattgaatgaacaaatgaatgaatgaagggtgggacatcagggtgtgtctgggtggtgcaggggcaggaggaggtctgattgtataaaaattacatttaaatacagggtcttctgcatgaggacacactaaggaaactgcatttccagagagagacacaccacgtaggactgaaaatggttactctaaggggattcgtgacaggtaagcatgggggagcggggagggtagccagaatgtggggctttaagtgctcaaagaggatttgaaaaatcaaaggagcaatattaaaggatgcaaaccactcagcccattcacattagagggacatgatatagatggttggggacagaaggaaggtcagaaagactgactgttcacctcatgaaaatcagggagtgaatgtgagactccttacttactgagtgtggttgtcagttctgcagggctcccaaactttctccatctgtgttagccaggcctttggaaatccttaattagaatgtaaactccatcatagcaactatttttgtgtacttcgttcattgcagaatccacagacctatgtaagtgcccatttgtaggaagaaggcaataaaaaattgctgagtaaatgtggttctgctagtggcaattctgccttatgctcttgatagcctcgatcagggaaagcactgtagaccagttgaatcgtttgcttctttgtttctttaatatgctagtttaagctacagactctcaatgcccatcccaggaaagtgggccagggtttagactgtgtgtacaagagtcagtaagacctgattcattcccagctatgcttcttctctacctggccaaacttttagatctcatgtctcttcatctttaagaggttgataataattgtccattaccccatgtgtttgtcgaggatcacatgaatcatgtatatgaagcacttggatgtctgacggtatcctaatgttgctactgaatgttactgcatcatttatttactcttaggattgtactgaagaacagatgcttagtgaagtttaatttcttttcaattaaatgctaagccttaggccatctgttgttattgctgttccaattttttggtctcagaacctctttatattcttaaaaattgttaaggactccaaagaacttttgtttctataggatatacctagatatttaccatattcaaagtgaaaactgagattaaaatatatttattcattcctttcaaaataaaatgataaatgcgtgacgtgttaactatattttccacacacaaaaaaaaattgtgagaccaatggcattgttttacattttagtactttagggcttaatggaagatggcagaattctctcctgcttttgcagtcaccttttctgatgcattactctattgaagtgtaagaagaaaatctgacctcatacagatatgatgctagaaaaaggagtattcttgtagcctttgaaataattgtggatattctttgaaattacaacacaaactcaacaagtagcagtttcttaaagatgagttgcaatgtgaaaactttttttttttttttttttttgagacggagtcttgctctgtcgcccaggctggagtgcagtgacatgatctcagctcactgcaacctctgcctcctgggttcaagcgattcttctgcctcagcctccctagtagctgggactacaggtgcgtgccaccacgcccagctaattttcgtattcttagtagagatggggctttaccatgttggtcaggctggtctcaaactcctgacctcaagtaattcaccctcctcggcctttcaaagtgctgagattacaggcgtgagccaccatgcccgtcctgcaatgtgaaatttgaaatcatatgaatgaactttccaaattctgtgacattaaaatccattggtctacattgaactttgagtggatcttttacccatgcaggattttgtaacattacatactggtcatttgcaaaatattggtttatgaattaagaagctcttctaaatttattcccctgtacatttgttatagaataagagtgaaaaagtaaaataacatgcaagatgtcaccattgagggaggctagctgaagtgtgtgcagcaccttaaccatatatattattttgcaatttcttgtgaatctgaaattagttcaaaattaaaagtaaacaaaacaaaaccagtaaacaacatggtaatttttgctttcaatcttcatatatattccaaatagcttttaaacatttaagacctattatatgtaagcagatatttaccatatgtgtggcttttcctttattcttgaagttccaattttccctcttaggaagaattttctttaatactccacagaacaggactactggccacagattctcatagttcagagaatgtcttcatttcaccttctttcctgaaagatattttccctggatacggaatctgagttgattgggagtgatggcaagtggtgtaaaaaacaatctaagttgacagtggtacaaaatctttgaagtgctaaaagaactgtctttgtttctgatgagaaatctgtggtcatttgatctctatcttttcgtgtatagattgcactttaacaatctcatcaaagaaatatccctctactttgagtcacaaagatattgacacaggatttcttttgttatttctaaagtttcatttttgacaagtacagctagagtatttctctatggtataaaatatgaatcattttccagctgaggtagaggaattgggggttaacctcacttgccagaggtcatacatcaagcccaggctccttgaaaacattgctatccagcgaatgaattcctcatcagcattccctatctcataggccttccatctcagatttcagaaaccatgaggaacagaatggccccagagaatccccagccagaccctttcatcaataggaattattccaacatgaaggtgataccaccacaggatccagctagtcccagtgagtatcatccttctttgtcctctttccttttctactgccccattctcatgcagccctacaattgcattttgcatttgttttaaggcagctattgattgttttaaaaaatctattcaaaaagtcttcccatcataaaaggagaaatacatttcaaatcaaatgggcctttggcccatggttgattcaaattatgagagataagctaagaatataatatatagagcaagtgagcatgtttttctaggagaaaagatctgaaacatagacagatagaaactgagaaatctccttttccaaggcaggtatattgtggcccaatatggaaggaaaatgaaaacaaacaaacaaacaaaagctcattattcagagtagtattgtatacatgtataagaagattcatttatataaggtggatcttagtgaattgttctgaaatatatatttgttatttgatattttatcctggagatttcccaaacattgtttgtatacaatgtttacctttaaaaatatgtaaaactgtataaaaatctggtttttctatacactaataagcaatcagaaaagaaaattataaaaataactccatttacaatagcatcaaaaataattaggtactaagaaataaacttaactaaggatgtgaaagacttgtccattgaaaactataaaatgttgctgaaataaagacacaaatggaaaaacactccatgtgcataaatgggaaggcttaatattattattattattattattattttttgagacagtcttgctctgtcacccaggctggcagtgcagtgtcacaatcttggctcattgcaaactccacctcccgggttcaagtgattcttctgcctcagcctcccaggtagctgggactacaggcatgcaccaccatgcccggcaaatttttttttttttttttttttttttgtatttttagtagagatggggtttcaccatattggccaggctggtctcaaactcctgacctttagggttttgtttgtttgtttgtttttgagatggagtttccgctcttgttgcccaggctggagtgcaatggtgcgatctcagctcactgcaacctccgtctcccaggttcaagcaattctcctgcctcagcctcccgagtagctgggattacaggcatgtggcaccatgcctggctaatttttttgtatttttagtagagaaggggtttcaccgtgttagccaggatggtctaggatctcctgacctctggtgatccacctgccttggcctctcaaagtactgggattataggcgtgagccaccacacccggctgactcctgaccttgtgatccgcctgcctctgcttcccaaagtcctgggattacaggcatgagccacctcgcctggccagctttaatatttttattattattgttgtttttttttttttttttttttaaagacggagtttcgctcttgttgcccaggctggagtgcaatggagcgatctcggatcactgcaacctacgcctcccaggatcaagcgattctcctgcctcagcctcccaaatagctgggattacaggcaggcgctaccacacccggctaatttttgtatttttagtagagacagggtttcaccatgttgatcaggctagatgggctcgaactcctgaccttgggtgatccacgcgcctcggccttccaaagtgctgggattacaggcatgagccaccactgcccggccaggcttaatattattaatgtgtcaatactacctaagcaatttaaagatttaatgcaatccctataaaaatcccaatggtgctttttgcagaaactaaaaaaagtctatccaaaaatttatataaagtctcaaggaatcccaaatagccaaaataatgttgaaaaagatgaacagatgaacaaagctggaggcctcatattacacaatctcaacatttattacaaattacagtaatcaaagagtgtggtgctggcataaagacagatatatagaccaatagaagagagcaaagtccagaaatacgtccttgcacatatagtcaacaagggtgctaaggccattcaattgggagaggacagtctctgaaacaaatggtgttgggaaaactgaatatccacatgtgaaagaatgatgctggatccttaccttaccacatgcaaaaattaaaatggatcaagtcctaaacacaaaagctaaaactgcaaagctcatagaaaaaacatagaggaaaagctttatgacatttgatttagcaatggtttcttggatatgacaccaaaagcacaggcaacaaaataaaaatagataaattagactacattaaaaataaaaacttgtatgatcaaaggacacaatcaaaagagtgaaatggggccgggcatggtggctcatgcctgtaatcccagcactttgcaaggccgagatgcgtggatcacctgaggtcaggagttctagagcagcctggccaacatggtgaaaccctgtctctactaaaaatacaaaaattagccaggcgtggtggcaggcgcctgtaatctcagctacttgggaggctgcggtgggagaatcgcttgaacttgggagacagagactgcagcagagatcacgccactgcactccagcttggatgacagagagagagagactctgtctcaaaaaagaaaaaaaaaagtaaaatggcaaactatgtagtgggagaaaatatttgcaaagcatttatctaataaggggttaatagctataatatatacaaaactagaactcaacaacaataaaaaaaatccaattaaaaatgggcaaaaacctgaggtcaggagttcaagatcagcctgaccaacatggagaaaccctgtctctactaaaaatacaaaattagctgggtgtggtggtgcatgcctgtaatcccagctactcgggaggctgaggcaggagaatcacttgaacccaggaggcagaggttgcagtgagccgagatcacgccattgcactccagcctgggcaacaagagcaaaactccatctcaaaaaaaaaaaaaaaaaaaaaaaaggcaaaaaacttgaatagatctttctccaaagaagatatacaaatggacaaatccatgaaagatgctcagcaacattaattattaggggaaagaaaatcaaaaccatacccgttaggatgacaactatcaaagaaacagaaaagaacaagtgtcggtgaggatggggagaaatcagaatgtttgcaggaatgtaaaatggcactgccgctgtgaaaaacagtatgatggtacctcaaaaattaaaaatagacttaccagttcaagaccagcctaggcaatatagtgagaccccatcttataaaataaatatatttactgaaaggtatgaaaagctctttccagaagcattcagggcagcagtctccaacctttttggcaccagggactggtttgtggaagacagtttttccacggactggttggggggctgattttgggatgatccaaggacattacatttattgcacattttatttctattattattacattgtaatatataatgaaataattatgcaactcaccataatgtagaatcagtaggagacctgagcttgttttcctgtaacaagatgctcccatctgtggctgatgggagacagtgacagatcaccaggcattagattctcataatgagcatgcaacttagatccctcacctgtgcagtgcacaataggattcatgctcctatgagaatctaatgctaccagctgatctgacaggaggcggagctctggcaataatgtgagctatggggagcgactgtaaatacagataaagcttcgctgactcattcgctgctcacctcctgctgtgcggaccagttcctaacaggccatggacccataccagtttgtgacccaggggattagggaccccggatttaggagatgtggaagaatatgttacacaccaaatagaattgttatttcttacatctcacacagtacatggctaagaattttgcagaaaatccccagcagaatggtaatgtggaaatagaggctgcaggaacatggtgagaactgagagaacagaagaaagttcagaaaattgatatgtttgaagaccaaatgtatgtacaaattagtcattgctgtttcacacaatttcagtggttttaaaaaaataagtatttgttgttgtttatcaatctacaagccaggccaggtgcagtagctcacgcctgtaatctcggcactttgggaggccgaggcaggcggatcacagggtcaagagatcgagatcatcctggccaacatggtgagaccccccatctctactaaaaatacaaaaattagctgagcgtggtggcgtgtgcctgtagtcccagctactcaggaggctgtggcaggagaatctcttaaacctgggagacagagattgcagtgagccaagatcgtgccactgcactccagcctggcgacagagcgagactccatttcaaaaaaaaaaaaaagaaaaagaaaaaaatctacaagccagctggccatttctgatcttggctggcatctcttgcatgcttgagggttgactagctgtaaactcatttaaagtagcctatgttgcagaatatgagctcttttcgctatagtctctcatcctctagaaggctagtccaggcttggagggagagagtgggtgagacagagagagggcaggcatgagagcgagcacagaagcatgcacggcctcttgagtggggggcatcatcacttcagagtgtcactctctggctcaattaagaaggtgtggctaggttgggcacagtgcctcatgcctgtaatcccagcactttgggagaccgaggtgggtggatcatttgagggcaggagtttgagaccagtgtggctgatatggtgaaaccccatctctaataaaagtaaaaaaattagccagcatggtggtgagcgcctgtagtctcagctacttgggaggctgaggcaggagaatcgcttgaacctgtggagtggaggttgcagtgagctgagattgagccattgcactctagcctgggtgttccggtgagactctgtctcaaacattaaaaaaaaagtgtggttgaaaataaatgaaataaatgtaggacaaagagaaaaggaagaggaaaataaggtctcattgtacataatctgtgaagtgactcaataaaataaagctattcttttttattttataaatgtgaaaactgagaccctccacgtaaacagacatttatgttttgccaaattttctccttttttttttcctttttgtggagaatgggggtctcactatgttgtccaggctggtcttgactcccaaggtcaagcagaatgctttgcctccctaaatgctgaaattactgatgtcatcaacagtgcccaaaccaaattttctaataataatggacatatgtgttccctgagattatggtggtttggatggtccagtggctaaagtgtgtctatttccaaactcaatttatttatttatttatttctgagatggagccttgctctttcacccaggctggagtgcagtagtgtgatctcgactcaccgcaacctctgcctcctgagttcaagtgattcccctgcctcagcctaccgagtagctgggattacaggtgtgcgccaccatgcccagctaatttttgtatttttagtagagacaggatttcaccatgttggtcaggctggtctgaaatgcctgaccttgtgatctagccgcctcagcctcccaaagtgctgggattacaggcatgagccaccacgcctgaccttccaaactcaaatttatattctcattgttctttctttctctttctttttctttctttctctttctttctttttctttctttctttctttctttctttctttctttctttttctctttctttctttccttttctttttttgagacaggtttcactctgttatccaagctggagtgcagtggcacggtctcggcttactgcagcctcaacctcccaggttcaactgatcctcccacctcagcctcccgagtagctgcgactacaggtgcgtgccactacaccctcttttgtagagacgagatttcaccatgtggtccagactgttctcaaactcctaagacagagcaagaccttgtctctaaaaataataataaaataaattaagataatggagataaaacaaaagtacttgatgaccatttctatcagttccattctatctcctctctgaggttgtcattacaataggtttctcataatttttgtagtctactctctatatattcataaattataattttgagttataaagaaaagtgtgttgtgtatatatgtatgtgtgtatgtatatatatatatatctacatgtacatatatatatatatatatatatatatatatatatttttttttttttaaatggagtctcactttttctcccaggctggagtgcagtggcgtggtcttggctcactgcaacctccacctcctgggttcaagcgattctcctgcctcagcctcctgagtagctgggattacaggtgtgtgccaccacaccagctaattttttgtatttttagtagagacagggtttcaccatgttgaccaggctggtcttgaactcgtgacctcaagtgatccgcccgcctgccttggcctcccaaagtgctgggattacaagcatgagccaccacacctggccagaaaagtatattttacatgtcacattaccctgctgaaaagacttcattttcagtgacatactctaaactaaaataaaattaatttacaaaagagaggtatgttgtgcatacaatgtgccacacattattgtagtgtattaatgcctttacattaataaatcaatataattagtgccttacattaatacattcatgtaataaatttacaaaccctattataaagtaggtattcatttttgtgtgtgtggcaaggtctcattctgttgcccaggctggagtgcactggcataatctcagctcactgcaacttctgcctcctggggttcaagcgattctcctacctcagccttttgagtagctgggattacaggtgcttgccaccatatctggctaatttttgtatttttggtagagacagggtttcaccatgttggccaggctggtctcaaacttctgacttcaagcgatccgctcgccttggcctcccaaagtgctgggaatacaggcgtgagccaccacacctggccaaaagtacgtactcttaacattccccctaccccactttttttttttttttttttttttgagacagagtttcactcttgttgcccaggctggagtgcaatggcgcaatcttggctcactgcaacctcctgcctcccaggttcaagtgattctcctgcctcagcctccagagtagctgggattacaggcatgcgccaccatacctggctaattttgtatttttagtagagatggggtttctccatgttcgtcaggctgatctcgaactcctgacctcaggtgatccacccacctcagcctcccgaagtgctgggattacaggtgtgagccaccacatctggccacattccccttttatgcttgatgaaactgaggtgggctgggtgtggtggcttccacctataattctagcactttgggaggctgaggtgcggaggatcacttgagccaaggagtttgagattagccttagcaacatagcaagaccccatctgtatttaaaaaattaaaaaattttaaaaaagaaattgaggtgaagagtttgggtaataggttcataatcacattcctagaaaagtatagttttatctttttttttttttttttaaacagagtctcgctctgttgcccaggctggagggcaggggcgcgatctcggctcactgcaagttctgcctcccaggttcatgccattctcctgcctcagcctcctgagtagctgggactgcaggcacccgccaccacacccagctattttttttttttttgtatttttagtagatatggggtttcaccatgttagacaggatggtcttgttctcctgacctcgtgatccacctgccttggcctcccaaagtgctggaattaaaggcgtgagccaccgtgcccggcctgaaaagtactgttttaaaagcaaaatttctactgttgaacatatatcaagattactgcttaaaacttttccacagtgcaacttgcatattatggactccttgagctaattgaataagaaatagatcaaagttttcagaagacagcatgtatacatttaaatttctggaagaaatgcgccccacatggatgtgagttttcctgggatattattggtagttgtccatatatgatgtttccttgacttaatcttccttatcacattgccctaaaaaataacttaggtctgcatttataattattgaagtatttgtaacacaaagtatatcctggttccaggctttttatttttccttatctgataccaaactgatctatagtttctttaattttcattttagccaaggctgactgaaaatactttcaagtatataatgtttatttccacagtactctgatgaatagggtatcctttgtgactcctcagccacatattttaatcagcatcagtgattccagcgtgtccttgataccacaggaccaagccagttccagcaagctctgttcccctgtgccctctctgtagtctgtatctcttctcagggagcccacttgtccttccctaagagggtagttaccaggtgtgaatataacagacctaaatctaggactaaatatcttgtatgttggtcatatttgattgagatgggttttcctggaatagaatcaggaggctgatgagctgggtatggtggtgcacatttagtcccagctactgtgaaggctgaggcaggaggatcccttgagcccaggtgttagacaccagcctgggcaacatagcgagacctcgtgatctgcccgccttggcatcccaaagtgctgggattacaggcatgagccaccgcacctggccttccaaaatcaaatttatattttctttctttctttctttttcttttcttttcttttcttttttttttttttttttttttttttgagacaggtttcactctgttatccaagctggagtgcagtggcgcggtctcagcttactgcagcctcaacctcccaggttcaactgattctcccacctcagcctcccgagtagctgggaatacaggtgcgtgccactacacccttttttgtagagacgggatttcaccatgtttttgtagagacgggatttcaccatgtggtccagactggtctcgaactcctaagacagagcaagaccttatcttactgcaacctccgcctcccgtgttcaagtgattcccctgcctcagcctaccgagtagctgggattacaggcatgcaccaccatgcccagctaatttttgtatttttagtagagatggagtttcaccatgttggtcaggctggtctcgaacacctgacctcatctctaaaaataataataaaataaataaacaaaataaattaagataatggaggtaaaacaaaagtactcaaccatttctatcagttccattctactgcctctctgaggttgtcattgcaataggttctcataatttttgtagtctactctctatatattcataaatcataattttgagttataaagaaaagtgtgtgtgtgtgtgtgtgtgtgtgtgtatatatatatattttttttttttttttgagatgaagtctcactttttcgcccaggttggagtgcagtggtgcggacttgactcaccgcaacctccgcctcctgggttcaagtgattctcctgcatcagcctcctgagtagctgggattacaggtgtgtgccaccacacctggctaattttttgtatttttagtagagacagtcctatttcaagggacattttgaataaatacagaagcaagctaatgattcaaaagtatgtaaaaagctaaaaacacacacaaaaacccactgcttcctttactgtatcatctatatgttttttatttaatttacttttattatatgttgtgtttagatacacacaaatagatagcaagtttattattattatttcttttttgaggccgagtctcgctctgttgcccaggagtgcaatggcatgatctcagctcactgcaacctctgcctcccgggttcaagcgactctcgtgcctcaagtagctgggcttacaggcacacatcaccactccaggctaatttttgtatttttagtaaagatggggtttcgccatgttggctaggctggtctcaaactcctgacctcaagtggtctgcccaaagtgctgggattacaggtgtgagccaccatgcctggccaaaatagtaagtttaaagcttctaactttacttttaataggtaattaaacaatgtatatatgacattgaatgcaacacattaataaaatgtaacaattttgttaagcagacaaaatataatccaatgagatggtttacattctttgttcatagcaagactttaaaatccagtgaatactttacactttgcatatctcagtctagatgctaaatatttcatgagaaatacttgatctgcatttagatttcataaaatcacagttgaaaaaaggttgacgaacccaagttgttccaagcatactagtttcccaataattgcactatcagtttttaattttaaattaacatttaataaaattaaaaattacaggcacagtggctcatacctgtaattctagcactttgggaggtggaggtgggaggatgacttgagcccaggggtttgagaccagcctggacaacgtagcaaaacctcatctctacacacacacacacaaaaattagccaggcatggtgtgtgcacctctagtcccagctactcgggaggctgaggtgggagaatcacttgagccagggagatggcagttgcagtgagctataatcaagcaactgcactgcaatccagcctgggctggtgagggagactctgtaaaaaaaaaaaatcagctcctcagtggaactagccacatttcccatgattaatagtcatttgaagcagtggctactgtattgaacagaacagctctagagagtaattgggtggttggggaacagggatggtttcaattttgtactatttgtacatattgcttttccaaataaatgaataaatcaagttcttatttttaaacaatttacagtttgtaaattgttatttttaaacaatttacagtaagtagttaggttatggaagtcacaaatgcacccctatgggatgagtgtggggggaaagtggttatcttaatattatataaataagtttcctgtggcttagaacaaaattcccagtaacagtattccacagacacattccagaaatattgtatcacaaactacttatttgaaagtaaagaattagtgcctggtaaaacgatgttatttaattaaaagaacaggctcagaatatttaagatatggctatctaaggtaaatacagtttgagtagaataattttattaaatgtgagcagaaaaaaatcaatatttctaagtatattggatttcacatatatatatgaactgaaaaaataagatattataagtttagaaatatgtacatttaaagtgggattaaatatgttttatataggttattttcatctacgttcgtaagtggcattgcctatagttttatctatagtgtttatttttgcctgattttagtattggtattatggacttttaagtacaagaagggaggtccaagtgaggacctttcctccttttacttttattttatttatttttctagagccagggtctctctctgttgcccatgctggagtgcagtgacatgatagtagctcacaatagccttgatctcctgggttaaagtgatcctcccacctcagcctcccatagctgggaccacaggcatgtgctaccatgcccacctaatttttaaacattttctgtagagacagggtctcattatatttctcaggctggtcttaaattcctggcctcaagcaattttcctgccttggcctcccaaagtgctgggattataggtgtgagccactgtgcatggccaaattttgataattgcgggattttttttttttttttttttttgagacagaatcttgctctgtcacccaggctagagtgcaatgcaatgatctcggttcactgcaacctccacctccagggttcaagcaattctcgtgcctcagcctccctagtagctgggattacaggcatgcaccactatgcctggctaatttttgtagttttagtggagacagggttttgccgtgttggccaggctggtctcaaactcctgacttcaagtgattcacctgcctcagcctcccaaagtgctgggattacaggtgtgagtcaccacacctggctgataattgcatttttaaagaaaaaacccttttcctttccattgccattaaaaaactatactttttcaatcttctatacatatttatttttattttgttttattttattttattttattttattttgagacagggtctcactctgtcacccaggctgacacatgattgtgcagtgacacaattatggttcactgcagcctcaacctcccaggctcaggcaattctcccacctcagcctcaagaatagttattatgcggtgacaatcatggttcactacagcctcaacctcctggctcaagcaatcctcccacctcagcctcaagaatagttgggaccacaggtacatgcaaccatgcccagctaattttttaatttttcatagagacagggtctccctacactccccaggctggtctccaactcctccagtcatgtgatgctcttaccttggcctcccataagtgctgggattacaggtgtgagcacattgtgctgaccacgtttgatttcttttccccaaagtagtgaatagagcctcagaaatcccataaaagaaaaagctctaccaggcacggtggttcacatctgtaatcccaacactttgggaggccaaggcaggaggatcacttgagcccaggagttcaacatcagcctgagcaatgtaaggaaaccccatctctgtgaaagaaaaagttttttaattagccaggaggggtgatagtgcctgtagtcctagctactcaggaggatgaagccagaggattgcaggagcacaagagttcaaggttacaatgaactatgatcgtgccacagcattcagcctgggcaatagagcaagaccccgtctctaaaaaaagagagagagacagagagagaggaaggaaggaaggaaggaaggaaggaaggaaggaaggaaggaaggaaggaaggaaggaaggaaagaaaagaagagcaaagcaaagcaaagcaaagaaaagagcctatttgccagatgagatggactggattcctgaacaaataaatgaagagaggaaacccatttagaagagtgggttatattcagttgcaaagacatggggtttattcctagttttttctatttcataattaaaaaaatttttggctagctcttgcacagaatattcctagtttctagaataacaaaagtgtgaaaaagatgagaagacagaagctactatccactgtcctgaggttaggtagggtagaaagactgagtaccagagaataaaagtaaaacagaaaacttttcagtgcagtcagggcagactgaaactcaagggagccagtttccagagtgaacagactgagtacacagaaaattgaagaggtaactcatgtcctatcagagacaaaatctcagaaagcggaggacagagcattgttacacagggctcagccattcagactcaagacctgggatctgcattttctggatcctaagcctggttggaggaaaggcatgagagattcaccatggtgatttgttttttggtttttgtttttttggttggggggagagattggtaatgtaaatgtaaccaccccttctttatctctgccctgaagcaatacggagaaggcataaagaacgtacttctttcacccaccaacagtatgaggagctagaagctctgtttagccagaccatgttcccagatagaaatcttcaggagaaactagctttgagactcgacctaccggagtcaacagtaaaggtctgatcccctgtggtgtgcttggtacccccatccaagccacattcacctatccagcctggaaattccccaccctctacccctgccccacaataatatttcattaattgagtacctactgaaacggtatcaaactggggacatcgcaaatactggcctcactctcatgcagtttgaaaaatgagaaaaaatgaggttcagaggcaaagtgactgggccacagagataagaaatagtgttgctagaactaaaaccccagaaatcttatttttaatacttgtactatagagttcaaatagcggaaaggtgctcatccagacagactcctcgcttagagtctttttaagcaaagccctgcaatctgtttattcataatgctaccaacagacaaataatactccctctaacctctgagtctgctaaagcccatgacgtttttcttttttctctttttttcagagatggggtctcactatgttgcccaggctggtctcaaactcctgagctcaagtgatcctctcacctcagactctcaaagtgctgggattacaggtgtgagccaccgtgactggccatacatttttactggagtattccttataggagaggcctcctaaaataatccttaaaaatccttcagttcaaattcttcacctctccctagatcctagatccctaaactagcctctcttctctagagttcaggaccctatctctgaacacccagcacaaaccctgaaacacacccgcttccttcctttctggggtcccagacctgatcttcatcatccctcctactgactccagtcatgcccatctctgcttttgcagagcccagtgtcatggtgaattagagaggacatgaagattataacctggctgttttcactcaggagaatcctccaatgcctcctccaataacagaccacaatctccccctcttcccctactcccaggtttggttcaggaaccggcgattcaaattgaagaagcagcagcagcagcaatcagcaaagcaacgaaaccagatccttccatccaagaagaatgtgcccacctcccccagaacatcccccagtccttatgctttttctcctgtgatttcagatttctacagctcccttccatctcagcccttagacccttccaattgggcatggaactctaccttcactgagagttctaccagtgacttccaaatgcaagatactcagtgggagaggctggtggcctcggttcctgctttgtactctgatgcctatgacatattccaaatcatagaactgtacaatcttcctgatgagaatgagatatccagctcttctttccactgtctgtatcagtatctctcacccacaaagtaccaggtaggaggacagggttcctctctcagcatctttgctggtccagctgtaggcctatctcctgcacaaacctggcccaatatgacaagccaagcctttgaagcctacagtctaacagatagcctggaattccagaaaacctccaatatggtagacttgggatttctctgaccagagtactaataaatatagatcatttagaaaagtggtcttcttgcctcttgtacatgactgtttttttcctttgtctcattttaacccaacatctgggtctgtgtctctgatttccatgtaaatgttgcaaaaagagttttccaagtagagctgggcactacgtaatcagccccacaagtctccctgagaagcctgcctagtccctttcatggccaatgagactccaaaattcccttcccaaaactatcttggattttctaaaagtaggacagtggttttgggggttatccacttttatttttttgaaactagctctcattctgtcacccaggctggaatacagtggtacagtcacggctcacaaaagccttgacctcctgggctcaggtgatcctcccacctcagcctcctgagtagctaggactacagatgctcgccaccacacctggctaattttttttttttgagactgagtctcgcactgtcacccagggtggagtgcagtggcgggatctcagctcagtgcaacctccacctcctggggttcaagtgattctcctgtgtcagcctcctgagtagctgggattacaggcgtgtgccaccatgcctggctaacttttgtatttttagtagagacggggtttcaccacgttgcccaggctggtcttgaactcctgacctccagtgatccgcctgccttgacctcccaaagtgctgggattacagacatgagccaccgagcctggccaatttttgtgttttttgtagagacgaggttttgccatgttgcccaggctggtctccaactcctggacttaacgccatccacctgccacagcctcccaaagtgctaggaatacaggagtgcaccatcgcacccggctgggttatctagtttaaaaacactttttttcaaggaaaccgaagaaaccatcatccacttttctctctgtatcattctgattttagtatatgtgttgtggaagtgagtacactatcatccacttttaatgacagaaagttataaacttacattttgtttccaatttttcattttttgtttgttatttgttttttgtagacagcactctgtcacccaggctggagtgcagtggcaccatcttggctcactgcagcctctgcctcctgggctcaaacagtcctcccacctcagccttctgagtagctgagactacagacatgcgccaccatgtctggctaatttttgtatttttagtggagatggggtttcgccttgttgcccaggctgaatttgggtttttttaaaatgagactttcagtcctaatttgaggggaaattactgtcaccactagttttaatatagtacaatgaaaaaataatatatatatatatagtacaatggtccagacataataagaggtgtaaaaactatcacaggaagaaataaaaacagatttttgaaggtgagatgataaacttgcaaaactcacaaaataaagagtcaaacttttagaatgacaagttagcatattttccagccacatgatcaacctacaaaattaataccatttctgaacaccagtaataaagaaacataagggctgggggtggtggctcatgcctgtaatcccagcactttgggaggccgaggcgggcggatcacgaggtcaggagattgagaccagcctgactaacatggtgaaatcccgtctctactaaaaatacaaaaaaaaaaaaaaaaaaaagccaggcatggtggcacacacctgtaatcccagctactcgggaggctgaggaaggagaattgcttgaacctgggaggtggaggttgcagtgagctgaggtcgcaccactgcactccagcctggacaacagagcaagactctgtctcaaaaaaaaaataaaaaataaaaaataaaaaataaaagaaacataagataagtacctctcaatgaaaaatgtaaaagtacctagaaattcacaaaaaaattaatacctctgtggagaaaacttcaaaacttaaaaaaggacatagaaaatgttttgaataggccaggcgcagtggctcacacctgtaatcccagcacgttgggaggccaaggcgggcagatcacgaggtcaagagatcaagaccatcctggccaacatggtgaaatcctgcctctactaaaaatacaaaaaaaaaaaaaaattagctgggcatggtggcacacacctgtagtcccagctacttgggaggctgaggcaggagaatcacaaggattgaaactatgcagtgtgttctccaaacatgatggaacgaaattagaaatcaataaaatttgggaaattcacaaatatgtggatattaaacaacacattcctaaataaccagtggttaaagaggtaatcacagtctgagcaacatggcaaaaccctgtgtctacaaaaaataaaaaattagctgggcatgacggccagagcccatggtcccagctactcgagaggctgaggtaagagcatcccttgagccacagaggtcgaggctgcagtgagctgtgactgtgccactgcactccagcttgagcaacacagtgatactgtctcaataaataaataaatagaagaaatcatgagtaaaattggaaaacacttttaactgaaaaaaacaaaagcacaacaaaccaaaacatgggatgaagctaaatcaatgcttagaaggaaatttatagcttcaaatacttatatacatattttttaaaagtagctttacataggaaggaagtggcatagttttatcaatatctgtcaaattaaacttcaaggcaaaacttttttattgagatggagtcttgctctgtcacccaggccgtgcaatctcggctcactgcaacctccgcctcctgggtcaaatgattctcctgctttagcctcccaagtagctgggactacaggtgtacgccaccacacccagctaatttttgtatttttagtagggacaggttttgccatgttgcccaggctggcctcaaactcctgagctcaagtgatcctcccgtctcagcctcccaaagggctgagattacaggtgtgagctacctcacctggccaaaacagtttttttagaaatgaagtatattagacaacaacaaaaggaacaactaacctgaaatatataataactttgaacttaaatatacttaacaacatataccaaaaatatatgaggcaaattttagcaaaaattaaaattcttaagaaaacttcactaatatatagtcataatgtggtatattcatagaacattctcaataattgataataacagtccaaagaaagcagaaagaaggaaagcctagaacagaaataaatgaaatagagaatagaaaagcaatacagaaaaaaaattatgaaatcaaaagctggttctttgaaaagatctacaaaatggcaaacatttagctagattgaccaccccctcaaaagactcaaattactagaatcagaaacaaaagtcaagattttattaccaaacttatagaaataaaaattattagaaagaaatactatgaacaattgaatgccaacaaattagataaatgaaatggacaaattcctaggaagacacagaataccaaatctgactccacaagaaatagatgttgtgaatagagcttgctatggtatgaatgtgtcccccacagctcatgcgttggaaacttaatccccaaagcaacagctttgagaggtgagacctttaagggttactaggcagagcccccatgaatggattaatgccattattgtgggagtgggttagttatctcagaagtgggttcctgataaaaggatgagttcggccttcttcttccccaaaatctttatccccacccccacctctatctttctctctctctcttacctcctcctctcccttccttctgccatgggaggatgaaacatgaaggccctggccaggtgtggcccctccatcttccgtctgagactggaagacttcccagccttcagaactgtaagaaataaatctctcttcataaattacccagtctcaggtattctgttataacaacacaaaaacagactgagacagagttataacaagcacagagattgagttaacaattgaaaacttcccacaaagaaaagcccagtcccagatggcttcactgctaaattctaccaaaatgtttaaagaagaattaacaccaatccttcataaacttttccaaaaaaaacaaaagaggagggaactcattttatgagatcgatattatctggataccaaagctgaacaaagacgccataagggaactacagattatagtgagtatcccctattggaaatgcttggaaccagaagcgtttcagatttggagtttttggaatatttgcacatacataatgagatatcttggggatgggacaccagcctaaacacaactcatttatgtttcatatacaccttatatacatagcctgaaggtaattgcacaatattttaagtaactctgtggatgaaacaaagtttcgagtgcgttttgactatgacccaccatatgaggccaagtgtggaactttcctcttgtggtgtcacatcagcactcaaataattttggattttaaagcattttggaattcagatttcagattggggatactcaacctgtaatacctcttctgaatatagacgcaaaaatcctcaataagatccttttgtagttcatgaatgtgatgattgggcattcacgtggatgtgtgagtgctaccctcgaagcttgtttcaacattggcacattatgcatctgacttgaaaaaacaaattctcaataaaatactaacaaactaaatttagcaacatataaaaaggatagataccatgaccaagtagggtttattcaggaatggaagattgattcaacataaaaaaattcatcaatgtaatacacgatattaatagaataaaggacaaaaaccacatgatcatcttgctgggcacagaaaaagcatttgatgaagatccacactctttcttgattcactcaacaaactagaacaaactatcaaactcctctccttcaacttgataaaggccatctacaaaaatccacaggtaacattgtacttattggtggaagactgaatgcttcccccctaagatcaggaacaagtgaagtgtggccactctcaccactcttgttaaacatagtgctggaagttctaggcagggaaaaacagcaagaaaaggaagttaaaggcatccaaatcgcaaagaaagaagttaaaatatttttgttaacagatggcatggtcttgaaaatcctaaggaatccacaagaaaactattagaactaataaaccagttcagcaaagtttcaagatacaagatcagtgtagaaattttttacaattttcaactgctatttgctcattccaaataagtttacctccaaggacatatatgtatgaagaatccaggggaaaggttaattcgatggctgttaatcacagccaaatttagcacatctgctgttagtcaaaatacattcaaatacattcaaataacagctggcattgtggagcacttggcatgtggtacatatcattcatgtgccttatgtgtactgacacagttacctgtggtcgcaccaagtatcatcgccatttcacaatggggaaaactgaaatagaaaatggttaagtaaatttgtcaaaatcacatacctaatcccagcactttgggaggctgaggtgggaggatcatgaggtcaggatttcgagaccagcgtgacaaacatggtgaaaccccgtctctgctaaaaatacaaaaattagccaggtatggtggtacgtgcctgtaatcccagatactcaggaggctgaggcaggagaatcacttgaagccaggaggtggaggttgcagtgagccgagatcacgccactgcactctatcctgggcaacagagcgagactctgtctcaaaaaaaaaaaaaagaaaaagaaaacaccaaagccgggattctatatttttttcactcacaagatcctgaatgagtttatctgaagatgataagataaagaacgctagactgagagttaaacaagctctctggggctttcctctggctcttccactaacgagatgtgtgaccttggatgagcaatttcccttttctgaatctctgtctcctcatctgtaaaaagagggagctggactaaatgacagctaaagcctcctacaacctctaattctctcacactggatttactctacacctggtatctgaattacaaactctcccttttccaggaaagatgaaaggaccaggggaggacagacacttacttgtcacgacaagagataggagaaactgaagcaggacaccatgtcatttgcacaagttgctgcttcagccagtgatgggtttaggtgaggagcatggttataattagagcagcagccagtcctgaaggctgtgccagcctccttcagcacagctgggcctgccgactgcacatgcaggaatctgagaggctgttctggccttgaaaatgatccttcttaaaaggattttcctccttcctcaagggaaagaaaacctattgatataaaacttcacttcccattcagtttcccctgctaaatgccactccagtagagactgagtgttgataaatacaggggaaggaaaaagtcgtaagctgagcctggtcacattgccccttgtgatatcgttttatttttaacttcgcaacacttggactatttctgttgaagttttctctcctttccctgccttcccaacagaacgctgtcctctactgcagctgatgcaacccagccacctcccggcaatccgcttacttgcaatcaagggttcaggtgcaagcagatgctgactcagcctgttccattaaggtaagtattcaaacaggagcaggtgcaccatgacgaggacattcagtggtgaatatgcagatgaagctgagccgcatatcacttttgtgtcctgtggaagaggattgttaagcaaattagttatgtaaagatgtgggggaaaggctggcactgagaatgagatccagccgtgtgtaaatttctgtttccatttcaagagcaggtagagtacttgctttctgacagcttaggttctttcttctataatcaacaagagtagttatgatatctgtaaagttacaacatggtgatgggtggggggatctggggaagtggaggaggtggtgaggaaacaagtggaaggcctagaatccaggatttctattcccttttctttcttttttgagacagtcttgctctgtcacccaggctggagtgcagtggcaccatcttggctcactgcagcccctacctcccaggttctagtgattctcctgcctcagccttccgagtagctgagactacaggcacatgccaccacatccggccaatttttgtatttttttagtagagacagagtttcaccttgatggctaggctggtcttgaactcctggcctcaaatgatccgcccacctcagcctccaaaagcgctgggattacaggtctgagccactgtgcctggcccagaatttctattatttatttatttatttaattcattgttattatttttttgagacagagtctcactctgttgcccaggctggagtgcagtggtgcagtctcagctcactgcaacctccaccttctaggttcaagagagcctcctgcttcagcctcctgagtagctgggactacaggcctgtgccaccacgcctggctaatttttgtatttttagtagagatggggtttcaccatgttggccaggctggtcttgaactcctggcctcaagtgatccacccgcttcggcctcccaaagtgctgagaatacaagcatgagccgctgtgcctgatcagaatttctgttttctaaagtctaaatgctgtgatcttttctccagtcaacatttgctatgtttgcttgcaagtcattctcatgtagcttaaaatttcgtctgctgtgtcatactactggttaataagcacaactgtattttctgtatatactattcaaactccgcagagtttaacacctttttttcgccaacaatattctctaagtgtggccctcttctccccagctctcttgagtccaaaatgcatccatgaaatataagtgaaatatttctcaagttgaaaaacttatataggcttatgcaccaaaaccaaagattgttacaagcttgaacaattttgcatattcagagggataaaagtaaaatgactaatgatacttgaggtatcaaaagttataactttagacagatagtttctcgcttctggaataactgtatagtgttgcatgcactaaaaattggcaaggtaagggagcagtgtttattttcttgtttttcactggttcaaagttcagctaaggacatcctgggaagtggcctatgcagcaaaagggattctgtacactctgacctttgatgtgtacaggctaaagccaccgatgccaagtaaaaggagacctaaactaactattcagataccttaactcctggttccttcctgcctgtctctgtaacctccatatgtaccccaagactctgctataggtgtctgggttatcattatgcctgtttcctgggcacaagcaaattcactgtgtataatcacctaacttcatttaatttttccagggcctccacagcaccaaggtctccaaggtgtatgctgggatgctgtcctggtgaaactagggtgtgttggcttacaagtaaccaagcagacagattgagtcccagctacccctagataatccagttactttagcactatcttggccaatgcaactgtaatttaatagaatagtactgatacaaaagcaccagatataagaattaactagctaattcaataactaataagtataaagttagagagatttctagtataggtggaaaacttcagattgtgaagtggaatggatctgggagagggtggttctgttttaggatacagtgaaggtactggaatcgcagcgtcgaagccaaggattatggaacccaatgtgggaattagcctcagcaaagtgattgtgttaaaatctcaagaaggcaaagagattactttaataattatctttatacattttctttccctacaattaaatatttccatagcagggaaacaggtcaacaatgcataattaaagtaactaattaattggctggttaacaggttaagagttaaaaaatctttgacctttaacttttaaccttgtcactttcactgaagttaaagctcagaaataaatcattattgccagcgccagccacatgaggaggcagaatagtttagttactgacatcatgtgaggggtgctgagagggccccttgcctaaaaatatctccctgacatcaaccctgtttgcctactaactttaaaattatagaaaagaatgttaaaactattgtttgttaatcccattctcttttgcttgagtcagtgatttaaatacacctgctatacgtgttagcatgactttgttgaccagcaacacttggtcaccacctcctcctccttcttccacgctttgtcctactctgcccttggtaccatctaagctgccaacatgccttggctgtcaccactcaggtagctttgtgtggtgctgtgatttctacagactctttcaataaaacatcaaagcacaatagaaaaaaagcacgtgactagagccagagactctgggagcataggcaagacatttcacttctcagagcctcagtttctcctctaggaaacaaggaggttaaaacagaccctttcctttcaaaatgaggtccttagaccatcagcttcatctggattttgttacaaggaaagagtctcaggcctcaccctggtcccactggatcagaatctgcattttaaaaagtttgcccgggtgattcctttgcatgttgaagtttgagaagctatggaatatggatttcttaatatctgcctgatccagatttcggattctgtgcctgtcaagtgtttaaaagaacaagtactttaatcccctgcaaacaatctggcagtgctcagattatctattataaatccagcccactgaggtcttttcttcaatgaggcctacattaacctaagttgaaatgatttccttttcaccttaaaaaaaaaagcagccccaattagcatacatctgacaccactctactttcttcctaaatttgtttcaaattactctcgcagcttttaaaatgctgcctttttaagggttcagtttaattcagttcaatcctattcaatgttctcgttgactgagtgctgggggcagtgtttgctctactcactctcagtccctagaagcccatttggtgggtccttaagaagtattatcaccctctgttgatattccggtcagacctccttccactgcctgcacacacctcgctggcgacaacacttgtgcccatcattggaacctctctcaccattctcaccatcacagcaactttgccaggttctgccaactgccacagccaatcacaagagagaaggcaagtctcaaggaccacactttccttttttcttgatgagcagaataatgcagatgagcaaaaaaatttacaaattttggcctaggaaacaaagatgccttcaagttgtctttatggcatctacaaagtttcagtcctaaagcagtactatttgaattcctaagtgcttaaggaatggctcgtggtgattaaagggggccgaaagtggggggaagtgtggaggcttacattcttaaaagagtgaggaaataatttttaaaaaatagaatttgaatatcatcaaactgacagtggaatataagatacattggagtgagggggactgaaaatggaaagaccagacatggctacaggagggcagtgggaacacatgaaggcctggaggagggaggtgaccatgagaatgaccttcctcatagagtgactcatctattacacactccctatttcatctcattggatccttgtgcaaccctattggttattataggcccccttttttttttttttttttttgagacagaatttcactctgttgcccaggctggagtgcagtggcatgatcttggctcaccacaacctctgcctcccaggttcaagtggttcttgagcctcagtctcccgagcgtctgggattacaggtgcctgacaccacacccggctacttttttgtatttttagtagagacagggtttctccatgttggccaggctggtgtcaaactcctgacctcaagtgatccacctgccttggcctcccaaagtgctgggattacaggtgtcagccaccgtgccctgcttataagtcctacttttgaattaataaattagctttaggtagattaacttgtcaaaaatcactcagcttattcatgggagtgctcattgatttactttatattgggggtgtcaggtaaggactctctgtggaggtaacatgtaagcagaaaactaagtggcaagaaggagtccacagagcaaatacagaacaagaggagaattctcgtagaaagagcaggtacacaggccctgtgctggaataagtgacaagaccagagcaaagtgcataagggtgggaggtcaggcaaaagagcaagcaagggagagctcatgcatggcctcatgggccaagagaaggacttcagagtttatttccttgtgaagggaatccactggaagttttaagttggggagtaataacctagttttgtaaattgtgaaaaattacgccttctgctggtaaatattgccaatccattctccccaaaataggagctttaaaattcccctgtcttagcagtcaacataatatgatttagatttaaatactacaaagattcatacagagctagatttttctagatgtgctagatgtagtttaaatggaatatgagttggtggaaggacctggtgtgtgaactgagacatggtgcaaaatagaaggagtgagactgattataaacccattgcactacaccgggtgagcaaggatgatgcctggcattgggcagtggtggagatggaaagaagtgggcagaatttgcccactccttttccagatcttttgtcaaggccttcccacctaattggcaatcctcccaccttggtctcccacagtgctgggattacaggcatgagccactgaactgggcccaatttacacctttctgcgtggtccacacagcaccacaatctgcatcaaatcaagttgctgcccccttgccaggtgctaaatgcttccctatttctttgaaaaacaagctatgcctcaggctcacacacctggtccttccaccagcctatgtttcatttaaactacgtccagcacattccgtgtagatcttgggactatttaaatctaaactatattagtttgactgctaactcctctagacaggggaactttaaaactcatattttggagaaaatgtgttgaccatatatttaactgtagttcatttttaagaggatagaacatactgctttttcagacaagaagcaagaatttaaatgtgaacacaggggccaggggtggtggctcacacctgtaatcctagcacgttgggaggccgaggtgggcggatcacctgaggcccggagtttgagaccagcctggccaacatggcaaaaccccgtctctactaaaaatgcaaaaattagttgagtgtgatggtgcatgcctgtaatcccagctactcaggaggctgaggaaggagagtcacttgaaccagggaggtggaggttgcagtaagccaagatcgtgccactgcactccagcctgggcaacaggagcgagactctgactcaaaaaaaaaaaaaaaaaaagtgaatacaaggcatagtaattaaaagggaaatggcacctggatagccatactctgtctcaggcatagatttttgtcaaccttttcacagtgaagaatttctataatctgagtgctttgatctagtaggtatttcattttaaatatcagaatccatattgtagtgcatacacacacacacacacatgcacacacacacacacacacacacacacacacatatatatatatatatatatttttttttttttttggagacggagtctcactctggtgcccaggctggagtgcagtggcacaatctccactcactgcaaactctgcctcccgggttcaagagattctcatgcctcagcctcccaagtagctgggattacaagtgtgcactatcatgcctggataatttttgtatttttagtagagatgaggtttttccatgctgaccaaactggtctcaaactcctgacctcaggtgatctgcctgcctcagcctcccaaagtggtgggattacaggcataagccaccatgccctgtctaaacacacatatatatatacacacacacacaggatcttgctgtgttgcccaggctggagtgcagtggcatgatcacggctcactgtagcttcaatctcccaggctcaagcaatcctcctgtgccagccctccaagcagctaagactacaggcatgtgtcacacttggctgatttttttttttttttttttttttttagtagagacgaggtcttgctgtgttgcccaggctgatctcaatctcctgagctcaagcaatctcccaccttggcctcccaatgtgctgagattacagacatttgcctcagcacctgacttatgtagtgcatagtttttaaccctacaaccttccctttcacagttatatcctctgaaatgcaaagccattgggcctggatgttccttttgttttctgtactcagagagggcacagtatgggatatgatccaaagaagtatcaaaataatcgccataaggaaggaggggcttcttaaggaagggcatctggctcctttacaacctgaaaagattaataatacatgtggacactattctgtgccccaactctagcgatgggcttgcatttttcccacaccatgtggatcaaacacctgtgtctccatgggcctttgagggccaagtgtgatgtagcaaagagtatagagtttgaagacagacaggcctaggcctctttgtgcctcagaatccttattcataaattggaaatggtagtacccacctcacatggttgttgtgagaattaaatgaggtgttatgtaaaagcataggaaaggcactaaaatttcatttctctgcctccgtgacacccaaaatgcagagaaatctctcaatctaggaaagtcacacaaaccccatgggggataaggatcctgttactgggcacaggaacagagaagattgggagaacaggtcatcttctatcacaaggcaaccaatgatatatctaatttgatcattttggggcaacaccagttggttcctacttaaggtgatcaatcaactgtccagatttgcccggaactcaggcattttctgggatatgggactttcagtgctaaaccaggagagtcctaggcaaaccaggacaaattggtcatcacacttacccagccatgattagactatcgagagttccagattgacccttatatcagtgagaacaatttcccccccatacacaacaaaggctcagatgtgatttgtttatagatgtgaggctatttcatcttcccccttcctttcattgtcaaacttctctggagtggtctccactcaccgtgcctttctgctctgtacatgtcctctctcaaagtcactcatcgggtgtagctccaaagcctggtaggagagctttaaatagcaacatgaaaaaaaaaaagcgtctttgttatctcttaaagggacattttcaagtaacttcaaggagctggagaacaataaggctgcacaacaaatgtttccagcttcaataatactgttcccaagaaccatactccatagtgctgaagggtaagaaatgatagagcttaagagttagtcaccagtgtccctccagccagacacagccctgctgctggggcagagttctcactgcacgcatagaagcacactgaactagccagcccttcttttcctttccaggaactgagctcaacttaatgacagaacaggctggcatatatgaagttagactttcctggagctggtagcttttttcacagagcattattccatttgtgattttccccttctttcccacctaaaaagcagcaggggactctgaattatccagactttgtcatcattggtgaatttctcttctgaataaaaatagatggccacattctctcagccaggacaggccctgacaacaatggagtgtatgcttaatagcttttccttcctctacaagcaaacaacacattttcaatggccaagggtcccactgcgcagctaaaatgccacacttgctctggcaagagctctttggggacctgccataagcagtgacattgtcatcattgttcttaactttgcagtatcatttgaggccgtagctcactttttcctttgcatctgtgacaacatagtcctgactcttttagctctctgatctctccgtctctggttctacttcttcctaatttcccccaaagccatcatacttggctatgtacttcatggctccaatttctattctgtttttactttcccacatatggcttcccctctcacttgtaagtggatacttcacaaatctgcatctccacattccagtccctcatcttcccatccatgagatctatcatcctctcaagcaacttgtattaaactttcaggacccatctctcctccccaaattgttccctctttagatctctatttttctcaaaaattatagccaacattctttcttcctggttcgaaatcttggcatcaactttgtttccttttttaccatcccagccagaaataaaaatgtgattctccctttgtaatgtcttctatgtgtctcatcttgactatttttactgtcattggtctcacccatccaagcttccatcgcattctctacacagcagtttctaactctaggtcttcctactccatttattcctccagtactcttacttaacaccccaattacagtgttaaatggctccctattgtgtatcaaataattccagatgctttagcctaatatttaaacatttccacattaagtccataatggactctttttttttttccaaaagtgacctggaatatggcaggaatctacctctacattacactgcatgttaagagatcagtagctgggctcttggacccaaagatgtgtttcctgctggatcctattctgctccatcacagtccatttttgtccattcaggcttctataacaaaagattctagactgggcagcttacagacaacagaaactatttggagactggaaaagccaagatcaagatgccagcagattctgtgtctcgtaagggccttcttgggtcacagactgccatcttttactcctgtcctcatgtggtggaagggacaaaggatctctcttgggcttcttttataagggcactaattctattcatgagggttttaccctgatgtcttaattgttgccagaaaagagtgtcctgatccagaccccaagagcagattctcagattcccacaggcaagaattcgaggcaagtcacagagcacagtgaaatggcaagtttattggaaactactctgttacagtctagggcatcctcagcaagaggaggagcactccatcttttgttagtgtctgtacttataagaaactataaagaggtaaattaaacttggaatgtgcagacatgctctgatgtgctcactaaaggtagtggctgtcagtgttatcgatgaccatcaatcctttaacctcagcttgctctttaacattatctttaagcaaagagggctgcactgtcaggacatctggacattctgcaggcttggtgagagatgttttgtctggccataaatattctgtaattataagtggtggtcagcttgggatgtggctattttcagaccataagtattaaccttataggtgctttgtgggtgcctcactattcactgaaaggtgacatcactctggtcatagttcttttttattttattttatttttatttttattttttttgagatggagtctcactctgtcgcccaggctggagtgcagtggcacgatctcagctcactgcaacctctgtctccccagctcaagcgattctcctgcctcagcctcccaaggagctgggactaaaggcatgtgccaccacacccagctaattttttgtattgttagtagagacggggtttcaccatgttagccaggacggtctcgatctcttgacctggtgatctgcctgtctcagcctcccaaagtactgggattacaggcgtgggccaccacgcccagctctggtcatgttttatcaagccagaggcctggtaaataggggttcctctaacatatttcccccttctgtcatgagtggacccttaatcctaagggacactgaagggcagaggtcagtcttctgcaacctcttcctgctgagaaacgtcattgatgttaactctgcctagctttaagggacctgtcatgttgggaggggtcttaaccagaggtagcttgaagctgttgcagttaactggaggagcaataggtctgtaggtttgtaggtcactcataagttgatatcctaaacatagaaacttataagaattatagctataattataaaacatgatatatgagtaccatacattgtgaattaaggattaataataagaatagggcccagtaaaccctacattccatgcaaaacatgcagcaacaataaaatccacaacataaagctatgcctattccaatttttatagctggggtgacaaaaggaactttttccaccatgatggccctgacccaaaccacaatgttagccattatctaaagaaagtgtgggattagagatggctttaatttgttgatgcatatctggagggccaaagaaatattgtctgagttatttgggatatatatacaatatttgattctgataatagcacaggttcctccctgtgccgcagtcagagtatctaatgacattctgttttgcatgatagccttatgcatataatacatttcagcatttataaaagatatatctcacaggctgttacttacagcccatggggtatcattggcaatgacctcaacatgccagatagcatcttataatctaacagatggtaggaagagtgaggccaagtggttatacccatgaaaaatggatctggcccacatactggttatgtggagaaggttggctggctttatttatttatttatttatttatttatttatttatttattatttatttatttatttgacacagtctccctctgttgccgaggctggagtgtggtggcatgatctcggctcactgcaacctctacttcctggattcaagcaattttcctgcctcagcctgccaagtagctgtgattactggtgtgcaccaccacacctggataattggccaggctggtctcaaattcctgacctcaagtgattcatccacctcggcctcccaaagtgctgggattacaggcatgagccaccatgccagcctggctggcttttttaaatagtctttgtccagtgacctggggtcaagataagcttcatgtacaatgtcctagccacccagaaggcaatcatggccaaagattggtgccacatatccaatgagttcctaagggatgcatatcagttgggttttggtcgttgcgaccaatcggtagcagataagtccatttgttgcaggactatggtatgttggcattgtcttgcaggaatccatcccatgacacaagtagcatttgtcaaggcatcaagggagtgattccattgttcctaacacagtgggactacctgacttaggtgtcctgcagaggtggttagtcatagaaaaccatctcaaatctgaagaaatcattcttcaaaactggagtttttgagctttttagtttggatgtttatctttgggtctagaaaggaggtgcccagtgcaagaaacttttctgtggtctcatttactgagaatggcttcctatgcccagaattgctaaaattgttattaattggccattgggttacattgttccaagtcaggccagacatctgtgcttttgtccattgtttaagtccctctaagtatgtctgtaagttatctaagcatgtccctgtgtgggggatatccaccagggcaagcctgagatgctagagaagggcaatagctcacaaatccagcaagaggacatcggcatagtcctgtgcccattgtaagaaaagatttgaacctccagcaatagtgaaaggaaggatagaagccccaaaatagacacaaataaaagagaagctacattctatagttatatcctgtaaggacatagatattgcttacccagagctgggacagactcataccagtaaaagtaaaagacgaccaggaggaggatcaggaagactaaccttgcccccaagcttatccagagcatcactttgtagtaagaagcttccaaggatttctcctgaagaggaagtatagaccttctactggctcacaagagtaaactagattagcagactgggtgtcagaagtgtagaccttctactggctcacaacggtagactagattagcagactgggcgtcggtagcttgtggggctccataagaaacaggtttaattcaagacaaatgtacctaactgtgaatcccttgcagtttaactgctattggagtgctcagagcacttgatatggacctttccacattggggaaagctggtcactagagacccttccattcaagtctttagtaaggttaaataccctagttgaactgaaacagaattttcctctcatgtggggagggaaagccttttatatccatattcacacaatgcattttgcacttgtcctagattgataacatatttttgtaattaatgaatcatttcatctattaggagatttgcagttaggaaaggccttccatatgttaatgcaaaaggacttaattataagtttccctttggagcagctcaaacctgcagtaaagctacaggcaatagagatagccaggtctctgatgtttcctggcaaatttagccggagtcctctttagcctatgattaaccctttccacctttccagaggattggggtctccatgcagaatgaagatgatattggattcccaatgccaaggataggtattgggttatgcctgccgtgaaagaggggccatagctactttgcaatctttcaggtaatccaaactgaggaattatttcttttaataaacttttagataggcttggtgtggtggctcatgcctgtattcccagcactttgaaaggcctaggcaggtggatcacccgaggtcaagagtttgagactagcctggccaatatggtgaaaccttgtctctactaaaaatacaaaaattagctgggcatagtggtgcatgcctgtagtcccagctacttggaaggctgaggcaggagaatcgcttgaactcaggaggctgaggttgcagtgagccgagattatgccattgcactccagcttgggcgacaagagtgaaactccatctcaaaaaaaaaaaaaaattgagagacctctaaagctctttttttttttttttttttttttttgtgagatggagtctcactctgttgtccagactggagtgcagtggcacgatctcggctcactgcaagctccgcctcctgggttcatgccattctcctgcctcagcctcccaagtagctgagactacaggcgcccaccaccacgcccggctaattttttgtatttttagtagagacagggtttcactgtgttagccaggatggtctcgatctcctgacctcgtgatccgcccacctcggcctcccaaagtgctgggattacaggcgtgagccaccgcacctggccgagacctctaaagctcttttggatcaagtgggggaaagccttaacctaaccagtgaaggtaacaataaacaccagtaaatatttgaatcccctacatagaggcatttaaataaagtctagttgccagacttcacccagataggctcctttatgttggacaggtttaactagaggtgggggcaatggctggctgcttgggttattttgggcatagagctttcaggctgaagtcatctgttttagtgtcttgaaaaattttcccataaataaataagatatcaactgaaataaagaatcccttcccaaatgagtggaattatgaaaatgcttaactattttacactgattggcacttggcattagtaatttgttatcattaaccagccagaggggtcctgggccaaatcgtgatccctggcccattttcgttcttccttggagtacactggctcggctatgtctggggctgtgggcactaggatgcccataagcgttaactggctcttttagtgcagtggccttggcccccacatctgcaagggcatttcatttaataatatcatcaaaatgtgctctgcaatgaattacagccatttcttttggcagtaaaacagcatctaacaagctcaaaatatccgagtgatgttttctgggggagtccttagcagtgagaagtccccactctttccaaatgtcggcatgaccatgaagcattaaaaaggcatgcttggaatcatcagaaatgttaatttttacatccttttccaattgcagggccctagtaagagcaattagctcagcttccatctgtaaaccattctgtctcaggattgttaagaggctcatctcttaagtttggcctgctagaataaatttgctccataacctgtatgcaggaatggtttagagcgtctgtggactctggcagacaagcagctgggtttacttggagaacttcaagaattatgtctggtgtgtctaacagtaaggcctgatgctttaataaacatcctcccatcatccactggtgccctttagcttctaggaccccctggacttggtgtgtggtcaaaacctccaggtgctgtcctaatgttagcgtattagcttcatctaccagaagagcagtagctgcaacagcccaaaggcatccaggccatgcagaagccacatggtcgagttgcttagaaaaataggctactggctgtggaatattccccaatttttggacaagaacatccaagaccataccttgctttttggccacataaaggaaaaatggcttatccaagttggggattcctaaggctggagcagagcccaatttcgctttgacagtattgaagttttgtctgctattctcattccaatcaaagcgttttaaatctgtcctttatagaacctcacatacagacttgaaatgtttgcccaaatccaggcacccataaatggcagaacccagccatccctaaaaaggcccacataggtttcttggtatggggctcttgaatgagcttccttccattctgaggctattgcttgggtaccagaggttaagatgcaacccaaattgattctggaggagtgttataaataataaagagagaaacaaatagtaaataataaaaaaatttataaaaaagatatattcaaaatatttgactttctgagtagaaatctgagccttgtgtggtgacaccctatatccagtagttcctaggaaatttagcaatttaacggtagtattatctgagttctctttagttgggctagcaatgagcaaatcatctacatactagataattgtgcccttttgcagttgtagattcttcaagtccttagctagagcatttccagacaagtgtgggttatcccgcaacccttgagggagaactgtccaggttagttgtgaggttgaatgagtatcaggatcattcctttcaaagtcaaacagaggtgtggatctggatgcactgggtgcagaaaaatgcatccttatcttccttttttctctcctcaggggagaggaacaaaagtaacactcgtttgttttatgctctctgaaggtaaccatgccttgcagccgaatcaataaattcctccccagtaaggggtagggcatgcaggtagtactaaaaagccatgcaagaaaaccagagtccctgaaggacagcttaaaggataaggaaagtggcatttctgggcttgcccatcaatgcctgtacagctatagaagacagggctccattatgctgggccagaacaaagtaaaatgctcccatattgaataagaaattaataatcttatctgccacttcaagagtcacctgagtctcctccagagcaatggctaattgtccaacaggaaataaggtgtgaagtcttgggctggtgtcactcttaggtctgctgggccattatgggttcaggagccgattcttgggaacacagggcattccctcttccagtgaccaaccttcttacagaaaacacattggtttacacccaggacacagtggcccagggcacagtggctcggaggcccagaatggggctttctgcctgctagcttcctctggcagggcttgggggataaggggctggctctgaaggggtggagagctcaaggctgcagctaaaagctgggcctttgggaggtttgctttactttctctgcctcctctgccctatcttggccattgaaaattgcaaaagtcatgtctaaaagctgatttatggaagtccaggggcctaagtttgcttttgtagcttcctgcagatatcaggagcagactggattatgaaatgaactcctggcaatgcctgtccctccttggagtcagggtcagtgttagtatatttcctcaaggcctcaattaactgcccttggaacaaggttgggttttcatcctttccatgagtaatttccctgactttatcataattaacaggctttatcacaaatcttctcattgcttcaaggaggcaaataatcatatggtttctcctctctaggttcttacttcctttttttgttgtttttttcctcaagacggagtcttactctgttgcccaggctggggtgcagtggcaagatcttggctcactgcaacctccgcctcccagattcaggtgagttctcctggctcagcttcccaagcagttgggaccacaagcacatgccaccacatacggctaatttttgtgtttttagtagagacagggtttcaccacattgtccaggctggtctcaaactcctgacctcaagtgatctgccaaccttggctgcccaaacttacttcctcttaataactccaatttaggtcccagtcaggaactgctgtacctcctactggatagatgtcatgcccctggttgcaggctgccactccatctgcatatgctttaacagctcccataatatgctgcttttcttcttctgtgaagcaggtagacagatgtatatgcaaatcttgccaggttaaatcatatgttgaaggggtggcctgcccctccacacctgtgggtatttctagtcgggtgggacgagagactgagaaaagaaataagacacagagacaaagtatagagaaacaacagtgggcccaggggaccagcgcttagcataccaaggacctgcaccggcaccggtctctgagttccctcagttttttctgattattatcttcattatttcagcaaaaaggaatgtagtaggagggcaaggtgataataaggagaaggtcagcaacaaacatgtgagcaatagaatctatgtcataatgaagttcaagggatggtactatacctggatgtgcacgtaggccagatttatgtttctctccacccaaacatctcagcggagtaaagaataacaaggcagcattgctgtaaacatgtcttgactcccaccatagggtggtttttctctgatctcagaattgaacaaatatacaatcaggttttataccgagacattcagttcccaggggcaggcaggagacagtggccttcctctatctcaactgcaaggggctttcctcttttactaatccacctcagcacagaccctttacgggtgtcaggctttctcatcccacgaggccatatttcagactatcacatggggagaaaccttggacaataccccgctttcaagggcagaggtccctgcggctttccgcagtgcatcgtgcctctggtttattgagactagagaatggcgatgacctttaccaagtatactgcttgtaaacattttgttaacaaggcacgtcctgcacagccctagatcccttaaaccttgattttatacaacacatgtttttgtgagctccaggttggggcaaagtggctggggcaaagctacaaattaacaacatctcagcaaagcaattgtttaaagtacaggtctttttcaaaatggagtatcttatgtcttccctttctacatagacacagtaacagtctgatctctctttcttttccctacaatatgtcaatgttagtctctcaaattcatctatgaattttcctagaccctctaaaaaccagctgaattttttctggcataaggctgtcaggcacagaaaagggtacatgtacccatagagtgcccctgtcaccatctgccagctcctgaagacagcaaagagtcaacttcgacggctggtaagaggccccactaagagtggtgctggtgaagctaggctctttggggaacgaatgtaagacagggcttgaagggtaaggaggaggtgatggcaggacatcggacaaccccaaataactaggaggggttaataatactttggacacttctggggaactaggagtctgactttgttcctccggagcacttgaacttacagtggggagtctggaaccagctgggggaagcctgggattaggaggcacttgcataagtggtcatgaattatgtctagtccttcatttttctctccttctatcaaacatatacaagcgtattttaaatccttatcctgactaaccattaggaaggcctgcacatagagtatttctccacacttagtttcccttctacaaaacaaatcaagccgaagtatagtgttaggggccgctgtaacacctgaggtccacctttctggtcctctcaaaggatattggggccagtgttatattaaaaaaaaatttctcagccgggcgcggtggctcacacctgtaatcccagcactttgggaggccgaggctggcagatcacgaggtcagtgaatcgaggccatcctggctaacacagtgaaaccccgtctctactaaaaatacaaaaaaattagccaggcatggtggcgggtgcctgcagtcccagctactcgggaggctgaggcgggagaatggcgagaacccgggaggcggagctttcagtgagccgagatccagccactgcactccagcctgggcgacagagcaagactccgtctcagaaaaaaaaaaaaaaaaaattctcttaagcccatccagtttaaaccttcccttccctaataggttaaaatgcaccctaacagtgagctcttcaggataggtactgcgttctccaccaggactgaaggtgctgaataccactccttgtccgcaagattgtactgcctccagccgagctccactgaaagggacaagataattcttagtgccaatttggccaagggaggaactactggagccagtagggtccccttgttcatatcagataataagaacaagtaagcagacccatggtcgcctgaggcaatgccacaaggaacccagcgaagaaaagatgatgaaccaaacaagggaagtgggcaagctgtaacttgggatcccctgacaaaactatttcagggcaaaaatgacattctgggtctagaaagcggggcccggctgtccgtgaccagccaataaaagatgatcttctgattaatagacaagagaaaactgttaagaaaaagtctcctgtcctccattctggggctaattttttgcaaggaaagtcataaaagaggcttttttcttaaagggcgtttctaatcttgtcacatatggctgttaaataccacactttaacttgtaactgcagtaatggagaagttattgcccatctcttccaataattaaggtacaaaaagactagatcctgagtgacttcttgtttccagtgtccctcagacaagtggcgaattaagtcagaggagaggcaaggaaagtaaaagctaaactgtttggtggccgggcattgtggctcacgcctgtaatcccaacactttgggaggccgaggtgggcagataacttgagatcaggagttcgagaccagcctggccaacatggtgaaacactgtctttactaaaaatacaaaaattagactgggcgcagtggctcatgtctgtaatcccagcactttgggaggccgaggtgggcagatcacaaggtcaagagatcgagaccattctggccaacatggtgaaaccctctatctattaaaaacacaaaaattagctggctgtggtggcgcttgcctgtagtcccaactacttggaaggctgaggcaggagaatcgcttgaatccggaaggcggaggttgcagtgagccaagattgtgccactacattccttctagcctggtgacagagcgagactctagctcaaaaaaaaaaaaaaaaaaaaaaattagctgggcgtggtggtgtgcacctgtaatcctagctactcaggaggctgaggcaggagaattgcttgaacacaggaggcagaggttgcagtgagccgaaatcgcaccactgcaccccagcctgggcaacagagtgagactctgtctcaaaaaaaaaaagaaaaagaaaatgctaaactgtttgggccatccttcccgtggcagcctcaggggttctgtgaaacaaaggcagcaagccgacaggagacaagaagcaggacgctcaggccagcaacagaaagcacaaggtggattactcccaaggagttagtggcaaacatctcatagggccaaatccgttttccaaataaaccctggggcttctaactccttgggccctgggcctcaaactcaagtagcagtggacaagcatccttgtcccctggaatagcttaatgactctaaaatgagccccacttacccaaagtcagccaactgatgctgcgcagactgttttccttccgagtgggagtctcttcttattgtccatccatacaaggacaccagaaggatgttgcaggaaaagagggtcacgacccagacaccaagagtgggttcttggattctcacaggaaaggatttgaggcaagtgaaagaagcacatttgccaggtgcggaggctttcacctgtaatcccagcacttcgggaggccgaggctggtggatcacgaggtcaggagatcgagactatcctggctaacatgatgaaacccccacaaaaagtttgctgggtgtggtggcatgtgcctgtagtcccagctactcgggaggctgagacaggagaatcgcttgaatctgggagacggaggttgcagtaagccaagatcgtgccactgcactccagcctgggcaacagagagagcatctcaaaaaaaaaaaaaaaaaaaaagtagcacatttgttggaaactactctgttacagactagggcgtccgcagcagaaggaggaacgctccctcttttgttagtgtctctacttataagaaacccgaggcaggcagattccttgaggtcaggagtttggaacaagcctggacaacatggcaaaaccccgtctcttctaaaaacattaaattagccaggcatggtggtgcgcgcctttaatcccagctactgggaggttgaggtgggagaatcatttgaacccgggaggtggaggttgcagtgagccaagatagtgccactgcaatccagcctgggcaacagagcaacagagtgagactgtgtcttaaaaaaaaaaaaaaaagaagaagaagaaagaaagaaactataaggaaactataaggagctaaattaaacttgaaatgggcagatgtgctcactaaaggtagcagctgtcagtgttattgaacaccatcaatcttttaacctcagcttgctcattaacattatctttaagtaaaaagggctgcactctcaggacatctgggcactctgcaggcttggtgggagaagttttgtctggccataaatattctgtaattataagtggtggtcagcttgggatgtggctatcttcagaccataagtattaaccttacaggtgtcttgtgagtgcctcgctattcactttaagatggagtcactctggtcatgtcttattaaatcagaggcctggtaagcagagcttcctttaacataatcacttctctaaggccccacagccagacaccctcacactgggaattagacttccacatatgaatttgggggtcgatacaaacattcagatcatagcacagtccaaccctctcagccaccctgctctgttcctctccttctctggctttaacacctttgtttatcttctgctgggccctgaccctgtttgatgcttctgcttgcgatttctcacctgccccctgactagggctattaggagtatagagcactctgccgtgattcctctttcacactcagtagccccagtggggtccagaacaagggttctcatttattaatgtgcataagaatcagatggggagtgtgttaagcatgtaaattccaggagtccatcattccctcaggtccaggggtacagccagcatctgtagcagtggaactttttgtgaagatgggaatgttctattctgtgttgtcctaaagaggagctactagccacaaatggcgattgagcacttgaaatgtggctaacgtgactgagaaactgaattattcattttattgcattttgattaaatttaaatagccacatgtggcttgtgactttcatattgaccagtgcagatctataggtttagcaagcatcacagctgactctaatgaacaatagtgtttaagactctaacaagccgtccaggtgatccttatgctcacttactggcaagtagtagtaggtaatcaacaaatgtttgttgagtgggtgaatgagtggaggaactaataaatgaatgaaccagactataatttccttgtggtttaaggctgtctctcctgaaaaagaaaatgtgggggactgttccagattaaagaggctaaaaagacttggcaatcgaatggaacaaattgacattaaaaggatccttgttcaaaaatgagaggtcttaaagccagacatagaaagacacgtattgcatgttctcactcatatgtgagaactaaaaaagttgatcacatggaggtagagagtgaatgatagttaccagaggctgggaagggtgtaggggatagtaggagagggaagaagagaggttggtgaatggatatgaacagacagagaaaacaagttttagtgtttgatagcagagtagggtgactatagctagcaacaatgtattgtgtatttcaaaacagctaaaagagaggccttgaaacgttcccaacacacagaaatgataaatacttgagatgatgacctaaatatcctgacttgatgattacagattctgtatgcatataagaaaatatcacatgcacaccataaatatgcacaaatactatgtatcaattaaaaaattttgggccgggcacagtggctcacacctgtaatcccagcactttgggaggctgaggcgggcggatcacgaggttaagagatcgagaccatcctggacaacgtggtgaaaccccgtctctactaaaaatacaaaaaattagctgggcatggtggtgggcacctgtaatcctagctactcgggaggctgaggcaggagaatcgcttgaacctaggaggcggaggttgcagtgagccaagattgcgccattgcactccagcctgggcaacagtgtgagactctgtcacaaaaaacaacaacaaaattttttaaaaaataaagttagaagaaataagttctagtatttgataatacagtagaaaaattataatgaacaataatttattgtatatctcaaaataactaaaagaggccaggcatagtggctcacacctgtaatctcagcacttttggaggccgaggcaggcggatcacttgaggtcaggagttcaagactagcctggccaacatggtgaaaccctgtctctgctaaaaacacaaaaattagccaggtgtggtagcgcctgattgtaatcccagctacttgggaagctgaggcagaagaatcgcttgaacccaggaggtggaggtttcagtgagctgtgatgtgccactgcactccaggctgggcaacagagcaaggctctgtcaaaaaaaagctaaaagagaagaattataatgttcccaacataaagaaaagtgtttgaggtgatggatatcccaattaccctaattcgatcattccatattgtatacaggcatcaaaatattgcatatacccccaaaatatgtacaactattatatatcaataaaaatgtttaataaataaaaatattaaaaatttaaaaataactatactagacattttggagacaactggagaaatgtgactataggcattttacatgatattagaaaagtatttttagttttcttaggtgagacaatattattataagtctttattcttaggaagtacaagctgaagtacttagggataaagcgtcttatatcagcagcttattttctttccttcttgttttttttttttttttttgagatggagtttcactctgtcacccaggctggagcgcagtggcgtgatctcgattcactgcaacctctgcttcctgggttaaaacaattctcctgcctcagcctcccgagtagctgagattacaggcatatgccacagtgcccggttaattttttttttttttttaattttagtagagatggggtttcaccatgttgactaggctggccttgaactcctgatgtcaggtgatccacccgcttgggcctcccaaagtgttggggttataggcttgagccaccgcgcctggctggcaacttattttcaagtggctcagccaaaactgtgtgtgtgtgtgtatgtgtgtgtgtgcgtgtgtggttggagggcagggagagattgagagagagacagagaggagagaaagaaaggacacaaaaatggtaaaatgttagcaattgttgaatctagataaagtatattttggtgttcattgtatgtattccttcaccttttctgtatatttgaaatgtcttttttttttttttaagttgggggaaattttacccacaatgaattggcaaattctaaagtaaagtaaaatggttttttgtttgtttgtttgtttttgagacagggtcttactctctcacccaggctggagtgcagtggtgtcattacagctcactgcagccttgacctctcaggctcaagcgatcctcccacgtcagtgtcactctcaagtagctgggaccataggcgtgcaccaccatgccccgctaattttttaactgtttttttttttagtagatacagggtatcgctatgtttctcagactggtcttgaactcctgggctcaagcaatcaacctacctcagcctcacaaagtgctgagattacaggtgtgagccattgcgcctggccaaattttaaacttatggatcttctgacatttggatgctaacctccccactccatcacagactaacactgtgctgaaattatgttacaaattctgtagaccagatattgcaaactggcaacctacagatcctatctggccagcattcacatttttccttggctcaaatagtgttgttttaaattaagttagttgttaacatttaaaattcagagtatttttatttcgatatattatgtagtaaaatattttgcattgtgatgaaatataaaatactactttataatagcaaacatgtatagatcactgcctgtgaaacaagcactgttctaagagtttcatgtatatttaggtcatttactccttacagcagcattatgggataggtactattattatcctctctctactgatggggaaactgatgagcgaagaagtgaagtaaatttcccaaagtctcacagccactgacttgtagctccagggtggaaacctgtgcagtctgccttctaaccactaaaccatatcacagctcacaaaagtccgcatccccactgtctctggaaaaaccaggtctggcaacacattcccacatggcatcaattaaccagggctgagaaatttcatttccctgaagacagggcattttctctttcacttgccagagtctccattcagtcaacttctgggacctttggggttttgacccctgctctagcacagctgaatataccaggggaaatggcatgttacagatatttcacagacacctatacactgccccagacaaagttagatctcagactaacctctaagtggacaggaagccccagtggaagagaagattagaaggtaacctaggccagattgtgggtagcagagtgtttaggatgccaggataattgtcagcagacaatggagaaagttataggaagcagaagttaacatcccatgattggtaatatgccctatcagagggcagcgggggtcagtgaaaataacatgggccagcatggcctggattacaaagctgattccatcacttagcagctgtgtgaccttggacaagttacttaccttcaagcttctgtttccttgactcaaacatggagataaagacacctccaggatggtggaaggaattaaatgagatagtgtgtgaagtctctttagcctctattaatataggtaacctaactgtttttcttactaattatttatattcatattttcccgtagagctaagaagcaagaagaaattggggcgccatggtaagcaccaggagcttattgaagcttcaccattgagaggtccaggtcttccttcatttatcctgtagcccaagcagctagcagacttgctcttatggtttgatgatatttatcaacttttttccaaactagagatgctgaacagaacttggaagaaattgacacagagtaaggggaaaacagttgagaaggatttttgagcaaagagtttaagtgaaaatttaaataaaatagtcaaaaagccagcaataatctaaatggctagcaattccttcattcagcaagcattgaatacccacaaaggtccaggtcccatgctagatgctagggacataaatgcgagcaaaaccagacatggctgctgtcctcccagcccgcactctggtggtagttgattaaatgatagcacacccatattccggaatgttacactgccattatgaagaaagtttgtaaagaataactaataaaacaatctagtttcatgttctaatagcaagataaaaagcaggatgaaaagttgtattcatagtattatccgtatgatataaataacctgtaatccacaactcaaaaataacaattgtcaacagtgtagtccattatattcaattctttttttcctattctaaacacatctactacatatatataataaactattggaaaattctaaaaagtacttatagttgttatttctggattgtgggattgtgatattccatatatttcaaggtttctacaaaaagcaggtataaacaggaaatatgtcaattaaaacacagtcatagacatgcatagagcttctcctcagtattcatttgttttcttccccctgtccttggtgtgtccaggggaaagcccgcagatccccgccagggcaccacaggcattgtgagggatgcttcaaccgccactgccacattcctgtggaacccaacacctcctgcctggtaataagctgccacctgctctgtggtgccaccttccacatgtgcaaagaggcagagcaccagctcctctgccctttagagcaggttccgtgcctcaactccgaatatggctgccctctgtccatgtcccgccacaaactggccaagcacctgcaggtgtgccccgccagcgtggtctgctgctccatggagtggaaccgctggccaaatgtggactctgaaaccacccttcatgaaaacatcatgaaagagacccccagtgaggagtgtttggacacagccctggccctgcaggatcagaaggtcctcttcagatccttgaaaatggtggaacttttcccagaaactagagaggctactgaggaggaaccaactatgaatggtgaaaccagtgtggaggaaatgggaggagcagtgggtggagtggatatcggtttggtaccacatggtctgtcagcaactaatggggagatggcagagctaagtcaagaagaacgggaggtgctagccaaaaccaaagaagggatggacctggtcaagtttggccagtgggaaaatattttcagcaaagagcacgcagcctctgctttaacaaattcatcagcgagctgtgagagcaagaacaagaatgactccgagaaagaacagatttccagtggccataacatggtagaaggagagggcgctcccaaaaagaaagaaccacaggaaaatcagaagcagcaggacgttcgtacagccatggaaaccacagggcttgccccttggcaggatggtgttctggaaagactgaaaacagctgtggatgcaaaggactataacatgtatctagtgcacaatgggcggatgctgatacactttggtcagatgcctgcttgtacacccaaggagagagactttgtttatggcaagctggaggctcaggaagttaagactgtttacaccttcaaagttcctgtgagctactgtggaaagcgagctcgacttggagatgccatgttgagttgtaagccaagtgaacacaaggcagtggatacttcagatttggggatcactgtggaggacctgcccaaatcagatctcatcaagaccaccctccagtgtgctttggaaagagaactcaaaggccacgtcatctctgaatccagaagcattgatggactgttcatggattttgccacacaaacatacaactttgagccagaacagttttcctctgggacagtgctggctgacctaaccgctgccaccccagggggactccacgtggagctccacagcgagtgtgtgaccaggagacacaacaaaagcagctctgccttcactttcacttgcaacaaattcttcaggagggatgagttccccctgcacttcaagaatgtccacacagacattcagtcatgtctcaatggctggttccagcatcgatgccccctcgcctacttgggatgtacatttgttcaaaaccatttccgtcccccagggcaaaaggcaaaagtaatctatagccaggagctcaagacctttgccattaagccggaggttgctccagagctgagcgagggaaggaagaacaaccatcttttgggtcatggaggaaaaagccagaattctttaaccagcctgcccctggagattttgaagtacattgctgggttcttggacagcgtcagcctggcccagctctcccaggtgtctgtgctgatgaggaatatctgtgccactttgttacaagagagaggaatggtccttttgcaatggaagaaaaagaggtattcccatggaggcacctcctggagagtccacagagaggtaagtaaacactcatttattgattgactcattcagcaattttttgtttcattttttatagacaggttctctctctgttgcccaggcaaaagtgcagtggtgcaatcacagccttgaacttctgggctcaagtgatcctcttgcctcagtcttccaagtagctgggactacagatgtgcatcaccacttctgactaatttttaaattgagatggggtcttactgtgttgtgcaggctggttttgaactcctgacctcaagtgatcctcccatatcagcttccaaaagtgctgaaattacaggtgtgagccactgtacctggccttaacaaatatttttaaaggcctttttttttttttttttgagaaggagtttcattctcattgcccaggctggagtgcaatggcatgatcttggctcaccacaacctccacgttccaggttcaagtgattctcctgcctcagcctcccaagtagctgggattacaggcgtgcactgtcacacccagctaattttgtatttttagtagagacggggtttctccatgttggtcaggctggtctcaaactcccaacctcaggtgatccacccgcctcggcctcccaaagtgctgggattacaggcgtgagccactgcacctggccttttttttttttttttttctgagatggagttttgctcttgttgcccaggctggagtgcaatggtgcaatctcagctcaccgcaacctctgcctcccaggttcaagcaattctcctgcctcagcctcccgagtagctgggattacagacatgcaccaacacgccaggctaattttgtatttttagtagagacggggtttctccttattggtcaggctggtctcgaactcccaacctcaggtgatccacccgcctcagcctcctaaagtgctgggattataggtatgagccactgcgcccggccttaaagagctttttatgtgccaagcagggtactaggcatgggaacagttgctgagaataagactgactcaaggaggtcagtttagtagaaaagacagacctataaatacataaatagcaatccggagggtagtgcctgttcatctgtgtatgtgtgctgaatatcttctgtttgctctcaagacccattctccatccttctccaccctgtctgtcccccaggaggctgcctggacagattgcctcagctggctcccttaccctccatcttccagtggggctaacgtaaatggagcgtgtcagcaggagatgggaggaagggaagaatgacgttgaagtatctattctcctggcttcccccctgcatggttcctcccctttgtgacactttgagcaggtgctgtccctccactgaaggtgcctttatcaggcggctctctacacaaaattactcactgtgggatccaacgaccttccttcttctccttcaggcccagggcataactctctaggtagctactcaccctggatactacactgtatctcgtggctttcctataccctgctctcgtgtctgtaaatcattcctttaaaaaaaaatctcttcaaattacccggtctgagagtgccgcctgttcccagctgtgactctgattgatacaggaggccaacaaatctcctcagtcccaagtcaactaattttttaaaacagtttttgctttgataaaggcattttgaaattctaaatgaatttggcccactgatttccccggttcaagtgctaatttaattgttcaaaaaacactctgctgtataaatcaaagaacctttcccttcagaaataccttgttccttttccccagtaggtcatgtttgtttaactgtattataatttctaccagcttgtaccatactgaagtgaggcacctaattcatcatatcccagtgcctgtagcatcctttctcatggtaaacctgttggtactatgaaccatgaatttgtgatgcccatttaggtcaataattctataatctcactgttgaatttcttcctaatatgtggtatttgcaaattggcactggggagttagagttgtttgcatctatttgtattgatcatgtctaaaacattttgtatgttttccattatttattcctgagcagtcttcctcaaaaagtaattacaagactctctctcttgtatatgtgcctgcattcaagtgttaaataaacactgattgccaaccaagcacgtattaggaagaaacatgaatgaagactaacacactgccttcaggaatcgtattgtttaaaaacgcctaaaatccgatgtaaataatttaatttagatactataaattattttttggctcaagtttttccccaattcaatgatgactgaccactctcagatattatttgggacgagctaatttccttgcagaaagaaataaagaaaatttagttggggctaaaggatactcacattagaatggatttttaaagtaaaaagggaaacagttctaagatctcaaaaaaaccacttttcctacatagcaacaaggacaagaaactgtaggtgaagtagtcaggttgaaagagtattaggctatgcctactcacataaccagacttgaaaacggtgactttgccatcacatcccaggtggaaagaccagaagatatttcagaactcatagaattctcctatggggttcccactctagtgagactcttatgagttacaatactttaatttcaagcaacagaaaatcaacctaaagtggcataaacaataaagggaatttattggcctatgtaactaaaaagtctaaaggtaatggcttcaggtaaggcttgatctaacagctcaaaaaatgcccccaaatgacatctcttctttctattttttacctctacttcctcaataatggctacattgtaagatagtgctcactcggtggtctctggtgattgctggcacctcctaggacttcagctttgcagttcaagtagagaaagaaaaagagaatctgctttttggtatctccaacaaaagttctggaataagagttgcactggtactaattgttctgatttgaactgtgcatctactttaaaattaatcacttgctggtggaggagcaagggagagtgtgtgtcaatatgctgattggtgttagtgattctcacaactacagggctggttgggaagattattggttggcagggggaactaggaattggatgctggaggaggggctaccaaatgtctgcaggagccactaaacactctggagtctaagaatatgaagaacaggaggatatttccttatagtgcccaaataaagccagccagagggtaacacccctatattcacctttgaacttctatctttctcaacagatctggcagttcagcagcctcttctccaaaatcaagagctgggagtttaatgaagtcacctccatgtctgagcacctgaagtcctgtcctttcaacattgtagagcacaaaactgacccgattcttttgactagcatgtgtcagccccgtgagcaggcccgagagagcttagtctccacctttagaatcagaccacgaggaagatacgtctcctaaaaattcagatgccactcgatgcacccttcttggatttcttctcggagttcctgaagtaggacagagtgtgtggttttgaggactcccttctgtaaactgcctatttgcttatcggggtgtattggaacacgcaatgtccttcgaaacctcaacacgaggcctaagaatttcctaagccatgtcttgtaccatagtgccacattgatgacttgtttccttttttcttttcttttcttttcttttttctttctttctaaaatagattggtctgagaagaaaataagtaatttgaggccatttggaagatgggcccaatttcttaagtgatgagagagcacgaaattccataaccagtacaggcctgtgcttttacatgggctttttagttcacaaagcactttcaaatttatgggacaggaaatgcaggatgggactccccagggaacgcagggtgaagggaacaaagctggaggctctggagctgggtctgttttgacggtcaagtccagggctcattttggttattctactgcctctaggccagggtagtcctaacacagcctgacataggagagcccctggctgagcatggcagccttgaagacaccacaggccaaaacatgaggggcagaaatgggatcacagagtctgttgctagaatcttggcaacatacagcaggaaagccttgataaatcgggagtccaaaggagacaccatatttatggagaacattaggacaaaaagtcaccaacttactttgtaacattttaataatgacttaagggtcaagatttttttcttctgaaaattatgttctgagttaggcagaacatagccatggccctgggccaccctgtgctatctgaaatgacctcaatacactaatgccaacctcagcgtcatgccagaatgcacagggcagcccagggagatcacacctttggcaaagtccagacaaggcccactgcagttcctatggcgccagtcaccagctcctagacagcacttgggtaccccattggggtcttggagaggaagacatgtgaacataacggctccctgaaattgctcctacccatccatatttctggtcatgctttcagtctgacaaaaatggatgatactgctgtttttggtaacaaacagtgaatattcataagaacaaaagtaaaagaaaaaaagacacagtagaaactggcatcccctaaagcagggcttcttagccttggaactattgacatttttaaatggataattctttttttttttttctaggtggggaggggatggagttcactcttgttgcccaggctggagcgcaatgacatgatctcggctcaccgcaacctccgcctcctgggttcaagcgattctcctgcctcagcctcccgagtagctgggattactcgcctggctaattttgtatttttagtagagacgggctttctccatgttgttcaggctggtctcaaactcccgacctcaggtgactcgcccgccttggccttccaaagtgctgggtttacaggtgtgagccactgcgccctgcctgaactggataattctttgttgcaagggactgttctgtgtactacaggatacttggcagcatccttggcctatccattaaatgtcagtagcacccccacagtggcaacaatcaaaaatgtcaccagacattgctaaatattggggagcaaaatggctccccgttgaaaatccctaaaggatgtcatactagtgacaataagttaggatatgcttattttttagtacagcaaaatcttatcgcacatagctatccacaatagttatgatttaatgcagctctttatttatgaaataggttttagacatgtggtgattttaagttgggaaccagaaggaaatgattcgtttggtatggcttcatgtccttcagccacccccaagaatgtatcctttcagctctctttggttatacctgaagccaggagcgttgagttattagccttgtgtttatattcctctcactgtaattggtgtcattttcccagcagtcctagcagtcctcaagcaagtgggaaatcggaaaagaaaaggacaggcattgtagggaagcagaggataaagaatttagccaacaaaagaaacaatctagtcaatctgggtgcttttatttcctgggttctctctaaacatggctcagagctggtgtagatgaagtaggtgaaacctctgaaaagagtctagaaggcagtagagcaagtcccagaccagaaacatgctcatcttttcatcgtaatgtgccactcggtactatttggtaatgtcactctatttttcctaatcccatcctttggtttgtatttcatatttgtatataaggcaccattttctaaaaatatgactagggtgtgacctaaggttttattctgtgaagatgagtaactggaaagaagctaacactgcagtgggaaggaaggaagagagttgtccaggtggtagttcgacgtgttttgaatctagtccttcctacatggaggataaaagctcctaaagtccactctgggtttgtgattttaatagaaatagaaagggaaactatagaccaatggagatgaaaatcaggggctatcgacagatggaggagaaataaggtgctacatagagaaaggaagagggcagaaggctttcccttcccaaactgggtgagctggggaagccttggttcaggagagtggcactgcccacaactgctttgtgggttgtgcacttccagccgcactctccccctccagttgctgccttcagagccgtactgaagcacgagcttcaataagacaagcacacttcatagtgagagggcagcggtaccaaagcctttcagagagactatggattagacagaaatgatttgtgagaggaagctggagtgaacagcatgaacagcgagtgttacctgacagaggcaagacagctagaagtggcttcagatttagaaacagctgaggggagcaaagacggactgtgtacacagggagggaggatgtctatgggcagagcccttggtgagtatcatcaccaagaaaggcagtccagagtagagatcagccgaatatggaggctgaggtctgtagaactgggccagagaggaccttactgccttagtagcataagggtctggaaaagaagtttctatctcacaacaaaggaaaaagtgaaaagcaaggtggaacttgaagatacgtcacgaaaatcactataaaagtctgatttatgtgtgatgtcaaatcaaactgaaatgaagaatgagattgagtatatctgtggtgactgacctctgtatactagaaacctcaacatctctagaagaggaaataaaagctgctttgcactctgaaaggctaattgggtgaatcttataagttaggtctagagacagatgtgtgattcacaggcatagaagttgtcgctgaaaccaagtgtgtatcatgaagaaagaccagagcacaagcctgagaccaaacttgtccaacctgccttattgtgttgttgttctgttttgttttgttttaggcttttagcagcctgaagccatggtttttagtttctgtctctagtgataagcagaacagaggaatgacaaaggggctttactggcccaaccagaaacagaaactatgaacccatggctgaattctctcccttggacaccctgctgggcagctcaccaactctatgaagccctggagcaactaactgtgggtcttagcaaccattctagctcctccttgatcccagtgccttctccatcttttctttctttcttcttttttttttttttttttgagacagcttctcactctgtcgcccaggctggagtgcagtggtgtgatcacagctcactgaagcctttactttgacttcccaggctcaggtgattctctcacctcagactactgagtagctggtgctataggcccacaataccatgcccagccattgctcaggctgatctgttttggactgggtttaaaatgcagcctaaggaggccaggtgcagtggcttatgcctgtcatcccagcactttgggaggctaagcggggggcgatcatctgaggtcaggagttcaagatcagcctggccaacatggggaaaccccatctctactaaaaatacaaaaattagccgggcatggtggtgcacgcctgtagttgcaggtactcgggaggctgaggcaggagaatctcttgaacccaggaagtggaggctgcagtgagctgagatcacactgcggcaccccagcctgggtgacagagcaaaactccttctcaaaaaaaaaaaaagttcagcctaaggaaaaggcctagtctttgacatctagggtacaggggaattggcagtggtaagagaaagtttcctggatatgcctggaagaggaaaggttggagccttaagatttgaggccatgagggccacacaaaaagtactatttacctcagcatacaggtgaaccatagtctcactttatttcgaattttaggactgaacagaaagaaggttcagatatttcttcagggaaggaaagtgggcaaatagcacaatgaggcaaaccacacaatctagacgtactttcccgggtaaacaaactgggaagcccagagctcacagaggaggagagcagagcttggggtggcagagaggtgttcattgggaaggagtcaggaacacaagagaaatgttcatgagctcatccaggatagagaggactcttggggaaggggacctccttccccatgctgtctctgccccaagcccttaatgaagcaggagagggaagtctgtccagaacctcatctggttagacatttgcagcaggaatagggagggggtggaggcagagccactttggacatgggaaatcacagttgcagtagacagtgagctctagtcactccagaagcttgacataatttgcagggaagagtccaaagtggccatggcaacgtccccgccaccagccctcgtccaccatctcaatgtcagtgattacgtcgtccggatcaaaggaaagctcatcacttccctctggggagaaagttgaggggatattagaatggtcagacatgaatctcttttcacatgtccccctgtcttatatcaggggcctccatgtaccaggctcctcgggccactcccaacctacctccttggtaatcatatacagccacagctgagatccccagagccacagccccagccccagccccagccgggcagcctgatgatcctgcataatgagaaacacaaacatgggatcatcaacatgaagaaggcaaacagagaaagatcctactggggcaatagagaaattcttcttcctcttaccctcccctggacatgagcaaattctcctgcttctcctcccatcactcaccagccagagcagaagaaaaagaagaatcttcaggctcgagcacctcctcatagtccccctctggttcatcctcctgctcatgcctgtccatctcctcaacgtcctcatagtcattctcaggctcgggctcaggctcgggctcaggctcaggctctgcttcgtacactggctcttcctccacctggaggccttccagagtcctagggggcagagctgggggctcctcattgtcctgagaagagacagtgtggagcactgtgacttccactttccaggaggaatcaatggaggactgataagatcccccgcccttcaccaccctgcctcttctcccctctacccttgcctccatctaacagcctctcctggggaacacagcctttcatccatcttcattcttcaatctcctcccacacccacccacccaaaacacattccagagacaatgggaagagaatgtaaaaggtgtgaggggagggaagtagaaaacaagtcagattctttgggagaccaagaaaacattgaagcaagagcacattgttgagctaccacagctaggataatcatctatactagtttgcccaggacagaggagtttcccagaaggcaaggtcttcagtgctaacaccagaacagtgcaaggcaaaccaggatggttggccaccctgcacagcccacattcctaagactcgagaagatggggtgggggcagagaatctttgggggtttgcttacctccgggagagtctgcctaatgggcagcaagggcactgggtgttccctgctggttctcacaggctcagactctgatgatggaggagtcccaactggaggccaggcctgtggaaaatgaagcatctctcaagtaagcaagcctccatcttcactccttttttttttttgagatagactctcgctctgtagcccaggctggagtgcagtggtgcgatctcagctcattgcaacctccgcctcccaggttcaagcgattctcctgcctcagccccctgagtagctgggattacaggcacacgccactatgcctggctaatttttgtatttttaatagagacagggtttcactatgttggtcaggctggtcttgaactcctgacttcctgacctcgtgatctgtctgccttgacctcccaaagtgctgggattacaggcatgagccaccacgctcggcccatcttcattctttttattttattttatgcattttttgagacagggtctcactctgctgccctggctggagcacagtgagatcatagctcactgtagcctcaaactcttgggctcaaacaatcctcctctctaagcctcccaagtagctgggactataggcacacaccaccatgcccagctaattttttaattgtttttatagcgataggttcttactatgttgcccaggttggtctagaactcctggcttcaagtgatcctctcaccttggccacctcaagtgctaggattacaggcatgagccaccacaccatgcatgtcttcactgttacatttaccaggaacaccctctcccactctctgccaattcaaatggaactcatccctcaagatgggctccagcctgaagtgacggccccttcctcatagttcctacagcaataattggctgtgctggctggtgacttgctttctgttgtactatgtaaatcttgagggttttttctaacattctgataggaggtccaattacagtcagactgaagtcttctaaagacagagacaacagaccttgcctaacccaggggaggactttgccttattttctgccaatggtttggaccccttaggctcctgtctgggcaagagatcctggatgtggatcccagagggccaggcgctcacctctgaggagattttcttgggcagtggggccggtactgctggctcttccatagctatcactggctgtggagcctcagggctcctctttgtcacagcctttcgctcctgttgcctcctggccacctgctgtgccttctcctcttcctctcgcttcctcttctcctcagccatggactcaaatttcgccttcagcccacgggtaccactagaagctgcagacacaggcaagaaaaattagggttgtcttggattggagagtggggaagggcatggcacttgaaggaagaaggggaatcagttaaatatccgggaggagggatttgtgggacaggatggtaaagaggtatcgatagaggaacaagggataataggaggatggcatagccctgaagcctggatttttataaagccaggctatacgacctaagactcgtgtcttttttttttcttgagacagggtctcagcccaggctagagtgcagtggtgcagtcatgggacactgcagcctcaacctcccaggctcaagcaatcctcctacctcagcctctggagtagttgggaccacagatgtgcaccaccacacccagctaatttttgtattttttgtagagaggggatcttgctgtgttgcccagcctcatcttgaactcctgggttcaagtgattatcctacttcagcatcccaaagtgctgggattacaggtgtgagccaccatgcccagctgacttgtgtcctttctaaattgtaaactttgggcttccaaaaagcatcctcccctgtccatattccataaatctgtatgccttcttcaagccaccactcatcctcaacctcatccgaaactcctgtccctgtgtgttcttcccaagtggttcctcaccaatgttcccatgccaccccacccctgtcccaagccacactgtgttctctgcctccgattccttccccgacgtcactctgtctatccacttgactttctctctttctttcttttctttctttctctctctctctctcttctctcccttttctctctctctctctctctctctctctctctctctctcctctctctcctctctctctctttctttcgtctcactctgtcacccaggctggagttgagtggcatgatctcagctcactccgacttccgcctcctgggttcaagtgattctcctgcctcagcctcccaagtagctgggattataggtgtgcacctccatgcctggctaatttttgtattttttatagagatgaggtttccccatgttgtccaagctgttcttaaattcctgagctcaagcagtcctcccactttagccaccaaagtgctgggattacagatgtgagctccgccttacctggtttttctaggaaagacagaatctgggaatatgaggatagggatcaggtctaactcagctaatctaggtagttaaaggcatggaggatatagtctggggaagaaaaagaatgagggagaaggaagtgaggtgcatggagagtgaatcactaagcctcaccggcttctatgggcgtcgtcttcttataagctgtggtcggggcctccatttcattgaagccgacagcgctctgcaggcaggagaacagcatgtgtgttgcgggagaggggcaagggtagtggtgacctggaggtagtattgggggttgggggccactataagaggtatccctaaccattggatgctcaacagctggacagcatgttccaatgttgttttgtggtagagagggggtaaagaagttcttaagtgctgagttcagctccccctttcagcagctcagtgaccttagaatctcacatctccaagcccagttgcctagaatgtagcagggccccctggctcatgcatgaggaggaactagtgtagggaggacagtggcatggggtgggaagagacttaagattgggttaagcaatgccaagaaatcaatacaatttccagtccaatacgacctttcccggcggtttacctgtctctctgtatgcctctcccactgtcctcaaagctcaggctttggcagacatgccccttagatgctgagggcagtcagtggggactgcaggacgccagcaggacaggctctgtgtgcccagcaccaccgtcccctccctctcccagccttcttcacgctcttctctgcacactttcctaaacttagggaactcttcttaagacattggtgttccggtgctttaccttatccactcggtccttctggattccatactggccaccaaagcccttggcataatctgcaggacagaaagttctgagttataggagatcaaaatgctgggaatgggtggtgagaagaatcagtgggaagaaaaacaggaatgtggaaaacaaatgtaggaggaaatgtgagaatcagaggatagagggaggcatggatgggaagagagggaaacagatggggaaaaaatctgggagcgaatggagaagacaaagatggaagtagggaaacatggaaagcagaaagcaacagataaggaaaaatgtaaaagaaataggaaaaaatacagagagcacttcagccatccgtatgggttccagggaagcagtaaacctctttatcctctgtgaggacagcagagatccctctaagactcatggcaaaccatcttctgaccatcactcagcttgtctgtcctcattccttcctcaacgcccccttctctctcacctccctcctaggccctgctcttaatccttctgttttcctctccatctctcctctctcccctcactaccaccacctgtccccacacatgtgcttactgccctggcaccccctgctctgcacatctgcccctctgtattctggggcacccgggtgagcttccagaaaggaaggaaggagatccctgtgctatctgtgaccttcccccttccaaccccaactcacctctctgggactcgtgtttctccgtctctcccttgtagtcatatcccagagctgctttgtcccatttatccttctccaccccgtaccggccaccaaagccacgagagtaatctgtggtcgaaggagcagtcatgagagcccacccttaggctccagcacacagggaagcgctggagaagagaggtcagcaggaatgggtacagagtgttaggggcctgggaaaagagcagggcttgaatacaggggaattaaagagaagccatgtcttaagtagtcttttaattgaatattgcttactttttccctctcttctctcatttccatgccaagatgagaagaacattcccattttctcccttcttcttcaagaaggggaaagtatagagagtgaggagattgcagaaaaaaaaaggcagatacatgaaatgtatgcctttcccctactcccatataagcacatagaaatgtcagataaaacataacaattgtgttttaaagagtgaagctcaggccgagcacggtgctcatgcctgtaatcccagcacttcaggggccgaggcaggtggatcacctgaggtcaggaatttgagaccagcctggccaaaatggggaaaccctgtctctactaaaaaatacaaaaattatccaggcatggtgatgtgcgtctgtagccccagctactggggaggctgagacaggagagtcacttgaacatggggggtggaggttgcagtgagccaagattgcaccattgcactccagcctgggtgacagagcgagactccatctcaaaaaaaaaaaaagtgaagctcagcagaaaggaagggaaaaaatcctggctccagaaaccagagacaaagagatgaatcaaagctgtatgtgtgaagataattatgaactgacaccacagaaaacccaagggcatttttgggggattttttgtttttagaggtagagtcttgctcttttgctcaagctatagtgcagagtacaatcatggctcactgtaaccttgaactcctggggtcaagcaatcctcctgagtaactgggaccacaggcaggtgccaccatgacttgctaatttaaaaaaaaatctgtagtgataggatctcactgtgttgcccaggctagccttaaactcctgggctcaaaggacccacccacctcagcctcccaaaatgctgcaattacaggtgtgaactaccacacctggtcagattttaaattccaaatgtaatgaatagggattaggatcgaggctctgtgattctaatttccatttaagaatgggggaggagggaagaaagccagaaacgaagctctgtccactcctataagagagtgctagaaaaattctactcatttactcaggaaaatcatgaagggggcttgtaacctgttcaatatttgatagggggaaaatttgcttatgagacttggaaactccaagcctacatctgagtgtagaatgcaaatacacattttttttccacttatgtgatgcaggaattctaagctgagaaattaactaaatactgatccaggaaaatatacattttggaaagagtaagcataagaaagatggcatgaatatgagataaagtgatctcaagacaaagtgcattctaagagacaagaaagacatgctccaatgataaaagaacaataccttacatcaggagtatgtatgctggcataaacctattcacagaaccaaaattcatgaagctctcaaataaaagaaaaatgtaaaaaaccaggtgtggtgaatgcctgtagtcccagctactcagaaggctgaggcaggagggtgacttgagcccgggagttcgagaccagcctgagaaacatcgcaagactccaacacacacacacacgcacacacacacacacacacacacacacacacaaataatgcaaaagctgacagaagtagaaagagaaatagacaaatctgtaatagtagttgaacatttaacaccattctttcattaattaataggtattttaggcaaaaacgaatcagtaaaattatagaagatccaaacattatcaactaataaacctaattgactcttatacaacactataccccaaactacagaatatacttttttcatgcatatagaacattgaccaaatagaccatgtgccagtccataagtctctaagacagtaagtctcagtacatttcaaaagactgaaatatcagagatcatattctgatcacaatagaattaaagtagaagtcaataccaataaaattatctagaaaatttccctgatgctcagaaaatcaataacagcttttaaataatacatgtgtcaaagaagaaattacaagggaaataagaaaatatttttaactgaatgattttattttttgttgttgttgttgttgttgttgttgttgttttttgagacagggtctcactctgttgcccaggccaaaatgtagtggcacaatcatggcttgctgcagcctcaacctcctgggctcaagtgatcctcccacattagtcccctgaatagctgggaccacgggtttgtgatgaatgaaaattaaaacacacacattcaaatatttgttgaatgtagcaaatgtttgtagcaaatgaaggtagtgttcagagggaaatgtatagcttttcaagtgcccatatagtaaaggaaggcttaaaatcaattatctaagtttctactttaagaggctaggaaaagaacaaactaaattaatactaagtagaagaaaaacataataaagataagagcagaaaccaatacattttttaaaacaagtaaataatagagaaaattagcaaagccaaaagcttgttctttggaaagagtaataaaattgataaacttctagtaagaataattaaaaagagaaaaaacacaagtaagtaagatcagaaatgaaaataggcatttcatatcactagaaatcttacagaagttaaaaagaagagaatattataaatgaatttatgccaataaacctgacaacacagacaaaatgaacaaattccttgaaaagcacaacataccataaccaacttaaaaaccagaaagacttgaactccatgggaaaaaataataataaaggaaaaaaaatgtccgttactattaagacctctagagttgagccagaagtagaggcaatatttccctggatgaggtacttactaaacccagggcacatgaaattctcataaaacaaatatccctctccttcactaaaataagtttataaacaagattacaaaccatcaaggaaataaataaccatgaggaacgcagattagtcagaagaaatggcacagccaagaactgcaaataatataaaatatgaaagaaactgcaaagtacatgtttaaaataattaaacagcttaaagaagtggcacagggaaccataatgaaaccataatgtcttatggaaaatgaatcagcagatatgcaatagaaccaaaagaaactccagaaatgaaaatatctgatgtggtggctcatgcctgtaatcccagcactttgggaggccaaggcagaaggatcacttcagcccaggagtttgaggccagcctgggcaacataataagactttatctaaaaaaagagagggaaggcaagggaaggggaggggaggggaggggaggggaggggagggcaggggaggggaggggacgggagggcagggcagggcagggcagggcagggcagggaagagaagggaaaggaagggaagggaagatatttgaaagaaagtttaaaatgcaatggacagcttaaacaataatgaaatacagctaaaggaagaattagtgaacttaacctagagctaaaggaataacccagaatgcggcacaaggacataaagagaagagagaagaggtattattccaagagaaaatgcctgagaacttcctataatgaaagtcacatctgaggttgaaaaagggcagtaagtcccatataggataataaaagtagatctaacattcagacacaccctaataatagtgaagaatatcagagaccaaaagaaaatctttaattaaaaaaaacccggagatataagacatgttacctactcaggaatgatagtctgacacaagagagatgtcagagacgatgaaataagatcttcaaagtgatgaagggaaaataaaaatgaagaatgatgcaacataaagacatttttcaaagactgaaagttctttcatagactcattgaaagaattatcaatggaatattttagcaagaaggaaatagaagacacaaaggtgaaacaatgaaatacaataagcaatgttgagctaggaaataggtaaataccttggtcaatttaaataagcatttactaagtaataataatgattcatttttgtggggtttataagatggaatcaataataagatggaataagatggaaccaatatactgaacaacaacaatatggttggttaaaaagaatgtagttaaaatattctatgtttccaatacactcaggaagagattgtgattaattttaaatttaagtcaaagatgcatgttaaaatttaggaataaccttctaaaataaaggaatagaataccttattttcaacccattagagaaaaaagagggattcaaaaacttgatcaatatggccaggcgcggtgactcaagcctgtaatcccagcactttgggaagccgaggcaggcagatcacgaggtcagaagatcgagaccatcctggctaacatggtgaaaccccgtctccactaaaaatacaaaaattagcccggcgtagtggcgggtgcctgtagtcccagctactcgggaggctgaggcaggagaatggcgtgaacccggaaggcggaacttgcagtgagccgagatccagccactgcactccagcctgggcgacagagccagactccgtcgcaaaaaaaaaaaaaaaaaaacttgatcaatattatagaaagcgatcacggagaaaaagagaagcaagtgcacactgggtttaaaaagcatataaaatagggccgggcacggtggctcacacctataatcccagcactttgggaggccgagtcgggtggatcacgaggtcaggagatcgacaccatcctggctaacacagtgaaaccccgtctctactaaaaatacaaaaaaaaaaaaaaaattagccaggcgtgctggcagtcgcctgtagtcccagctacttgggaggctgaggcaggagaatggcgtgaacccaggacacagagcttgcggtgagccaatatagtgccactgcactctagcctgggtgacagagcgagactccctctcaaaaaaataaaaaagtatgtaaaatagcggtgggtgtggtggctcatgcctgtaatcccagcactttgagagggtgagaggggagaatcacttgagccaaaaggtttgacactgcctgggcaacatagtgagactccatctctacaaagaataaaaaattagccaggcatggtggtgcacacttgtagtcacagctactcagaacgctgaggtgggaggatcgcttgagcccaggaagtcgaagctgcagtgacccatgattgtgtcactgcactcccgcctgggtgacagtgcaagaccctgtctcaaaaacaaacaaatgaacaaaaagtaaataaaatagtggtgcgctgggtcatggaagttaaaaagctgatgacaactgctggaagataaagtcttagcagaagagcctgccggtcagattgctgaggctgagtgaagtacagtgtccttgcctttctgagatgtgtgcttctccacttctcctttataatcaaagccgactgctgactacagagaagaggagacagaattggttagagtcagagctgacaggttttcctcttcctaacctccccttactcccagccagccccagaggtagtttgtaggggcttcaggctgagtataggtgtttaatgtagaaacaggctggtatggacacaggatactacagagcaatgaacataggccctggacacagacagttttaggttcaaaccctacatcccctatttatagttgttgaagtttaagcacgttcctttatattactaagccccagtctctttcaatataaaatcaggagaggcatgcctgccttatctacctcgactgtaaaatgagagaaatgatccctcttcatctgggatgtcatgagaactaaatgggacaaggtaaagtgtctacttagtttcattcactaacttagcgcttttcttcctaacgaatcctcacaaaagtgaaatgtgatacctagaaaagtgccttgtaaagtataaagcactctgctcatgaagagacattaccctattcccagttgataatgctgtgcctcttctctttcattactcaataatggaaacacaaatatgtggattttggtgggataactgcaaccaggagagtctggatcctagctggctctgggactggatatgttgcccagatacccaacattaccgcagagttttggagctttgttctccatctggctcaggaactatgggtatctaagcaagtctgggtttttgcatattaagaactaattaacatgtattgtttcttgatttacatgacacactgactgggtgattccatttgtggcttgtgagcaaaagatgtaagaatcggtgattaagcaaaggcaggcaagagtggtgccaagatggaacagggaattccatcctgattctagaacactgcatgctccatatttcactattgccttctacatcttcccttagctttgcagtatgttttaaactttcctgattttgtttttcatggttttaccccccatgatgcaaacaattaattttctagaacttagctgccttagcttccaatccttagctttaaggatgcatgtccacctaattaacaactgttggtaaaaacaaagaaaaaatctcagctaactgtgaaggagctgtcctctctctgtgtgcagctgcagggcaggagacaccattctgcaccataaaaaatgagttcaaagaatccgacctaataaggcgtggaactaaaaacatcgatgagttatcaatcttactctcctgtcaacgatatgatgctgtaatcatacggtacttttttttctctttaaaacaacattttgttttgttttgtacaaaggagtctttaaagatatctggacttcatagattgatgctaaattctgtaaatagtaaccctaattagttgtttaacttgattatctgctgctatggcaataatatttaaactgatgaatctgttttcctaaacggcatgagtatttataaggttttgatgttaagccaaaagaagagcttagatgattctctgttctatcttcatgcatatgagtataataaaaaccagtggcttgaggaattattcattcaaacacacagtttgagagtcttctcctatttgaatcactgtctttcagctcagcatgtggcttccaacattggcaccaaggaacttgctgagggaggtatccctgtgacggtgtcaggtcctcacagcatccactgtcctgtctttcaacaaagaagcatgtgcctccatccaggggtgatcgtgggcaattttcacaggactggaggtgggtggttgggagagagagtggtcacttaccttgtctgccctgtccctctcaactccgtacttgcccccaaagcctttggcagcatccgtctgagaagagtgcttctccacctcggcaacatactcatggcccactgcactctgagaaaaatcaaggatggagtgagtgaaaagataaaaatgaccttaaaaaaataaatacagatatggagtgggatgtaggcatgtaagaaattccattctgggtcagatctatagcctctgacagtggtgccaaggaatacgcgatgggagagcaagatgactttttctggagacctgctcatccctgttcttctctaataccattaggaatccttcattctgaacactcccataggatgggctgggaaccaggggatagagacaaggtagacagagcagtgtttaaaccagaaacaaaaagagctgaaacaagagcattgtgcagcagaacagagtgtagtgtggggtagtgtggaggagagaccaaggggactgaccggacgccatagccgggatggaatatttcactaggagagccaatgattttgttctagatctttgctcctgtatggccatcaaagttcagaagtgaactctgagctttatacaccatgtaatgtaggacatgtatacaaaaaaaatcactaaatacacagtaaataaaataataaagagaagttgcaacatagacataatacataaacatttaaatgcagcaaataattttaaaacatattttttccttctccacttgtgctccctgtcttcttggtctaggagttacaatgtggttggggctacaacaggccagcagttctaatatcttggttcttattttctgccatgtatatcttatgtgttgagatcagaaaaatttgatacaaataatatgtggacattatattttagaccaaatgactactgtacttttgaatgagttttaactcatgaaccaatgaatgagtcaaaaaatatatattttgatctagaacaaaagtatctgggtgttttagcaaaatttttaaatatacttaaatattatatactatatatttatgaataaactatatatttataatataaatatgttatatcatataattataatatattaaaatatacataatataaatttatatatttacatttacttataattatgtaacatatattaataatatatatttataaatatatttataaataattatataagtatataatatataatgtattaatatataatatattaattatatacttgtattaatatataatatattaattatatacttatatataatatatacttatatataacagatactatatataagtatatatataatatatcttataattaatatataataatataatattaaatatattatttatatttttatatattttatatatttatatatattttatatatatttataaataaaaatatataatatatattatattttatgtattatattttatatacttatataatataatatatattatatattaattatagtatataatatattacattatattacatattattactatgtaatatattactatgtaatatattacatagtaataatatgtaatataatgtattaataatgtagattatatattatatatgatatataatatataatatagatatattatatattatatatacttatatatagtatctgttatatataagtatataagtatatattatatatattaatatatatttattacatatattaatatatataatatatattaatatatatacttattatatattatatattataagtatatattatattatatatacttataatatatatacacttatatataatatataaaatataatatacattatattatatttataacatatataaaatatataagtatatataataaatatatacttatataattatatacttacatataattggctcttatagagccaattattttatagccaattattatagagccaattatttattatagagtcaattatatatacttatatatagttggctcttattatagaggtatataattatatataagtatataattatacatatttacaaaatatataagtatatatatcaattttttaatgtattatttatttattttatttattttttttttttttgagacagagtctcgctctgtctcccaggctggagtgcagtggcatgatctcggctcactgcaagctctgcctcccaggttcacgccattctcctgcctcagcctcctgagtagctgggactacaggcacccaccacgacgcacggctaattttttgtatttttagtagagatggggtttcaccgtgttagccaggatggtctcgatctcctaacctcatgatccacccaccttggccttccaaagtgctgggattacaggcgtgagccaccgcacccggcttgtatttttttaaagcaaatctttccctttcaacttaccttgtccattcggtctctttctactccaaaccgacctccatagccatgggatgctttgggccctgactccatctctttcttcctgagaacatcatgctcctctgatactttgttcctcagctggtggatgctggaagaaaccacatgaccaaggctcatctatcctagggagatcaagaaacccatcttcccagaaaaatggaagccttgaagtctgtcctgtttactttcagtaataacctgggcccccaaaatatactagtgatgggtctggaagtaaaagatcagtctggcctgcataccatagcctgatttaaactctccataggccaataatatttcctctagtctgttatttgctcactaaaataaccttctgatctttagtcccatttttcatgttcttaaatattagaggacaatggtacctatattctgataactggaaagttattttcttttctgaatggatctgctttctatcaattagaggatgtgtctcaaaaagcagaaaaatattcacataccattggacctacacattctagttttagcagtctacaccagggaaatgattttaaatatggcaaagcttaatgtccttaatgtctaaatgatactcattgaagcatcgtatataatagcaataactaagaaacaatctatatgaccaatggttggataatagttaaataaattgaaatactacctttcactagtgtactaggaagtcattaaatataatgcttataaaaacacagaactggggaaatttatgtaaacattagtggtattttttatgctttttggtcatgaattaagatcttctgccccttccccccaggctgataatacctgagaaaactaaggactaatgaaaactaactaagaaaatccactcacagttattgctataacactttaagcctcaaattatcttgatttgaagggacacctctatccctaagagaaagtaccaccaaaaaaggcattatctttcttacttcacacccacttccatctttaccatgaaggtgactgcaacaattaagagggcagaaagccatcttggccaacctctttggcttgaggatatgaagtgatagctcagccccacgtgacaatcagatctgttatttggacacatataaggatccggggattcttggaaacatttgggcaagagaaccctaaataagaaatttgactttctgcagcaagcaatgagggtttagggtattaagatagtgatgttagatggtgagctgggactttaccagcgcaggacaaccagacacattggttatacgtagaatggctgtctcacagcagaaattgtcttcttttaaggaagaatagatccatctggtggcctttagtggataattctaccaaaggtctttttaaaaagccttctcagctttagccgcagttaattttagaaagctggctatgaaccagatgaaattaagccaagtgctggaagaaccccctgttcccatgcctcctctaaactctctggcagcgttgaaagcagagatcttgtgttgtcagttcaacaccaacactgtgtcataagctactagtaccaaggacatgtaaatgcctgcccaatatcttccaactgaagtattcagatgaaagatcaagaaaatggggccaaaatttactttcaaatggaaaaaatctgcaattttttaatgaatataataattgttaaatgggttataactatattatagttaaaacaagtttttaaaagggattagaaaatgatactcagaaatattcatctaaaggataacagaaaaactagtcaggggatcataccaatgatataatttgaatgaaattgttgaggcccaaagaaaacagacttctttaggttatagtggaagtcattctaaacaggtctttattattattattattattgagacagaatcttgctctgtcgcccaggctggagtgcagtggtatgatctcagctcactgtaatctccgcctcccgggttcaagtgattctcttgcctcagcctccagagtagctgggattacaggcatgcatgtcatgccccgctagattttgtatttttagtagagacagggtttcaccatgttggccaggctggtctcaaactcctgacctcaagtgatcctcttgccttggcctcccaaagtgctgggattacaggcgtgagccaccacgcctggcctaaacaggtcttaatcacatcattccttcattttataactattaactaaacaacttttaagtgtgaggtactgttaggctctgaggacacaaaaatgttttatgtatggagatagaggacagctagaagagatagagaggaaaacaaaaaattccaattcaatatgctgtgttgtgcctaagaaacttttgacatattaactctcagatatccaatttaagttttaaaagactttgtattgataaagcaatgcagtttatgtgaaccaagcaaaatgtagcacctcaaagatgactcattcctcaatctgtgtttgttttttattacaaaactaaaagcacaaatgtgagtgactcagaatataaggtttttattcacagatgacctgatcatgtatgtagaaaatcctaaagaattcacacaaaaaaagctactaaagcattgtgcatttggctaggtcacaggatacaaggtcattatatcaaaatcaattgtatttttacatactggccataaacatttggaaactggaagttaaatataaatacatgaaataacatgaaacattttaggataaacttaacaaagtatgtgcaagacctaaacactaaaaaatatttctgaaaatattaaagaagatctaaataaatggagagatatcccatgttcatggattggaaaactcaatatcattaagatgtcagttctccctaaaatgatctatagattcaatgcaatcccaatcaaaatctgaacaggcattcttgtaggaattgactagtgaattataaaatttatgtgaaaatgtaaagtcctggaatagtaaaatcttttgtttctttttttttttttaaggagagcaaagttgaggactacataatttcttgacttataaagctacaataatcagtgcagtatggtatgctgtcagggtagaaaatagatcaacagaacagaatagagtccagaaatagacccacatgtatgtggtcaaagatgccaggtaagtcaatgggaacagaatactcttttaatattgttgaacaactaaataatcacatggagaaaaatgaacctcaatcttgacctcacactgcacagaaaagtctacttgaaatgggtcatagacttaaatgtaaaagctaaaactgtcagtcctttaggacaaaacatcaaagaaagtcttcacaactttggggtaggtaaatatttcttagacacataaagcattagccccataaattttttttcaataaattagacatcatcaggattaagatcttttgctcttaaaaagatgccattaataaaatgaaaaagtggccaggtgtggtggctcacgcctgtaatctcagcactttgggaggtcaaggcgggtggatcacaaggtcaggagctcaagaccagcctagccactatggtgaaaccccgtctctaccaaaaatacaaaaattagctgggcttggtggtgggcgcctgagtcccagctactcaggaggctgaagcagcagaatcgcttgaacccaggaggcagaggttgcagtgagctgagatcatgtcactgcactccagcctgggcaacagagcaatcaatcaataaataatcaatcaatcaatcaataaagtgaaaaagcaagttatgttctgggagaatacacttgtaaaacacatatttcacaaaagacttacatccagaatatataaagaactttcagcaacttaataaaaagacaaacaactcactttaaaagtgagaaaaagatgtgaacagatacttcataaagaagatatatgaagatatatgaatggcaaatgaaaatatactcaataaaactggtcatcagagaaattcaaattaacttaaaagagtggttaagttggttttgttgttgttgttgttgttttgttttgtttgtcttttagagaggatctcagtctgtcacccaggctggagtgcagtggggcaaacatggctcactgcagcctcaaccccctgggctcaagtgcttctcctgcctcagcctcctgaatagctcagaccacagccagccaatttttaatttttttgtagactctgaatctctccacattgtccagatggtcttgaactcctgggctcaagtcatcctcctgccttggcctcctaaagtgctgggattacaggcatgagccactgcacccagctaaatttaaaaatactaacaataacaaatgttgacaaaaatgtggagcatctgaaacccacacattactggtaggaatgaaagagggtaaattccctttggaaaagagtttgagagtctctcaaaatgtttaacatacacttattatatgactcagcaattctactcctggcaattttccaagagaaataaggatatgtcaacaaaaagatttgtacccaaatgcccatgacagtttcatttgtaatagatccaaattgtcaataatccaaatggctattgacaggataatgaataataaaactgtgacatatccatacaatgggacactacatgacaatataaaagaacaaaagacttatatacacaacaccatggataaatctggaaaacattatgctgaaagaagacaacacaaaacaatacattctatattattctgtttgcatgaaattctatgccagacaaaactaatctatagtgacaaaaagatcagtatggggtgtattgactgcaaagaggtgcagggaaattttcatggtaatagatatattctatatcttgattgcattggtggttatattatatatatatagtcaaaactcattgaactatttgcttataatgattaggtatcaataaatttaatttttgcctgggcaatggtggcttacacctgtaatcccagcactgtaggaggccgaggcaggcggatcacttgaggtcaggagttcaagaccagtctggccaacatggttaaaccccgtctctactaaaaatacacaaattagctgggcaaggtggcacatgcctgtaatcccagctactcgggaagctgaggtaggagaatcacttgaagctgggaggcagaggcggaggtttcagtgagccgagatcgtaccactgcactccagcctggatgacagagcgaaactccgtctcaaaaaaaacaaagttaatttttgaaaaataataaagtgaagaaaaccttaaatgaaagagactttgggcactcataaagaggtttgtttatgaagtgattgtagtattattaaggccaacttatcaagtactttgtcactgtaaacagaatagcaagcagccttagggaattggcaatagcttagttcatgggaatttgcatttcatttcaacaaaagaattacggacatgacgatattatgtttattagacaaaaacaatatattggttaagatttcagcccatggagtcagactgagccgaattcaaattactacaggttgactatccctcatcccaaacgcttgggaccagaagtgttttggattcaggattttttcaggttttggaatatttgcatatacataatgagatatcttggggacgagacccatgtgtaaacaggaaattcatttatgtgtcatatacactatattaaggaaggtattaaagaagaactaaataaatgaaggtaactttatttttcccttggggacgctgaaaaaactgttgtgcacctgtattttgactgagacccatcacatgtagtcaggtgtggaattttctacttgtggtatcatgtgggctttcaaaaatttcagattttggaacattttagattttgaatttttggattagggatgctcaacctgtatctctgtatcctcggacaaattgctaaacattaatatatccattcacttttctgtgaaatcaggatgccaacgtcatctatgatataggattgtttttaaaaagtactctgtgttttgcaagacatataatagcttaataaatgttagtcattattcttaagttatagccatggctcttcccagtacccctgtgaggtaaacagggatggtactataatctccagtcagcgctggaaatcaagataggatggtaaaatattattactctcctcagcatcataagcctttttacagcagagctggaatcagtccctagagctccagaattctatttctatactcttggcattacaccattctttatttccacttgctataaaatgtcagggcacgagaagaggacagggccactgaggcagacatcctatggttatagctcagtaaagatttaatctaaaggccagactggttccaggaagtgctgaaagattattccagagcagtgccactcagtgtgtggtccacaagctgaactgtttctgtttcacagggaaataagaataaaaattgagaatatgtgtttagaaacttttatagcaatttgacatagtgattttattctttttctttttcttttttagaaatggggtctcactgttgcccaggctggagtacagtggctactcacagacacaatcccactactgatcagcactggagttttgacctgctccatttctgacctgggcaagttcaccccttcttaggcaacctatggtcccctgctcctgggaggtgggaggtcactatattgattcagaattcagcgtggagacccaatcagcatagagcactatagcccagaactactggactcaagtgatcctcctgcctcagcctcctgagtagttgggtctataggcacagactagcatgcctgacaacatcgtgattttatatctgttgaatttaaaaataaaaactgtgtttgtattgtctatgttatttttaaccatttatttttccagaaacttaattgtattttattttacaaaagtatcagtctgtgacagatttgaaaataaacaaacaggtcaagggaaaagacacccttgagtcttgagaatgaatgggcaagagtggagaaaagaaggtggagagaagggtgatagttcttgaaaaccaggcagttcctttacagaatggataagggatgcataggaccatttgaattattcactgaattaccaaattactatccaaactaaatttattcaagacagacctaaaaagagacatcacggtgtggggaaggtagtaagattagtaagaactgcaaccacttccttttcctgcttttagtcgtctcagctctacagctactgttttgttttgtttgtttgttttttgttttttcattttgggatctgtcagtgttagcatctacagctactgttctcctctccaatttccctctcctttccaaggaccatggtgattcccatcagatgttaaagactgacttagcccacactaacgagagggaatccccaaatagtggagacttactactggaaagtcctctagaggtctttttgatccagatgggcaaaatgagaatcagagaggaaaagggacttgtctaaagccacctggcctgttaccagcagataccaggctttcactccttgataacctgggtaaatgggagatgagcgagatttttttgtcaatatctccatcgtttattctatctgatagattcagttaggttaacaaggaaatgtgcagggtcaccatgttgtaccactccaggcagcacccgtcagagtgatctgtgtataggagttgtgcaatccaacagtccaggtagacaccacttaggagaaaaaagggctgttgtctgtttacatgtttgttagattttagaaaggaaatctgattaaactaacctatattaacaggaaacaaaactaacatcactgagctgctcagaagtgctaagtactgcattagacattggctatcccattgacctgtaactatacatcttcagggtggctatttttttttaagttatttcatttttttatgagggttgcttgctcttttttttttttttttttttttttttgccaatgcctactatattgcaagtcgtcatggcggagtgttgggaagttttcaattagcaataatcacacctcggataaacctcattggctacaataccaccaaaggcatgaagtgtgcatcctcatctggacaattcccagaataccagcgttgagtggcctttattcagaaaaggaaaagggtcttgtggtttttttttttttttttttgatctatgagtctatagaggggtatcacagaagcttcctgaatgaccctgttccattgtttcaatctttttccagaatggcatggtttaagaataatattcattatagctacttaattgaaaccatttatttatttatttatttatttatttatttatttatttattgagactgagtctcgctctatcaccctggctggagtgcagtggtgcgatctcagctcactgcaacctgtgcctcctgggttcaagagactctcgtgcttcggcctcctgagtagctgggattacaggtgcccgccaccacgcccatctaatttttgtatttttagtagacacagggtttcatcatgttgcccatgctggtcttgaactcctgacctcaagtgatcttcctcgctcggccttccaaagttttgggattacaagcgtgagccaccacgcccggccgaaaccatttatttctgattaaacaatgtggtattgtcatccagttgtagaaacttgtgccaggctttcacagtatgttgcttgtgcaatgtggtcatccactgacactttttaaaatctagaggtaaaaacactgcttttagggtgcggtagggggagttaaaaatggagcttaaaactgtattaatcttgccattttgtgtgtagttgttgaatttttgcttgttacactatttattgtgtctaccttgctactaatgtttgacattctgatactatccaaagcagatggtcctggttagatgatcctgaatcatccgtggaagagagaaggggatctctcagcctgaatgtatgacatatcccacagaaacccctggatatgtctgtaagttccttttatcttctggtatcggagggttttgtttgtttgtttgtttctggtaaaatgcatatggggctataatcttaaagatccctgaacatcgttgccaaaatagtttttatcaacaggttttccaagtgttacatttcttcatattaccattcatggcttccaacttctgtcaaatagctaagtacaaatctgtattttaaaagttatttgggccagttatgggagctgaagtggcctctttttatagcatttattctgagttcttcaccttgacattttactgaattgttcttagttcatctgaaggaagtcaccctgaattctaaatacatatttacatttatctgaagagatagataggagatagatgattgccaggtagatagatagagaggaccttagtatttggtccacttcctctatgaatctctcatgccttactaaaggaagggaggcagttaatccaatagacccacttggggaaatagcagagttgttaggtataaaagatagataatagggttgaggagggtaagaggagagacataaaatggaaatatgcaatgacacacaggtacacacaggaacagactctagaaaaaaaacaaacacaataatacatagacatgaactaccctatccttttcctccctcaccttcccccaagtctccgagttttctttgggctcttcccataacccccttccttttctccagtcctttcggcacctacttgatgtgttctgtgcgtccagacccctcgatggtcttggctccccatcgttgctccttttcagagatgtcattctgcaaacgacagcacgcagtaatacatgacggcaagaaatgtgccacattgagaagggccacccaactgacacatgccctccatgtcccctgtgtccactgccttcttcagtctgggtctttattcacatcccctctatatttatcccatcctgaccccatgtaagaattaaactggtgaggccaggcgtggtggcttatgcctgtaatcctagcattttaggaggccgaggcgggtggatctctttaggtcaggagctcaagactagcttggccaacatggtgaaaccccatctctaccaaaaaaatacaaaaattagccaggtgtggtggcatgcacctgtagtcccaactgcagggactacttgggaggctgaggtaggagaatcgcttgaacctgggaggcagaggttgcagtgagctgagattgcaccaccgtactccagcctgggtgacagagtgagactctgtctcaaaaaacaaacaagaaaacacaaagaattaaactagtgagctctgaaacctccgttcctcctctgcctacttcatgcctaccccatctggtctcctacagctttttaatcccccaattacacatgcccagcttgaatcctggatcatgggccaggggagacccaggttcacctgcttctcaccttcagtgtagcctgccatggcctgtcaatcacactgtcaaactcacccacacctgtctcttttcatccctgataccaggtatcgtgcatgccccacaggtgacagccaattgtcctaccaattagtcccagtatgagggctgtctcagtcctagaaggcccttttccaagcatcctcaaagatcacagagtggcccagatgccctcctcaccccaccctctgcactgtccaagcaaagctacttccaaactcaccacaaagtcaggatctgtgtcccaatcatcaccctgggtctccacggaaacagacacatcatggcccactacagacttccacatctgagagtgaccggagatgggaataattagggacaaaaaaggatcaagaggagggaaaataggaatgctgaagtcaaaatatagcagcccaatatttcctgccattttttttttcttagaagaaaatagaaaatgaagcaaagcaaatgggagttgtaggaaggcttttctgctcagttacaagatgagagatgggactttaatcaagacgaattgatgtgggctgggcccacctggggctagagagaagtcatcatgggtgtgggtaacactaggtaacccacgagtcaaaattgctggaattgttcacttgtgtcccgaggccagccaggcagtggctggaggtggttggcaatgagcggtgctataatatccctagaattatggccttatttcactcaggtttctatatatgattcctttgttgctgttgaaatacaaattggttctgcttctcacaaagtgaacatctacatccctctttacaacctgctgaactacactgagaatttttccagcctctggtccaagtgctgtcccacctccaccctgagtctggtcacctcacagctgtgtaaggtcagcagcgacagtcggctgaaatttccacatggaacaatgcattgggagagcattatttgctgggaataagtcagttattactcaattttttaaaaatggttcaattaattgctaaagtcaaaaaatagcatgttttcaagttgacaatttaccgtagaaaagaaaaaagaataatatgtaataaatctgattttgaacattaagaggtactcagtttttatcaactaaataaatgttgcagaaatatttagagaaccctagcttggaagggtgccaaacttattctgctggggcattcccagtgttctagacggccttccggactgtgcagaaggaagagcggcacagttgctctgcatctgtggatttggtgtgaagaagtaacaacagacaatgctcatctgctgtggtcaccactgagacttcttgaccctggcagcacttgctagctggcaatccttccctcctcagacacctcatcccattggagaccttccccatgctctccatcgtctccaaagagtccctttacaaccactcctcgggttctcctgtctccacctaggccttcagattctccagttttctatttccacttgaaagctccatcttctccattgagcaacctcttaaaaaccagcccaggggaagtctgggtaaatcagttaaagagatgctaaggggacaccggagagatattgactgagtcagccgggagtcatggctgaaagcagcttggctttccctgatgcggttggagacagcaaaacatccttactacctgcatccttactacccctctgcttctcatcccctggctcctgggctgctgtgcaacaacaaaaggactgtcacacagaaaactggaatggagaagtttctgaaatagtcatgagcaataaggaagcaatgaggactgatggtcccatcctccttcctgtggctcctctgaggcctcagcctgactctcccattcacccatttttgaaataaagagtttctgaaatagagacaatttatctaatatccttgacctattgaccagaaaccagaaaggtaagaagtgctatctagaggtgagaaccagagagtaatctggtgaggccttgttgcgatgctgacctcctgcatcaaagtacacagactgggagtcagaagccctggctgtcaccccagctctgtgactaagcctctgagggaccatcacaagggcatcaacagagtaggtactcatttgccaggtatcagaccaggcgattaagaaatactaactttaataatttggcaaatcagcaattatctctgattttcccagtggaaaataatgaaggggttaacgtagctcatctgtggtctccttgatttctgacattctgagattctgtgatctacgaacacagaaactagccccagcagaacaatcatgccttctcttgggctccatcagcacttggtactcagtgctagtgtacatcagtgactacttcctgatctgttacatttcctgtgtgggtttgtttccctgagaccatatgctcttcaagggcagacactgttttcgtctcctgtggtcctcctcccagctcagtacctaggggagacaggccttagagtgggttgtagattgtcagcagaaaccaggcaacactttgcttgatgttggtgctagatggctcctgaaacacttgccttgggtttaagcccctcccttttgtttctatctccagatgctgatttgctacaaccactcacaaccaggccttctggccataaaaggataaaagcctactagtggtgaccttgcccatcaccaaggactaagagccaggtaggttcctcctcaactcttactctgtgtttcccaactgtcccatggctcagagtacccacctccacctgtgcaagcctctgttctaagcgcccggctcctcgcgtccacaccgactccctctctggctgctgccacttcggagtgagaaactgagctgctgcttcagttccgtattcaggttttcgtcatttcctgccaccccatcctcacagctacttcctgaaatttgagtcagttccttctgctttagacacttaaattttaaaaggattaaatgtttctgtgcctggtcttttgcaaggttttgacaatgggggtcatagagcagtcatagaaaatgctgctttgactctgagtttgtaatccagtgagagaaacaaacattcaaccagaaaacacattagagaatgctgtagaacagcattgtgtcctaaatagggtggcagttacatttgagacagtaaaggaattcagagcatttggtattgggtgtattcatcaagaaaggctttatgggaaaagtgatttatatgtgggttttgaagcataagacttaaaaagaaactcacccctatattacccacagcacttaaaagtggagttttcatatagatgttcaaataaacgtcgaccaattgaatgccagaagagaataactcatgagggaaaaggcaagacatggaaggagagtttcctagcttgtttggggcactgtggagtctgagctaacaaactaaagatttggctctagagcgtaggaagaattctgaaagaaccaggtgctggtcagctgatggaagaaggtctttgtggtatcctgttttactgcgtgtcaagacttgctgcccctcccttccctcttgaagtcagacttactcaggtgacttgttttggccagtgacagataccactttctggcggaggccgtaagaccactgcaagctttgccatgctttcaccactgcccaaggcaacctgcaattctccatattggctcctccagcagactgggtccctgagtgagaaagaacacaagtggagccccatccaccatgtgggggaattggagtctttcactaaaaaatagtcctttgttttggctactgagaatttgagggtgtctgttattgtatctgacctagcctttcctaatcttgattgtggacttcttgatttgttcacaacggtgcatcctccaaggagtttaagcaggactggatgaaactggcccatgatacaggcacttttctgcattaggaatatgaagcctctgtcacttccaaatctaaggattctatgcctgggggagctttatttattccttctactttattacctatttatcatggtggtaccaaagttatgataaggaagagtacgtttgtacaagagaaaaatcacttggaatcctcatgtagtgtcaaaatacgatttagactagatgatgtgacacaccatccaggtacatagttctctagagaaaatatagaaattaatcagagatgacaccaagaagtcccatctttccttagcaaatgtcacaagttcattactgatgaggtagtgaggtgtatcacacagaaaaagaatgggccttgaagccagacagacttggttcaattaaaccacttattgtactttgagaaagtgagctatcttctctcaagcagcaacttaatataaaaatccataatagctgggcacggtggctcacacctctaatcccagcactttgggaggctgaggcgggtggatcacaaggtcaggagtttgagaccagactggccaacacagtgaaactccatctctactaaaagtgcaaagattagccgggcatggtggcaggtgcctgtaatcccagctatttgggagactgaggcaggagaatcgcttgaaactggaaggcggaaggtgcagtgagttgagattgtgccactgcactccagcctgagcgaaagagtgaaactcggtctcaaaaaaaacccaacaaaacaaaacaaaacataataatgcctatctaacctgctacatgctattaagcttctcttctcccattcccacccagagggatccctaggggcctaatgttttcactatgtgccagacaagagttctcccaggaccatgcatggacctgcatcaatttcatgccctaaggcccagcttatttggttcagtattaggatagaatttcctcactgcattcatcacctggggtctagcagctaaggctggaaaaatgcatgcagctgtcactgatattggccagtgagaagaaagcctgaatatgtagagctttctacccctataaccattcctggctacctcctttccctacttcccttacccaccttccaccccccagcatgcaaacacaggtaccgaaacacctgtgcacatatccattcactcacacgtacacacacatacacacaaactcttcattctgaaaataattttattattttacagttgttcaggaaacttcccaggatgttgtaaccaagatttaatcaccacagtagatttagagcagatcagtcagcccacttgtcttctctcttctttagggagaggctaggcagtgaacacatcacgtatgcaatgagaaaataaccaactggtaggatgggggaggggaggggaggcagggaataggcacaaatggaattctatcctggctgtccttctcaggtctatctatatttaattttgtcttctctatattctccttccattgccacagagggcagagacaatggggctgagaaactgtaataactgtcactaacagcaaagtagcttagtacttcaagaggtcaggagttgcagtgtggtgttagaccagtcagactcctggctgagagtcaatgcctaatattggctcccagtggcccctgagcactgtctcagggtccacattccaggaatattcagatattcctggaatgacaagaattggaaccctgctgtccatagacacttctccctgccctttggtgaaaggaaagacttgggccacttaataccttagtatacatgtgatcaagggcaaaagcaaagggattctatccttatagtctaagacctgaaattctccctccaattatatctgaaattggcagggaagaagatgctgtcctcccatgtgatctaacagctaaaacccctagggagttccttcagctttcaccaccctattctgcaagagacctaaatcagatgtcctatgaggtgacatgttcatttccctgaactctgtttatggcagagccaccttccccctgaaacaggagaaaatacaggcaaacaaggcaaagaaagttatcaatcaaaatgatactgaacttcagattattaggtttattgaaaccatcctcttggcttggctgaaagacattcctcagtatcttttacaggaccacaaaagatcagggtcctgcaaaatctcaacaaatattaggctcaacaaaccaaatgtgattctcagattaagcagaagcgttcaggctcagggcagtagaagaaagcagactcgccagtccctgcagctccaacctgtcctcgtatccacctctgtttttgcaggcactttccgtgaagagttggagagaagacctgtaaatgggaagactgttccactggaattgatgttctgatgttagaggtgagagaattccaagttttgaggggagtggtccaaagagtaacaactaagtctatagatggcccgtaaaacacagaatgagcaggacatgaatcattagaaagtagatggctgctagaagtggcactcgggtccgtgaatgacagagtgaacgcaggactcgcttccatccaacgccactccgggtctgaaagaaaaatgtgaaagtcagagagttttcaccctatagggctatgttgctttccctcctactagtcttgcacttaagcaaagctgacccaaccactgtagaaaggggtattctgagaggaaagttgcctcagagtcaacaacttggcaaattccaccaggttctaatcttccacgcccttccagccttagactcattcgctgctcagtggctggacttccacattccttctcctcagctccttgcccccagtatagccagccctgtcagataataaaacaccctctctttatccttcttcctcttacccttcgacaactgttgcttgtaagatctattaacagtgcctgctcctgagtgccacaggagccaatgataggagtccgggaagagtcccattcactgtgctctaacctgagttgagaaaaaaaagaggcatagcattggttcatagcatgagaggctgatcaggcccagtcttcccagtcatcctgccacacaatgcagcacaggaggagacttgcagcaaaagctgctcccataaacccaaacccatgcaaggggggtaccagcagatacgtttccttcagcagcagcaaaatgtgacaataactatcaggaattgactgcctactcactatgtatcaggctctaggctgggtgctttacatacatttaatcctcaggttctgaggttggtcttattatcttcaaagtgctaaggcttacagaggttaaattacttgcccatggcggcacagccagtaagcggcagagccagaattcaatacccaactttgtctttcaagcctcacgttcttttttccaccacaccacacctgacttggagaaactcattacatttttttcttttattaaaggctaataggcaaaagcatccaaagaagatttctgtggggttttaaaaattaaattgaactaaaaaaaattaaattgaattggcagtctccactgccttctggctcagtttttgctgatttgcttatttaatactggaacttctccatttaatgaagaagctgccattactcactcaatggttatgtcaaacaaacaaaggagctgcatgtaacacagcacgtttgatcaagcatttgcctatagggatgaactttttcaatagggaagagaggatgaaactcttgcctctactctttgtgttttctccttctgaaaggatatctattagtttaatattcttgggctctctgcaggacacattcttttccccgggagagaagaaacaccttaatccaatttgtgagtctagaaagagaactgagcatgcacagcctagctccttctttcctgcttccctcctgagagccaggctgactaaaaaatacaccttctgtgtctattcctccatgtgataagcttttcagaagcagctttgatctggaacagcatggtctgttactatggaggtcagtctgtcaatgtaggctatgctgaggaaggatgagaagtctgtaggtattgatgaggaagatggtactggctgcctttaaactggagggccactgagttccacctgctctttagagtacatgtgagattctaacattacaatggcagtacctggactaggcaggcagcccttaattagctaccccaacttccattctgcatcagagctaaagagggaattgtggcttgaattaatacggcttgcccacaggctcaagagtcatcatcccacacatgcagtctcagttggtttgggacaggttagttacacaagagggagatcaacctccccattggccaggtttcaccggtctaaacaattcaatagcaagtagaagagaaacagtcatgagggcacaggcctgaaaatgctcggcagagatggcaagacaccacacaaggcattaagcaaagctggcccaccctcaaagctgcatatcaaggcctgaataggtgatgaaaattaagaagttgtgaatatgttggattggaaagaaaggtatctcaagtaagacctgctcaatggggctgtcacctctgccacataaactttacaagaaagcattaatatcagaaatgtcattctctgaggaaagtgatcatatacataggtggctttctcccaaaatataataaaagtgcctgcttttaacgatattttccgtggaaagggacttccagcagcaaaatacttgtagcaactctctatcctctcatgcatagtgattcttttgatgagaataaggaactagggatgtgtagctctgcccttccaaattacacttggagcaaactgctcataggaagcacagttcactctgttattccaatactcttgtttggcaagagcaggattttctgtgaaggaggtctaccttggcccaacattgtctgtgactgggaggggaagttcagggttaggaagtgcatttgccaacaaataaaaagctacattcttttaacatcatttataaagcagtcttttaatctctcaatcttttaatcttttaaaaaagatttccatggattcagatctcaggtagaaaatgaggttgtcacttatttggtcctctagagaacccaacacctacctcatatagttatggttagggtgaaataaaatatctttcagtaatggtagatatcattattattctctaagaacaactgttttagaaaacactgactctcttatactccaaaagtacagtgttctcttgggtgaccacaatgttggtaaactcattgcagcaactacctcaagatgagaaaaagatcttaagaaatcctaagtctggcaggaaatgtacatgagtttgatcagaaaggatcggaagggaacagaggctatctccttcagcctttaccgtctgatctgctcctcggccacagagagagcattctcagcagccactctttggtctcgttcttcttccagcagcttccttaattcattcacttcctgtctggtgttgcatagctgctgctgagcttcagaaaagctttaggatgagaggaaaacaaaaagcatcatcagatgcagaaaacagttgctaatacaagggattcaaagtcttcataaggttgtaaagcaagaaaatccatagaagcttgtctaaacacaatattttaaaagcaaagctgtagagggattaaatgaagctgcagaaaatacctaaagaaatttcaggaactgattatctttcattttactatcatagagtagttgttagtggtgtgtgtgtgttggtgttgctctttttgttttacaaacttttcacacacaaatgttagttattattgttactatttgatcctcacatcacttctgtgaggctaataagataacaagacatattaaatccatataaaggactccagttaaatctagattactgcccaatttctggactctggtgtatgctccagggtttagagagccactcccctacctttgctgcggttcccttagttcctcagggtcactctttctgtgaactccattcttttcctggggagctcctggagcaacatctatatttagtggcccctggaagaagaataagcttagtaattcagtgatgaaagctcttaagaaagtgtatttgagcaaaatgagagctcgtttacagaggactatccccgcttataattctcaagtccaaatttagaagtgagaagcttctgctctagcagattactcacctacataaaactcttgtcttgattagatttttctcccagattctcattcttgaatttctcctcttaaaagttaagtctgggccgggcgccgtggctcaagcctgtaatcccagcactttgggaggccgaggtgggtggatcacaagatcaggagttcaagaccagcctggccaagatggtgaaaccctgtctccactaaaaatacaaaaaattagccgggtgtggtggcaggcgcctgtaatcccagcaactcgggaggctgaggcagagaattgcttgaacccaggaggtggaggttgcagtgagccgagatcgtgctactgcattccagcctgggcgacagagcgagactccgtctcaaaaaaaaaaaaaaaaaaaaaaaagttaagtctgctgtggatgcttatggcttttccagaagccactttgatccttcccttgcttgtccagcccctcccaacccccttttcctcctccgtatcctatacgtctccatactaattctcagtctcctccaacttcaatgctgtactcctctccctggctgtcaacagtgctgcctgttttgttctcagatccaaagtttcctacaattttcttataacttaaagcaaaatcaacactttctctgtttcagagtaccaaatgtctcagtcatcactgtttcctactcatgttttgatttctctcccaccatctcactgatcttttttcttctaattgcttcactgtaatttttctcagaccttattcccatctcaattaactctttcttctctcccactttcttccctgacccctaattacattaacttcttccatactgctctgtagtgcttcaccacttgcactaaatttcatcacacttctcccagtctctcaccttctctttactcaccgcctgcagctcttgaacctgcttctccaagactgcacagtgatttaaaaggtcaccatagtgctgctggttctcacgaagactctgactggtatcgcagagctgaatggaaagggtgtttttctcttccagtagctgagagaactgaaacagaggcgaggataagcatcatcctgcagtactgtaagcagtgctgaggtgaaatgttctgagttttcaggatctaattttcctatggaagacctttgtttcagcaacagcaacaatagcactttgtgtgccttcaaagttggaaaaagcataatttttttttgaccaagacagaaaacaattctggaggagtagcagaaaggtttttttgttttgttctgttttgtttttttaaatggtgcccagtacattaactgaaaaaccatgaagcagaagtccataagcaatctaattacataggctattctgggtacataagagggagaaggcagtacctcagggtcaaagttcatggtactaacaaatgactataatctccagaactcaatatggctggagagagctgtcaccccaaaatctgtgcaataatattcctaggcagattcctcaatgccataaagagttataagttactgagagaatagaataaaaaattataatatgtggtagaagggagaaacagaataaatcccaacatgtatatgtatatgtcagaaactgttgagagcatagattctcccaggtagaaacatttcagtcccttaaagcaggactctcctctactgcatgactaacaggtcatcgttcagtcttcccttgaacatgttcagtgtcagggcgcccactgcctgacaaagcaacccaaaccatttaaaaaactgaaaattcatttttatattgaatgaaaaatttacctattgtagcttctacccattgatttgaatttggtactctggaactataattctctcacttgcaggctgtcaagttttaagttttagctgtgattagcctccaggtacattaataaccatggagatgtctctccaagttatctactctaggaccatgtacattatatgagaggaacccagtataccagttgcatgttcaattttttcttgatgattcttttttgtaagtttttgtgaaaaaaagttgaaacaaacaatgttttagaggagagacgacagttttctagagacaactgtgaggaagggcatttgatgcaaatagaaaattagaacaagataatccatacatacttgtaaaagtgctctgttagctgaaaattgctcttcagatgtagggttgttttttgtgtttgtcattctgaagagcaatgttagcttacaaagtactttcaccagtatcatcttatttgagagaggtagagaaaggatttctgtccttgtttacaaatggctagtagatgtcaaaccaggactcaagtgtggttcttgattccaagtctagagctctatctactatctgatggtgtccagtctgatagtctagcaaggaaagctaagaaaatcatagggttttcttttgggggggggggtgtgggaggaggtgggaatagttaggaaaggatataaatatttgggaagtgatactaatttgaagacagttaactgggtacaatgacaactattggattctgagacagggcacaacatgttcttcccttaacctaagaggaagttaattttcctggccacaatgaacagtccaaaccataccaaaaacaaaaacatagatccttctagtttaggggttggcaaactatgatccagggcctgctgcccttttatcataaataaggttttactggaacacaaccagcccaattgattctatattgtctatggctgcgtttgtgttacaactgcaaagatgagtagttgttaacaaagaccatacagtcaacaaacctaaaatattgtctgagcctgaaggaaaagtttgctgacctctcctctagcttataagctactatatttcactgtatctatacctgtaaaaacaaaataggagggaacaatttagactacattatgtcactaatcatccatctcatgtttttaagtttctagcacattcttacattacatactaacatccaaacagctggtagaaatgcagtcatcccttgttatctatggggtattggtttcagaaccacccctggacccccaactcccagtataccaaaattcgaggacgctcaaattccttatatataatggcagggtatttgcatataacttatacacaacctcccagatacttaaaaaattttttaattcatgtataatagatatacatagtttcaggatacatgctataatgtaatatattcatataatttgtaaagatcaaatcagtgtatctggaatatccatcaccttaagtatttgtctttcctttacgctagaagcatttaaattcttctcttctagctattttgaaatatacaatagattgtggtaaactataatcacctattgatttacctaacactaggtcttatttcttctatcaaaccatgtatttgcacccattaatcaacttctcttcattccctcctctcctttatccttcccagcctttagtaactaccaatgcactctctatcttcatgagattcacttttttttttttgctcccacacgagtgagaatgtgatatttgtctttctgttcttggcttatttcacttaacataatgtcctccagttccatctatgttgccacaaatgacagaatttcatacctctaaaagctgaataatattcccttgtgtacatataccacattcttaatctattcatctgttgacgggtacttacattgattctatgttttgttttttatgaacagtgctccaataaacatgggagtacagatgtctttttgatatattgattttctttcttgtagatacgtgggttgctggatcatatggtagttctatttttagctttttgagatacctccatactgttctccacagtggctgtactaacttacattgctaacagtgtatgggagttccccctttctctgcatccttgccagaatctgttactacctgtctttttgataaaagctatttcagcaaaggtgagatgacatctcactatagctttgatttacaattctctgatgtttagggatgctgagtatttttttttatatctgttggccatttgtatgtcttcttttgagaaacgtctattcagatcttttgcccacttttaagttgagttatttgttttcctgctatttaattgtttgagtcccttatatattctggttattaatcccttgttagatgggtagtttgcaaatgttttctctcattctgtggattgtctcttcactctgttgattgcttcctttgctgaacagaagccttttacttgctgtaatcccatttgtctatttttgccttggttgcctgtactcttcaggacttacacaaaaaaagccttggctagatccatgtcctgaagcatttccacaagttttgctctagtagtttcatagtttcagatcttagaattaagtctttaatccattttgatttgatttttgtatgatgagagataggagtctagttttatttttctgcatatagatatccagttttcccagcaccatttattagagagattgtcctttctccatcatatgttcttggtgcctttgtcaaagacaagttgcccctaaatgcctggctttatacctgggtttctaattgtttcattggtggtctgtgtgtctgtttttatgccagtatcatgctcattaaacaggtagtgtgatgcttccagctttgttttgtgtgtttttttgttttttggttttttttttttttgagacggagtctcgctctgtcacccaggctggagtgcagtggcgcgatctcggctcactgtaacttccacctcccgggttcaagcaattctctgcctcagtctcccaagtagctgggattacaggcccccgccatcacgcccagctaatttttgtatttttagtagagacggggtttcaccatgttggccaggatggtctcgaactcctgacctcaggtgatccactcatcttggcttcccaaagtgctgggattacaggcataagccaccacactcgacccagttttcctctttttaatcaagattgctttggctagttaggagtttttgtggttacatacatattaaattttttttcccatttttgtgaagaatgtcattggtattttgatagggattgcatttaatctgtagattgctttgtgtagtactgtcattttaatgatattaattcttctaatccatgagcacgaaatatctttcctttttttagtgtcctcttcaatttctttcacagtgttttataaatctttcatttctttggttaaattgattcctaagtattttaaattctttgtagctattataaatgggattgctatctatctatctatctatctatctatctatctatctatctatctatttttgaaacacagtctcgctctgtcacctaggctggagtgcaggggtgcgatctcagctcactgcaacctccgcctcccaagttcaagtgattcacatgcctcagccacccgagtagctgggattacaggcgtgcaccaccatggctggctaatttttgtatttttagtagagaagggatttcgccatgttggcaagactggtctcaaactcctggcctcaagtgatccactcaccttggcctcccaaagtgcaaggattacaggcatgagccaccatggctgactgggattgctttcttgatttcttttccagattgtttgctgttggcatatataaatgctactgatttttgcctgttgattttgtctcctgcaactttactgaattcatttatcagttctaacagttttttggtggattctttaggtttttctaagtataaggtcatatcatctgcaaaaaaggctaatttgacctcttcctttccaatctggatgtgcttttttttttgttttgtttttgcctaattgctctagctagggtatctaataatatattgaataacagtggtgaaagtaggcatccttgtcttatttcagatcttagaggaaaggccttcaatttttccctgttcagtacaatgttacctgtggcctcccatatactttaaataatctctagattacttataatacctaatacaatacaaatgctatataaatagttgttatactgtatttttaaaattcatgttttcctgaatattttcaatctacagttagttaaatctgtgaatgcagaaattaccaatatgaagggccaactataaatata

SEQ ID NO: 159 - DNA, 81945 bp, Homo sapiens
ttaataacagtcatccttccaaagcccttcacagcaataaatgtttccatattccagatgaggtttgcagggacctgtcctctctatcagtgtccacctggcgcctcccccgagtccggcctgcccttgcttctcccagagctcatggtgtttttcagggccgcaggctggcagggtgtccttctcccaggggactgagcctagggagagccaagtggaggtgcccaagtggaggagaaaggaaaggaccacagagaggggaggggaagtgggagagtcatggttaggacctcaggctgaggccttctgccaagccaggggtctggtgtcactcaactgggaaacactgtcagcacccaaagctgctctcagaggtgggggtgacgggaccactgcatgtgggaggcacacgggccctgtggcatccacagctgtggtctccttagtgtcctgtcacagacttgcaaatcaaagcccagagaggcggcagccagccaccctcccacctccccagcactcctgtgcccaccccatgcctgtttagcctctgcccttgctgcccccttcctctgctgtgtccttttggcaagaggaaggtacctcggggcagatttgggtggtccttgtgagacccagggcagagtgtggtccggggatacggcttctgtccagctccctgccagacagctgtctgatcctaagcacagaccagcctctcgggggttttgttcggccaggaggtgggctgaggggcaagtgtgtggaacatgcaggaacaggctgtgcagtggccctcagtagtggggggctggggacttctgggagactcctttgctcccattcgccatccatcccctttccctgatcagtgggccctggctctggacactgagtggagcagacagtcctcctgcccctataggttccacctcctgactggcactgtggcatcagcatggtccagcccgtgctgtcctgtcaaggaccacctccacagccagtggccccttcctccatctcagagacagagagacgctgggcacaaaagccctgttgaaagttcactttgaagggaagcccatggggtcatggcgacaacacttgttatggaaaggccctggcgcctccagcagctcccttgaggttcaggtgactggagcatccactgggtgccagcagtgctgctgggaggagcagggcacagacaggggccaaagctttctgaggattctccatctatagctggaaaagtcattcctctcactgcctcccctcctcgtagcgagaaccctctgcccacagtggagattgccatccggaacacgggcgatgcggaccagtggtgcccactgctggagactctgacagacgctgagatggagaagaagatccgcgaccaggacaggaacacgaggtacccctggccctgtggtcctgggctctgcccacaggcacctggctttccaggcagaggcagggccattgcctttcccagtctcccatggtctctgagacagagtacctctagtgctgctagaggcaggcaggcttctgggtgataaggccccatccaaacgccagggtatgtttccctgcatggaacaaacataattcctcaggctgagggtctgaccacagcccagatccaggttttggggtccctggagtgatgagcagggcctgagtggcagacaggcgaggctgagagaaggctgggtctgaccctgctgggggcccacatcctgcctctgttcccacccctacacttggctgccctgtagagccttgggaagggcagcgcccaggctgggagctggccccgactcattgccctccccactcctcttccaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaacaggtcatgttcaatttcttcaaagttttaacataaaaataatgagagccaggagtggggccggggcctggggggacgaaggtggtatgtgaacaaggttggcacacaggcctcaccctcctctgcctcagattcccaagtgggcaggtgggggtgaatggggctccgggtagcacctcagctcctctcagctcccctcagcctgttctccttccagacccagagagctgagaagagtagctgtgaggctcagggcaagaggctctctgcctttcaggaacagccctaaccctgctccccttgcttggcctcaggaaggtgccgcgagctctcctgccgtccctgggccgccctggctctgctgtgtccagatggtcaggctactgccagctggggccttgctgctctgaagtcccctgcggagggcccagtcctgtgtgggcactgctgggctgtcgccagcctgggtgcaggagggctgttctagctccagtggcacccatagccaggtcagctggggccctttcccaccccagcaggtgctgtggcctgggccagctcctgccttacaagccagctgtgaggaatatgggaatagccctcccggcctggtgccagctcttggagttgacacggtacagggaggagacacagcccagggtcccttcccagccctgcctccaaggagttcatgtcccctctgttctcatctgtaatagggaggtgtccccattcttcagaatggacacaggatctgggagggcagcaaactggctcgcagctccagccttactgaagagaatgggcacagatccgggcacagatcccagcacagactgctgccaccctcagctgttggcaggtcccatgctgccagggcagggctagggtcagaggctgctgtgctccctggaagtggggtagggccccatgtggggcagaggcagagctctgattagggattggggttcttggtcgctgagatgtgagaggagggctcctttgagcacatgttagcatgggactcttcccagggagtttgcactcagggcctctgccctccatcaaagagtggaactccccagagccccatgcacagcaaggggacagctgggccttactggaaggccttgaacaaaggggaagattcccagcccagctgctcttagacatgaacaggtttcattgctgaggtgtttgttctgtccatgaggtaggaacctcggcaatgaaagggtgaggcagccctgtgtctccacaactggggggatggaaggaaccttggctgcctcaccccacaggtcgggcagggccacctggctgggaggtgccgggaaggctgggccctcactcctgaccgccagctcacaccgccgcaaagccatctccacaaggtctggctacaacacggagggcagactcaacagagaacagtgttgttaccatgaaaatgacaacctgtctttggaggaggccccgtgccactgagcatccagaaataaaccacaacatggacaggcttagaacaacaaggaaagctgccaggtcagaagagaaaaatgagccacaggggtcggataaggctcacacacgtcctcagctaaaaagggcaggaacagaaccttccagaagtccctgcctcacccagtctcagaactctgctaaggtgaaaacttaggctctgaggtcatagaaagggcagaagacctagtcctggccctcttctgcacctgaatccatggggctttggcatcaccagatgaaaaatgaggcatacgcccacctgtcagggtggctgatgagagacaggagaggctagattggcatcagcctgaaggcaccactggcaggaacatctgtaggctggtttggcacaacctaggagacgcctgtcctggccccagcagccgaaatctggtgaacttccccgctgactggcaggtagcagaggcctatggtgggcaggacttgcccaaggccctggtggggccaggatgagaaccctgagcctgtcacctgtgagctcaaaagctctgcctggcaacctgtgagctcaaagctctgccaggcaaccatgggcagtttctttgccctctgtgggcacccctatcctaccacctgcagttgggctgagaggccacactgagtgaggacggggcaggcatagaaggatgtggccaggtgagatggggaagccagtgctgtgggccaagagactgcagctcattctgtttattcaggtgggcccttgcatgggcccagcctttaggatgggttttttctgccccaagtaggggtcatgggtaggatggaagctgccagaagcctcttaggcctggccctgggtgggggtcactgctgcgggggtggcagatggggtcctggctgttcctcagggaggggcaggtaattggggtcttctgcaggggcatccaggagcagctttctgtggggaggggcccgtgttgagcacaggccagcacaggtccccatcggtggggatccttctgagggtggggagagggagggagggctctcaacactcacaggaagccaggggtctgcaggagcctcttgcctccaggctggttggggaagacgtcctccaggaagtagtagatatggcccaccgcaatccctgtgagacagccacggactgtggggtcaccctccacagcccagagtcctagaccagcagagcctgccccaggcccccatccacagcctggtggccctgcaggccccacagcatgagtgccccaaagccttgcacagagtgccagccccgggttggccgtgaaggacaagcttaaaaggcccagaagcaggcaggacccagggaggggagggcctgagaatagtggaggagtgggagccatggggcaggaaccctgaccctcccatcctcactcccatcaggaccgtgcaagcatcagtagatccgtcctgacgatgcaaattatgtgggccggctggcttgaggggctgtaagagcacagcagctgggagggcaggaagatggggatggagccaggtgtgaggagaactccagcaaggatgggagaggggccccagggcataagcagcgtgtcctgaggggagtggccagcctggggcggactagatgtaccgggaggctcacccagcaggtccacgaggatggagttgcccagcagcagcgagaagcccatgagcgcccaaggcaggaacggtgcctggaaagtgagcaggccgaagaagttgaccctcacccgagggctgcggcggctccacacgtacaccagcatggccatgagggcctggcccaggaagaacaggctgcccaggagtcccagcagctgggccagagtcaaggtgctccggtgcaggcctcagcccaagcccagggcccctctgacttcccaagaccctggaattcttcccctcatctcccctatgtgctattccctcatcaagatgagccagtccaataaaggcgacacactccacgggcttcaggtcccacgaaatctgccctgcacacctacagcctcatcccagggcccaaccactgcctgtccctgccccagtttctcccggctactcgcattcagggctcagctagtggccctgacaacccacctggctcttttgtgcatggctttgtattttgcatacagcactgaagatctagccctgacccctgcagctgagcacagagtgggccctcaacacatactaagctggagacagcgactgtgtccctctctggcatggctgtgttggccccaggaccaacacaggctggacgccgaggcgccctagcccgaggttccagagcctgcgggaaggatacggtcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccggcctctctcccagcccggccggcctgccctccacccagcccgtgtccgcagggcgcaggatacacgaagagcatgttgaagaagaagctgaatcccaggggcccgaagaagaggaagttggtgacgagcctccagacctacgggggacgggcggtcaggtgcggggtgggtgggtcgggcccacaggtgcgcggcgcggggcggcctcacctggaacttccggaacacaaggtgcgggttgaagtagagttgaaaggggctgaggagctccagctgctgtggaaccaggggccagtcaagagctgcccgggagccacgccgtaaccatggcgaccctcacccctcccgccagaggctgtaaccaaggcgacgtccggtccgcccggccgcttaccaccgcggcggtggtgaggacacaggctgcggtgtaagcccgcgtcaccgccggcacctgcaggaactcggccgctagtccctgccacgccattgaaccttctcaagcacgcgtggcccagccagcaacgcgctctttaacccgcctcccagccccgccttcggccaatccgcatccgaggcgctgcgcgccccaggctgaaaagagagcccctgagcccgacagccaatggaaggaagaagagggaaattaggggcggaaagggagagtgggcgggtagaggctggtggccaatgggcaggcgccaaggttgagcacgtggcggttgttgtggctgcggtggtggcgcgggagaacgtgtggccaatgaggaactggtcatttcgcggctttctaggagaggaccagtagcgtggacccacgacaccacgggggcggggctaagatcgtatgggttacaggagcgaagacccgagcaggcgaggcaaaactggaaagggcggggcgcgtgggcggggcgcggagtgtggcggctcagaccgtgctggctcactaactgacgacctagccacaacgttgtcctcgctgccagcccaagacaggcccacctaacccacagcagggaggcattcgggaatgtgtccaaacctccccaaacgtccagggccccactcaaatgtgccggccgctgtcggggttcttccccgggggcccaaggaaggagaggcaggactgcgggattgagtccaggtggggcgcgagggttgagaggcgcaccagagcaagtggacaggcaggagaggtcctcaatattttggtggaaaatagaaaccaacctacccaccttccttccctccttccctccctccctccctcccttccttccttccaccgtttattaaacaactgtttgcctgacactgttctagatgttggggatgtagcatgcaataaaagacactgtctcttagagtccagccaggaggcagtcaatacaataagctagtgctgacacttgatgagaatattgccaagtgaggggtggggccacgtgggcgtccgcagtgccaggtggggtgacctgggatacctctaaagtttgtcactttgcaagcatccctgtgtccatcaggatggtaactgtgaaaagcaaaacaataaaacaaaataagtgttggcgaggatatggggaaattggaacccttgggcaccgttggtgggaatataaaatggtgcatccgctgtgaaaaacaatatgatcatgactcaaaaaattaaaaatagaattaccgtatgatccagcaatgctgcttgtgggtacacattcaaaagaatcaaaagcagggacttgaacagatgttcatacacccatgttcatggccccattattcacaatggttcacatcagttcacccaccgatgagacagacgaaatgtgctgtctacatgcaatgcaataccattcaaccttaaaggaatgaaattcggatacatgatgcagcatggatgacccttgaagacattacacccagtaacataaaccagtcacaaggctgggcgcagtggctcacacctgtaatcccagcactttgggaggccgaggcgggtggatcacctgaggtcaggagttcgagaccagcctggccaacatggtgaaacctcgtctctactaaaaatacaaaaattagctgggcgtggtggcgggcacctgtaatcctggctattcgggaggctgaggcaggagaattgcttgaatccgggagatggaggttgtggtgagccgagattgcaccactgcactccagcctgggcaacagagtgagactccgtctcaaaaaaaaaaaaaccagtcacaaaaagacaaatactgtatggttccacttatatgagaggggatcagggagttattgtttaatgagtgcagttccagtttgggaaaatgaaaaagttctggagatggatggtggggagggttgcataagaatgtttaataccactgaactgaacacttgaaaatagtttggacaaattttatgttgtgtatatgttactaaaatttaaaaaaaaacaacaaacctctgtgtttgctgtcagggtagtggactgccagaggaatccttgagcagggggaatccttaagggacagtgattactttcggggctgggaggtggaacctggaggacaaggaggggtgggatatgggtttgcctacagacgggacagggctgagaggggagtccaagtggattcagaggcctgagccgcagagtggttggatggtggtggtctttgttgagatggagggctcgtggggagaaggtgaggggcatagagggtcctgttctggactcatcgaatttgaggcatctgtgtgacatcacttggaaaaatctgagtgtggtgttggggtaggggttggagcagacagtctaaatgtgggtgccgtcatccagtagtagatcaatggtatttgtagctttgggcgtgtgtgagatgctcaaggggcaagggttgatggagaaaagaggccaggcctgggtagcctgacctgcagtagccagggagggaaggcagccccagctggggaggccaagggaggctgagccaggaaagggcttcaggagccaggcagtgagaatccagggagacgtggcccgggaagggactgtgaattgcagccatgccaaggttcctggtaaccaggataatggcaggcaggagggagaggaaggcacacaaatggatgtgccttaacaaacaaggggagtgcagccttggagggaagtgtggaaaacgagggatgctctggacagggccctgaggtcccccgaggagactggaactggccaagagggagaactggctgagaaggctctcaggtggatcccaagagcgtgagggtcccacaagggccctgagaggggttccctggggagtggggtgagaccagtgcctaatgacagtgggttcaggagccttcctccctgctctggaggggacggggagagcctggagtgctggagggaagtgcatttgctggagggatgtgaggagaaggtctggcctcatacagcaggggttggaccaagacactgaggggttgggggctgggagcagggtgagcggacccccgcagacaaccttggttttccagcaaagcaggctaaggtcatgttggaagcatgccaggcagagcaaatcccaccctggcagccacagtgtgcagcagggcggggacccagggcctctgacgcctgggcgggcgcccggtgggcacaaaggagccggtgcaggaggtcgggtttcatgtcagcgtggggaaggggagatattcctcctccaggcacttagcaggcgctggccggccctcaactcagggtcaggctggggctaacaggaggggatgtcattgtcgacaggggcgtctgtctccccttcgactgggggccgataaggcaggcgcccagattgggggctgagaagcacattcctgggaggccaggagcctggggcgggtgggggaggccagccagggctgggagggaggacatccagggaacagcagctgggtccactgcagaggctccctttccggagccccgggatatcctcagatgggggaactgaggcacgtaaggatgcagaacagggcctggggcagacctccattctttcttgtccagtctgaggcccagaacaggccactctggaaatactaggtccacttctccttggacccttgagcccctccagataattctttatagagggaagccctgggcatcccaagttcccagggtcctagagatgcagggtgtgccttaccctaacatcagggtggcagacctgtcggctgggccagccttctttctcctgtgctgaggatggtgggtgggtggagacctgtggttcctcggcaaggtgacaatgggctctgctccccatgccacctccctggcattgtgacgcttcctgctgactcccagaggacacctagatctcctgtccaggccctctcagtgtctgtaggcaggatagcgccctctgcatactctccccacccagctttccccctcactggcctcacacactaggaggggccatcctcagcccccaagcctggagtcagctctataccctcagccccatgttgcacttttttttttttttcctagagacagggtcttgctctgttgcccagactggagagtagtggcgtgatcacagctcactgcagcctcaacctcttgggctcaagtgatcctcccacctcaacctcccaagtagctgggacaacaggcatatgccaccatgccccgctaattttttaatttttttgtagagatggcgtctcactgtgttgcttagactggtcgcaaacccctgtcctcaagcaatcctcccttggactcccaaagtgctgggattacaggcgtgagccaccacgcccggccccctatgtcacacttgatgctcccatggaactctctagtcctttcccttctctcctatgccttaccaccaccactaactcttattcaggcctcaggttctctcctctaatattgtcccagctctctgaactattcattctgttaaaaaaaaaaaaaaaaaaaagagtaaggctgggtgtggcggctcacgcctgtagtcctagcactttgggaggctgaggaaggcggattgcctgagctcaggagttcaacaccagcctgggcaacatacagaaaccccatctctacaaaaaatacagaaattagccagacgtgctggtgcatgcctgtagccccaagtgggaagggggagagagccagggggctgaggctggaggatcgcttgagcctgggaggtcaaggctgcagtgagcagagattgcaccactgcactccagcctgggtgacagagtgagaccccgactcttaaaaatattttttaaaaaatgtttcctggctgggcacattggctcatgcctgtaatctcagaaccctgggaggccaaggccggtggatcacctgaggtcaggagttggagaccagcctggccaacatggtgaaaccctgtctctattaaagatacaaaaattagccaagcaaggtggtatgcacctgtaatcccagctactcaggaggctgaggcacgagaatcacctgaaccccgggggcggatgttgcggtgagccaagatcgtgccactgcactccagcctgggcgacagaacaagactctgtctcaaaaataataaaataataaaataaatatgtttcttaaaagcaaaataaataaaattaaaaaaataagagaggaagagcagagggtgaaagtgcctcctactccaggaagccctccctggtcaccttcaaagggaccagagctcacctacttctgttagagtcctgagcacttaatttttaaatatattttattctaaaggcagtccatgcctgttgtaactaaccacaagaatcaaacaaactgaacgtttgtgtacctgctggtgcagctgtattttcttcttgatgacacatagtgccttttgggccctgagcacttgtccattgggggacctctcccctctttgagcacggggcccaccccctttgagcacagggacccctgcaattgctgtgagtaggcttccagctagcccctcccagaaacagctgtgtcccccttggcccttcctgtctgggccacaggctatttttagcactgaatccggaacccacatagcagcagctgcttgtggccggagcgcaagaacaacaaaccatccaggtgggttgtgtcaggctgcagagggagcggcctgggcctggccctctgaacctggtagcagaatctggactttccaggaataagctggtctctgggtgggatggggagggaggaagcagaatggggcagaggatgggttgcactagctaggccaggataggggaagggcctgtgcaaaggccctgaggtaactgggggagaggaagggagcagaggagagaaggtgaaggaggcaaggaagaagagttgcttgtgacgggagggagaagcggggccaggccaggcagaggtgtgtcggccgtggtctctgtcctaatcagatgagccggggaggagagcggtggcctgcagtggcttgcattaacagcgagggagtggaagggttaggatggctgaagccacaggccttagtgaatgcttggtagtgggggtgaaggtaggaggggtcctggcctacccagcttgggggacagtgagcccccactgggtggagacatgggtgaatggccagtaagggagggagaccactcgttgagtcaggcaggtgagcttggggtgctgtggggtggaagccctccctggcctctagcccagtcctcccagctccttcccttccgtggccctggtcattcctgcttcatgcagaagggctgcagttgtccacacaatggcccctctaggcctggtttctgctgcggagctggcacaggcaggggcttggtaaacagggaaaaacagggaaacttgtgaagacagagacctggactccagggctggaaatgcagcctcggggctggcattgtgacctgagcactcccttccctctctggctctgtgtccctctctgtgagatgcgggtcagaagggtccatgtgtagagtctctttcagctccaaggttgtactctgatctataatgggggtatcagagatttctgggtggaagccccttcctgtaacaaacacagctggcctccccatccaaggcccatctctgctatgaataagtgaatgcttatgagcaagaatgcaccaacagaggaagctggagggcccctgccagtcctctctgccggatctgttcctcgctgtctcctctcagccaggagccttcatgggcctatggtcaggaacagccagagaggcctgcagggctggggagggagtcgctgtgggtgcctttttcctgcaggagctcagcttctggccaggggaggagacactgaatcccataccaagcagggagtggaaatgcactggtgagtggtccagggcagccgtggggcaggagagctcctgatgaggacaggaggaggaggggatgtgctaggcagggacaaaggcttaagcaaaagtggggaggcaggaatgggcccgtgtgctgctcatggactaggcaaggacctgtgaagtgcgggagataatagctgctcagtgatctatagccagactgcaccatggcttttattaaactcaccgaaccctcatcaccacctgatgaagtaggttactattacggatgagaaaataggctcagagaggttcagtaaactgcctgaggacacacagctaaagaggcacaaaatcagcagtcctggctttgccaccataacgggtgatggaagggacccatgcggaggaagtgagctatccctgaccccatcactggggcacaggggagtgagggacatcaccaaccagctaatgctgtgcagccccagacccttttccagctccggtttggaggtgagaactttttgcagcctctgggctcccagggagcgtctccaacatgagactccactcctgagctgcctccctgctgtctgggcctcgttttactgtctctgacccttcatggctgatgaaactgtctccattcagccctcagctgcgggacctgcctgagcctgtgtcctgactgtcatgacccagagcaattgccaggaattcccacttcctgctgtggccgctgccagaatgtcaaagccacctccggccaagcaccccagagctccagagcatctggtgggggcttccccctcccctgcctcagctattttcaagctcagcactgtgggcggtgtagggggagaagcagattatctgtttggcagagtcagccatatggcagggccagggatatgagttcacagagacaaaacctgagacagctctgtctttgacttcgaaaaagcctggcggagtggcgtgtggctgtagtcccagcggaggcaggaggattgcttgagcccgggagttcgaggccagcctgggcaacagcgtgacactccatctctacgaaaacaaaactaatctttagggactggggccaccactctggaaggccttgcccaggactagtgactcagagccatgggtctggtggaaggagaggttcagaaaggcctgggttcagccaggtgcggtggctcacgcctgtaatcccagcactttgggaggctgaggctgacagatcacctgaggtcgggagttctagagcaacctgactaacatggagaaacccgtctctactaaaaatacaaaattagctgggcatggtggtgcatgcctgtagttccaactctttggggggctgaggcaggagaatcgcttgaacacgggaggcggaggttgcggtgagctgagatcgtgccactggactccagcctggacaacaagagcgaaactccgtctcaaaaaaaaaaaaagaaagaaaggccttggttcaccccacctccactggcttgcatccactgatagccccaccaagcagccaggccctgctcccatgagtgaggggcatgctccccgtgccaggtgattgtccagccgctgggatgggaggctcctaacggtgggctgagatgacaacccaggtgacccatcctttcacagtgacaccaccagggcccctgcctccacgtcctcctccaaacactcacccagccctccaatgcccttcactttcatgagactggggggcctctttaagaaaatgaatgcaaaacagccgggcgcggtggctcatgcctgtaatcccaacactttgggaggccgaggtgggcggatcacctgaggtcagtagttcaagaccagcctggccaacacggcgaaaccctatctgtactaaaaatacaaaaattacgaaaattagtggggtgtggtggcaggctcctgtaataatcccagctactcgggaggctgaggcgggagaattgcttgaacacaggtggcggaggttgcagtgagctgagatcgtgccattgcactccagcctgggcaacaagagtgaaactctgtctcaaaaaaaaaaaaaaatgcaaaacaaatgcaagattaggtcgcaaagtgagtatttgaaatgcaaacaaatgaccaatttggttgccccgttggagagaagagaaaaccgaggctgcggcacggggagggcttccttggtgagggcagacgcaggaaggcacacctgtcccactgcttgcgcatcccaaacctgcagaaggtggtccagccacagcggactggctgctgtggcatctccccacccccttccaagaggccctgcttagaggccccctccgccccaaggaatgcaggcatcagtgcttcagactctggcctaaccaccgtccccacctcccaggcccccaccctttccctccagatgtgggcacagctgtatttttagaacagccgaccacgaggacattctttccttctaattaagatggcttcaaatctctcatctgcaatcagccccattgttcagtcctcaaacatcaaagggtggccaggaggggccgcctcagctggttgtggggttggggcttgttttctttctttctttgtctttgagccattacgctggaaatgagacccagaaccggagtggatgccagctctgaggaggaagaagcaggcctttgggtagtttgcaggacctgcctgtctgcacccctgcaccctgtcgccaaccttgagtgaggttgtccagctaggctgcagccccccagtgcacccatctgaggttagggtctgtctgggacaactgcgggatcaaaaaaggccctgtgttggctgggcgcggtggctctcgcgtgtaatcgcagtgctttgggaggccaaggtgggcagataacctgaggtcaggagttcgagactagcctggccaacatggtgaaacctcgtctctactaaaaatacaaaaattagccgggcatgttggctcacgcctgtaatcccagcaagtcgggaggctgaggcaggagaatcgcttgaaccccgggggcagaggcttcagtgatcatcaggcctcctgacctcctccctctcccccgcaggaggcccctggtgtaggacagagatgcccacccacgtgggggcaataggaaaggctgcagggaggaatggcctctgggtagccttgaaccgtgttacagtcctccgtgctacagcgctctcaagcccactgacagatgaggaaaccgaggctcagagaggccaacaggctggcctagagctgctcagcccactagcagtgaggtgctcaggaacgctaggtccccgcagtcagccgtgccctgcacccctcactcatccccagggatggaccgggcctgctgctgcctgagccttggctccaggtaggaggcacctgtcccaccccgcatggagcagagaggagagccacgcaggcgggccgaggccggatgggactggcgtcaggcttctcagctccccagggtcctggcccacccggccccgcgcggctggatgtgaggacagggcaagtgaaatcgcaccggggcgggtggcgcagggcaggaggctgcaactcggtacaacggccaggactggagcgcccaagagctgaggggcagggagggcaaggcagaaaggggagcctccccagatgaagtgccccctacccagcggcgcctgggcgcaggcctcctttgtgtcaccgccaccactgaaccttcgcgagtcggcggcaatcgctggtgctgggttccgcagagcccgggctctgtcgccccctcgcggccggagccggtctgggcggcgtcggggaaatcccgaaaagcctgcggggaagaagctgaacgggggcgggacccgggcgcggtgagcccattcattccccgagggctgggaaagtctccaccaggagacggaatccctgggatgtccccaacgctgggccctgcctccctaggcccaggtaacaggcattttctaagacagttcagggacacggaggcaccccgctggaagagccggtgggctcccgggtggggtacgggccgggtgggagtcagtatcaccagcgggcttcgctggattgattgtttttatttatttatttttaaatatttatttatttatttttgagacggagtttcgctctgtcgctcacgctggagttcagtggcacgatcttggctcactgcaacctctgcctccccggctcaagcaagcctcctgcctcagcctccccagtagctaagattacaggcgcccaccacacacccggctaatctttgtatttttggtagagatgaggtttcaccaggcagacctcagttgatccgcctgcctcagccttccgcagtgctgcgataacaggcaggagccaccgcgcccggcctgtattgattgtttttagtttgagctgcgctcctcccttggcaatgtgaggaagaccagctctgccagccgggctgtagggctggtgcgggcaccggcttggcctcacagagcctcagggactcccctcgtaaatgaggctgacatccacatatgggtggttgcacctagcactgcacaggacggatgtgagcaccaggctgctacaaatacagatatgactttcacatgcccaaggttaaactcccagtcaatgtttgctgaggcgaaacctagagcttcctggccaaaggataataattaatgtctggggagcccacacatggggacctgtctccaacgagatgggggtggctttagggcatccaagaggcatttcaaggagaatcaaggggcagccaggtattgttaatggtggccaggtcaggatccagtctggcagggtcttggattcaaggttaaacccagttctaaatttgggacttatccccaggctcgcccccaggcttttactatgtagacatatatattcctacacacattaggtacggttttgtatatttccaaacaatatacaggcataatagtgtaggcatctttctgcaactttgttcatgcagcgttgtgattcacacatgttgataccgttcctctagtctagtccactgattttcactgatgcatggtattctatggtattctacagcttatatctcctttttttgcatgattgacatttggatagtttccaattttcctatggtacaaaagatgctgcatttgtgaacagttcctgagcatgggattaagagtttctccaaggtaaacccaggagtggaattgctgggtgggagaggtatgtgaacttcaacttccttcatctgcccaaattgctctccagagtcattgcactgatttacatttttccttccttccttccttcattccttccttcctttttttgagatagggtcttagtctgtcactcaggctggagtgcagtggtgtgaacatggctcactgcagccttgacctcctgggctcaagctttttttcccacctcaacctcctaagtaactgggaccacagctgtgtggtgtgccactgtgcccagctaattaaaaaaaataaattatagagacagggtctcaccacattgcctaggctggtttgaaacttcagcctcaaatgatcctcctattttggcctcctaaagtggtgggattacaggcatgagccaccacacctagttccaactgatattttcatcaatagtacgtgggtgttccagctgatcaacaccaccacttggtattgccagaattaagctgttagtctgttgagtgggaaccaatatgctgatgtggatttaatttgcatttcctgattactaatgtagctatcttttaattaggttttttggtcatttcagtttcctcttctgtaaattccttgttcatatcttttttttttttgagacggagtttcactctgtcgcccaggttggagtgtagtggcacgatctcggctcactgcaagttctgcctcctgggctcaagtgatcctcatgcctcagcctcctgagtagctgggactacaggccaaaccaccatgccaagctaattttttgtattttttggtagagatggggtttaattttttgtatttttggtagagacggggttttaccatgtttcccaggctggtctcgaactcctgagatcaagcgatctgccccgccttggcctcccaagtgctgagattataggcatgagccaccgtgtcaagcctgtttgcccattttcttttccttattggtatgtgggtattctatatacattctgaatactaatactgtgttggtcatatgttgtagttaccttcttctacttggtagctttaggtttcaactttttaaaaaatgcgtatttttttatttaaaaaatcgagatgtggtctcactatgttgtcagggctggtctcgaactcttgaactcaagtgatcctcccacttcggcctcccaaagtgctaggatcgcaggctggagccaccacacctggccaggtttcaccttttcatggcgtcttttgtttgtttatttgagacagggtcttactctgttgccccagttggagtgcagtgctgtgatcaccgattactgcagcctcaacttccctggctcaggtaatcctccctgagcctcagtctcctgggtagctgggaccacaggctcaagccatcatgcccggctaattttttgtaatttttgtagagacggggttttgccatgctgcccgggctgttctcaaactcctgggctcaagcaatccacccaccgtggcctcccaaggtacttggattacaggcgtaaaccactgtgcctggcccattaatggtgtcttttaacacacagatttttaattttaataaggttaaatcctcataagaaatctgcgtggtttatccttgtttaacccggggttataaaagtattatatatttcctttttatttttattttttgagatggagtttcactctgtcatctaggctggagtacagtggcgcaatcttggctcactgcaacctctgtctcctgggttcaggtgactctcctgcctcagcctcctgagtagctgggattacaggtgcccgccaccacacccagctaatttttgtatttttagtagagacggggtttcgccatgttggccaggctggtctggaactcctgacctcaggtgatccacctgccttggcctcccaaagtgctcggattacaggcattagccacctcgcccggcctttacatttttttttatagagatgggggtctgcccatgttgcccaggctggtcttgaacttatgcgctcaagtgatcctcctgcctcagtctcccaaagtgctgggattacaggtgggagctactgcgtccagcctaaaatgtttgaagttaggtttttgcattaggtttgtgtgtacctggaatgacttttgtatatgaagtgagacagaggtccacactttttccccatatcatcaactgtcctagcgccatttattagcccgtcacttcccacttatttattattattattttttgagacggagtctctctgtcgcccagacgggagtgcagtggcacgaccttggctcactgcaagctccgcctcccgggttcacgccattctctcgcctcagcctcccgagtagctgggactacaggagcgtgccgccacgcccggctaattttttgtatttttaatagagacagggtttcaccgtgttagccaggatggtctcgatctcctgacctcgtgatctgcctgcctcggcctcccaaagtgctgggattacaggcgtgagccaccgcacccggccacttcccacttatttcttaagggggaaaaggcaatggttgttttgaaaaaaaattaacctgctctccctctccctctccctctccctctccctctccctccccctccccctccctctccctctccctctccctctccctccacggtctccctctgatgccgagccaaggctggacggtactgctgccatctcggctcactgcaacctccctgcctgattctcctgcctcagcctgccgagtgcctgcgattgcaggcgcgcaccgccacgcctgactggttttcgttttttttttggtggagacggggtttcgctgtgttggccgggctggtctccagctcctagccgcgagtgatccgccagcctcggcctcccgaggtgccgggattgcagatggagtctcgttcactcagtgctcaatggtgcccaggctggagtgcagtggcgtgatctcggctcgctgcaaccacctcccagccgcctgccttggcctcccggagagccgagattgcagcctctgcccggccgccaccccgtatgggaagtgaggagcgtctctgcttggccacccatcgtctgggatgtgaggagcccctctgcctggctgcccagtctggaaagtgaggagcgtctctgcccggccgccatcccatctgggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcagccctgtctgggaggtggggagcgtctctgcccggctgctccgtctgagaagtgaggaaaccctctgcctggcaaccgccccgtctgagaagtgaggagcccctccgtccggcaaccaccccgtctgggaagtgaggagcgtctccgcccagcagccaccccgtccgggagggaggtggggggggtcagccccccgcccggccagccgccccgtcctggaggtgaggggctcctctgcccggccgcccctactgggaagtgaggagcccctctgcccggccagacgccccgtccaggagggaggtgggggggtcagccccccgcccggccagccgcccagtccgggagggaggtggggggtcagccccccgcccggccagccgccccgtctgggagggaggtggggggatcagccccccgcctggccagccgccccatccgggaggtgaggggcgcctctgcccggccgcccctactgggaagtgaggagcccctctgcccggccagccgccccgcccgggagggaggtgggggggtcatccccccacctggccagccgccccatccgggagggaggtgggggggtcagccccctgcccggccagccgccccgtccgggaggggggagggggggtcagccccctgcccggccagccgccccgtccgggagggaggtggggggggtcagccccccgcctggccagccgccccgtccgggagggaggtggggggatcagccccccgcctggccagtcgccccgtccgggaggtgaggggcgcctctgcccggccgcccctactggaaagtgaggagcccctctgcccggccagccgccccgtccgggagggaggcggggtgggggggggggggtcggccagccgccccgtccgggagggaggtggggggggtcagccccccttccggccggccgccccgtccgggaggtgaggggcgcctctgcccggccgcccctactgggaagtgaggacccctctgcccggccagccgccccgtccgggagggaggtgggggggacagccccccgcccagccagccgccctatccaggaggtgaggggcgcctctgcccggccgtccctactgggaagtgaggagcccctctgcctggccagccgccccgtccgggagggtggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctctgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaataaataaattaaaaaaaaaaaagaaaaaaattaacctatcaaaataaaatatcagcagttgaaactaacaatgtattaataacaataatattatgaccaagttgcgtctaccccaagaattcaagaatggtttaccattagaaagtttattgatgtaactgatctcattaacagattaaaggagaatacccatatgatcatcttaatagatgcacgaaaagcatgcaataaaatacctatttattataactgctaatattttgtgtttttccttaaaaatgcagtgtttttaggaattaaagttcagagcagcaaaagtcaaacaaaaaccaagtctgagcaatagagctactacagtgcccatcacagtgtctgctcaggtgacttcttaaggtcatgtccagctctatgtttctgtgaccacaaatagcatctttggcaagtctagtttcagttggtctttgtccagctcctggattcctccatgcagggcctgagaagccctgagggataaaagattaatccggttcagtggactctgtggttcctcaactccaagtgcccccagcataagtcggacctgcctctcacgcaatggatcccctggcggcaacccgagaccggttctcctacccgcattccgccaagtctctcgctctgcccaggacgcacagatgagagcgctccgaagactggtgggtctatctttcggtctttcctaattttcccgtcctctggggaaaggtcggggatacctgaaccaaagtgtgtgtgtgtgggggggggggggtgtaggtggggcgtgcatagatgtgcacaaccaagggcttggccctccggagaacgcccaggggcagtggcctccgaggttctggcggccggcagtggcgaccggcgcagggaatcgcgcagggttgcggctgaggtcagaccagcgagagacagagacccgcagacatttagtccagagactgtagcaaaggagggggacgaggggccagagccggaatttcgggggaggacttgggagcgcggcgaccagagtcgcttgctggcacttgcgagggcgaatgcaggggcttggccgagatgaccttggaccagagctcccttccggcctgcagagatgagcttggggcttagccgagtaaggagtgagcggcttttcagcctcagtgctgcggcagaggcggatggaggatgaactggagccgtccttacggcctcggacgcaggtgagctcccagcggcggcgacaaaccccgcggcggtgaccccaaaccccccccccgcggcggcgactcccccccaacacgctggggcgaactccccagcacccccagcccttcttaaaaacgctgagtccgcgcatgcgcctcaggcgccctccgcgacactctagcggctctgcgcttcactgcgcctgagcttgagtctcaggccttagtcccggccatcgtttagcgttgcgcgaaccctcagctggtgcggccgctctcaatacccactgcgcttgcgctacagcttcgtctcgacgggtttgctcctctcaaacgctcactgcgcgtgcgctagcgcctctttcaccactgggcgctgcgcgctgcccttccctccgcgcacaggctgccggctcaccgcttgctaatggcagccggggtctccctgggacagcaagacctccgctcaggcccctctttcgaatgctccacgccctcctgcgatctagaatggtatgaattctcatacttgcccagaccaggcgtttcagatgagggattgcggacctgagtgaactgcgcaggtgcagccacctgggaggcttaactaagtcgtcaaatgttcaaaaatatcgtgcttgtatgtacagtggcgttaggtgctaggctcagatgtgcataggcaggtgtttacgcccagggtcggcctgtgggccagagcaaggttgctggaccctggcatcccagcccccagagatgctaaatcctctgccgatcagccctgacctcagaggcagtaagccctccgagcgctgcaatcctgactgctcgccccctcccgagactgtttcccacccccgcctctttcctcctcatgctccctcagctctgacctgacgtcctgcctcacagagggaaagggcgcagccagaggagagcgcccgcactgcactgcccaccgcttctaggggttccttcccaatctggactgatttctttaggtatttgcatggcacattccctcacctcctttgtcttgatttgcacttgtattccttgacagccttatttaaaatagcaccaactaaggtgggaggatcgcccaggagttcgaagctgcagggatctaataggatctcaccactgcactccagcgtgggcgacgtagcgagaccttgtctctaaaaaataaaaataaaataaaataaaataaaatagcaccacctggtccaaacacttcctacgccccttcactgctttaagtctctgtagcaccagctgatgtactatatattttgcttgttcattttgcgattgcttgtctttctctgctggaaggaaagctctgacagctcatggattttgtctgttgttcactgctgtatcccaacacctagaacagtaggattattgaccataatagggaggcaataaatctttgtttgctgaattaatggtccctatcgtagctaatgtctgaatgcttaccatgaccaggcacggtataggcaatctccatgcatgatctcattgaattcaacgatttcctgtagtcttagagacctgtcaatatctcctgctacatgagctcagctgccatcaagcactgtgttcgctgcttccttcacatctgctgtcttaagggagctctcacttccatgcggcccccgtggagctgtaatttggcctcaatgggaccagatgccaggtttctcacctggcttcttcctaaggcttccagccttagagaaagttacttaggccttattggaactatgggcagccagggcccctgtcaccaacctgtctccagacctatggcaaggccttcagcaggattctgccctccagagccacttcctctgctcccccagcctccagtgcagtatctcactgaatggtgaaagcacagctgtctctttcccagctgtatcttgccccccagcacacttcctggctgagataaacattcagcatttttttttttttgagatggagtctcactctgttgcccaggcaggagggcagtggcgcgatctgggcttactgcaacctccgcctccctcccggattcaagcaattctgcctcagccttctgagtagctgggattacaggtgcccaccaccaagcccggctaatttttgtatttttagtagagacagggttttaccatgttggccaggctggtctcgaactcctgacctcaagtggtctgcccacctcggcctcccaaagtgcagggattgcaggtgtgggccacgacatccggccaacactcagtatttgactaataaatgaataaatagtccgtaggttctggaaacttcagaaaaccttagccaaacatccttctgtcatgaaaattgtatcaaagttttcaaaaataatacatttaattctacagaacaatttgccagaacaagaaaggcagtattttttgggggaagatatcaacgattcaatttttgtaaagtcaactactttgcaaatatctaggaaaatacctgagggaaggagttaattgttgtgcctttggaggagtggagaactttcagtatatactgaattttcaaaaatcttaacaaacgtgtcattttgtaattaaaaatcacaaaagagtgggctgggtatggtggctcacgcctgtaatcctaccactttgggaggccaaggcgagtgtatcgcttgagctcaggagtttgaaaccagcctgggcaatatggtgaaatcccatctctacaaaaaaattagcccagcatgatggtgtgtgcctgtagtcccagctacttggggggctgaggtgggaggatcgcttgagcccaggaggttgaggctgcagtgaatcaagattgcgacactgcactccagcctgggtgacaaaatgagaccttgtctcaaaaaacaaaacagaaaatcaccaaaggagaaagataaatacttctgtgaatccctaagacgacctcaactacaggtcgggtgcggtggctcacgtctgtaatctcagcaatttggaggctgaggtgggcagatcacttgaggtcaggagtctctactaaaaatacaaaaattagctgggtgtggtggtgcatgcctgcaatcccagctactcgggaggctgaggcaggagaatcgcttgaactgggaggcggagattgcagtgagccaagattgcgccattgcactccagcctgggcggcagagcaaaactccgtctcttttttttttttgagacggagtctcactcaacctccacctcctgggttcaagcagttctctgcctcagcctcccgagtagctgggattacagacgcctgccaacacgcccagctaatttttttttttttttgagacggagtctcgctctgtcgcccaggctggagtgcagtggcgctatctcggctcactgctagctccgcctcccgggttcacaccattctcctgcctcagcctccccagtagctgggtctacaggtgcccgccaccacgcctggctaattttttgtatttttagtagaggcgggatttcaccgtgttagccaggatggtctcaatctcctgacctcgtgatccgcccgcctcggcctcccaaagtgctgggattacaggcatgagccactgcgcccggccaatttttgtgtttttagtagagatggggtttcaccatcttggccaggttggtcttaaacttctgacattgtgatccacccgcctcggcctcccaaagtgctgggattacaggtgtgagccactgcgccaggccaagactcagtctcaaaaaaaaaaaaaaaaaaaaaaaaagaaaatcccaactatcccaactacaaaggatgaggcatcagggatgccttggggaattctccctccatctctaagggtgtttcactgtccttttgtgtaccaagtgtgcatgactcatgggtacccagcctagaagtaggcttcattatctgcaggtccaggtaaggaagtcacttaggatgagaaaggaaggggagagctgggatagggaccaggcacctgggccatttatgctgcctctctactactcatatgtccccaagtccttgcacctgcaggtccatgtggcatcttctcttagcctcattgcagaacatgctggtgggaggtaagagaggtggctcagcccagattcctggagcctggccactctgttggagaaggttttcctggggcaagtcagaggctcctgtcctgctggaggcagagccttactctactggggccccagctcaggggactgtcttccccaaacacagcagacgtgctcaggggcagcccaacaaggagggatgggaaccgctctccagctcagggaaatgttggggctatgggtggggtgagggtaaagtggggtcctggactcagaacaggaggcttgggttcctctgctacctgccagccatgtgacccaggtaactcctctctgtgcctcactttcctcatctgcaaagtggagacatcactgcctgattcaaataaattgcaatgctgtgattggcagctctggtccagggagggggtggaggctgttgttggtcactctgtgttctctcctctctcctcagattcagggcaggatcctgctcctgaccatctgcgctgccggcattggtgggacttttcagtttggctataacctctctatcatcaatgccccgaccttggtatgtatcctctctgggtggagactgtccctgtctgagtgggtactggctaacagctgcccactgaggggcttcagccaggcatccactaggtggcactttctgccacaagtttgtctccattgggttggcccacaggttcctgcaggttcaaactgagcatacatcttccccaaacctgcatgtcctcctgagtccctaatctcagcagatgactccatcttccacctagtgatggggggtcagccttgactcttctcttcatctcttggacactaagtccttcctaactacctctggaatccagccacttctccccatgtttccaccacattcccagttctggcccagcctcctcactggcctccttgccttcagcctctccccaccttgatctcttcaagtcactcccctgctcagaaattttttttttttttcgagatggagtttcgctcttgttgcccaggctggagtgcaatggcatgatcttggctcaccacaacctccgcctaccaggttcaagcgattctcctgcctcagcctcccgagtagctgggattgcaggcatgtgccaccatgcccagctaattttgtatttttagtagagacggggtttctccctgttggtcaggctggtctcaaactcccaacctcatgtgatccgcctgcctcagcctcccaaagtactgggattataggcatgagacaccgtgcccggtctcatcaatgttatttataaagtagccagtggagattaagtttccgtgttcagcggtgaagccttgagctatcacggcctcagcttcatggaaaaaggaagaagaaattttaaaaagcaagcagggcaggcagacctgaccaaatgaacccctcggtttcactgtctcacaccttcgctcccccaaccctgataccaaagcaagttaagtatagttcctcaaatacctatgacacagcccttcctctaagcctccttccacggaggggccctctctcttccacctgtagaagcccaccccagataccaccaccttcttgaaacctttttgcctctccagcccttggtgcaggctgtcctctcttaggctgtgtgagggctgttttgtgtccatctcctctctcctgctggtttgctctcagcatctgagtcatctttgaatctctggcccttgatggtagcctggcccgagccaatgttctgtgagtgtctgtggaaaggataggtctttcagccccagtgatagaagcccacctctaacttgcttaagtaagaagggcaagtacctaatcatgtaactgggaatgatgggatgtggggcttcacacagcactgagggagagctgcaggaaccaggccccaggacagaactgtggctgtcctgcccctgttttttctctctctctggttttttttttttttttttttttttttgggacagagtcttgctctctcacccaggctggagtgcagtggtgcaatttcggttcactgcaacctccgccccgtcccgagctcaggcgctcaagcgatcctcctacctcagcctcccaaataattgggaccacaggcatgtacaacaaagcccagctattttatttgtattttttagtagagatggggtctcatcatgttgcccaggctggtctcaaactcctgagctgaagtggtccgcccacctcggcctcttgaagttctaggattacaggcatgagccaccgtgcccagcttggccttgttttcatacccagatggggagctgctgtcaccagattcacttcctgccagctgagaactcaccccaccaacaaaagtcttccaggttagctcatgtagaaaggcagggaagagcctgaggggctggtttggattacatgtccactcccagaccagtaatgtggtcaggaggctgggatgctcagattggccagatctgggccaggtgatcacctttatggggaaccaagggctgtagttgaccatcgagagaacttcctccaaagtaatatttgctagcagaagatagaggtggggatagaaagaatgatagcagcccagcctcttaaagaaaggatgagagtttagaaagggagatctgagctggctgcgttggtttattttttatttatttattttctgagacagagttttgctcttgttgcccaagctggagtgcgatggcgtgatcttggctcactgcaacctccacctcctgggttcaagcgattctgcctcagcctcccgagtagctgggattacaggcgcccaccaccacgcctggctaattttttgtatttgtagtagaaatggggtttcaccatgttagccaggctggtctcaaactcctgacctcaggcgatccgcctgccttggactcccaaagtgctgggattacaggggtgatgcattggtttatttattcattaattcatcaagcatttgagcacccacttcagtgcacactcagactagagaggggtccatcccaggccgggcagggcactctcagaccttacctcccacagccatcaccagcccctacgaaggagactttcctaggctcagaggcttcccctaccctgctgaatggtgttaagttctaattgttaaagaaaaagttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctctcaaaaaaaaaaaaaaaaaaaccagaaaacaaaactgggcgcagtggctcacgcctgtaatcccagcactttgggagtctgaggcaggtggatcccctgaggtcgggagttcaagaccagcgtgaccaacatggagaaaccccgtctctactaaaaatacaaaattaaccaagcatggtggcgcatgcctataatcgcagctacttgggaggctgaggcaggagaattgcttgaacctgggaagcagaggttgcagtgagccaagattgcatcattgcactccagcctgggcaacaagagcaaaactccatctcaaaaacaaaaacaaaaaactattcaatgacacttgtcaaagcacagtaatgaagactttattcaagaggtggcaagcactagttgtagggaccgtggcaatggggtcctgccctgaggcagaaaggttggactcaacttcaaatacagcaatgggcaagtgagaactgatagccaaggagcagagtggggtcagcgggtgcacaatgactaagaggatcatcaggcatttgtgggggattctggttaaattgtcctaacaggattcttgttgagggcaggccagggtaactagacatcatggaggatggcagaggataaggaggccgattagattttgagagtgatcagatgtggaggatgaggattctagctaaaccaacttagcacgatacttgctaaaattgaacaaggcagagatgaacacagaagtccaaaagttgagacctagttgaaaaagagctcagaaggccgggtgcagtggtccatgcttctaatccgaacactttgagaggccgaggtgggaggattgcttgagccccggagtttgagaccagcctaagcaacacagtgagacccagtatctacaaaaaagtaaaaaaaatgcaacagggcacaatggcatgggcctgtagttgtagggatctgtgaggctgaggttggaggatggctcgagcccaggagttcgaggctacagtgagctatgatcatgccactgcactctagcctggacaacagagggagacactatctttaaaaaaaaaaaaagaaagaaaaaaggaaaaaagagcttagaaaactctgaggagaatctttgtcaatggtcactcttgaggagttccacccaatgtcaggggaggctggccctggtcccagctcctgtggacagttcctcccccgagaggcagctggtgggcactaggctgacagtcattgccctgagctgggcaggggagagctggcccagcacctgaacccgctgctctcccttgtgttctgttctgtcaggagacctgcaaatgacatttcatctctaaccaagagaagggtgtccatgtcttcctcatgtctttcctaaccatgtggcttcccttcactcacctgaggtttggagtctggggagtccaaactacctggtacaactctgacctgtggctaacgctgtgagcaagtcatttcacctctccctgagcctaatccccagtcttgacagtgaccaaggctgggcatggttgctcatgtctgtaatcccggtgctttgggaggctgaagcaggaggattgcttgaggccaggaattggagaacagcctgggcaacatagtgagaccctgtctctacaaaaaaatttaaaaattagcctggcatgctggtatgtgcctgttagtttcagctactcaggaggctgaggcaggagggtcgcttgagcccaggagctggaggctgctctgagctatgaccagtggatggagagattactgaaattggaaggaaagagacataggtccccttgagaggatcgcagccaggctgaggcaacctcccagggagggagccagggaacagacactcctacttctctctcctgcctcctgatgtcctgctggtgctcaccattggccaagttggtcagtaagggagcctactgatgtgggctgcacaggtggctccctggggcaaaagcagggtgggaggggactgcagtggattcctcgggtatggtataataagaaatataatagatctttgtccttggttccaggcacagagctcctaaaactcttggaattttttttttttcagacgtagttttgctcttgtcactggagtgcaatggtgcaatcttggctcactgcaacctccacctcccgggttcaagcaattcttctgcctcagcctcccaagtagctgggattacaggtgcctgccatcacacctggctaatttttttttttttgtatttttagtagagatgaggtttcaccatgttggccaggctggtcttgaattcctgacctgaggtgatacgcccatctcggcctcccaaagtgctgtgattacaggtgtgagccaccgtgcctggccacggaatttcttgagtgataggagcatcttttgttatttgcaatgagccccatttcatcatacctgcgcttatggtaatgagatgacagggtagggccactagattgcctcaggatggagctggtcaccaaaaagaccaagagattagagggtccgaatgttcagccccactcacggagctctaggaaagggagaggagctgaagattaaggtctataaaaactcttgaatgacaagatttgatgagcttccaggttcatgaacacattgaggtgctgggaaggtggtgctcctggaggggacatggaagcctctagcaacctactctcccaggatcaggcccagtgcatctttcccatctggctattcatgagttgtatccttcataacaaaccagtaaatgtaagtaaagggccttcctgagtttcgtgagccattgttgcaaattatcaaacccacagaaaggatcctaggaatccccaattgatggccagttggtcagaagtgcaggagttgcacttggcatctgaagaggggacagtcttgtggaatggagccctttgacttgtgggatttgatgctaactccaggtggatagtgtcagaatgggattacattgtagtacacccagcttgtgtccggagagttagagaattgcttgatgtgggaaaatatccacacatttgctgtcaggagtattgtgtgagtagagagaaatagtgttttcgcagagaggggcaaatggagcgagtccagtgctaggctctgagagatattgcccatgaaagaaccagcatggtgccctgcacaagggaggtgctcaggcgagttggttcctgctccagggggagctcagaagacacggtgcctgttgtcattgcctgttctgcagaggcatggagccctgttggggagaaggcttgtttcatctagcacccccacgccaccatccccagaaggctgactggcatttctgtccacagcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggtaagtgcttcctgcataccccctgaatgccctttaatgaggagcgctgcagcctgcaggctgaggaatgtggaagaaggaagaggcccggcaagctccaggcccagatcagctcctcatccagcctcttactctgcctggagtttcaccttgcaagacacgtcttcaagggtttggtagagcaaacagtcctgtgctacaagagagggaggactcctggtttctaatttcatgtctgccaacaagtgctaactgaccttaaacaagttattttcttcctgggcctcactctcctcctgcatatctaatgcagttcttggatttcaaagaatacaaactgactctgataacagaatcaaaaatgtaatagctggaaggatagtggggcagctcatagcatgaaagaagttcttagaagccaggcctggtgaggcatggtggctcacccacataatcccagcattttgggaggctgagcggggcagattgcatgggtccaggagtttgagaacagtctgggcaatatggtgagaccccatctctacaaaaaattagctaggaatgggctgggtgcagtggctcatgcccgtaatcccagcactttgagaggctgaggcgggtggatcacctaaggtcaggagcttgagaccagcctgaccaacatggtgaaaacctatctctactaaacatacaaaaattagcagggcgtggtggcacacgcctgtagtcctggctactcgggaggctgaggcaggagaatcgcttgaccccgcaaggcagaggttgcagtgagccaagatcataccactgcactccagcctgggcaacagaacaagactccatctcaaaaaaaaaaaaattaaccagttatggtggtgcatgcctgtagactcagctactcgggaggttgcggcaggaagatcacctgagcccaggagatcgaggctgcagtgagccttgattgtgccactgtactccagcctggatgacacagtgagcccctgtctcaaaacagctcgcttactagcaatcttagtctatttttgttgccataacaaaataactgagactggataatgtataaagaacagaaatttactttctcacagttctggaggctgtgaagtccaagatcaaggcacccagcagatgcagtgtaccgtgagggctactctttctgcttccaagatggtgccttgtccctgtgtcctcacatggcagaaagggcgaatgctgtgtcctcatatggtgaaagacaaaagggcaaaaggcaaaaagagcctgcctagttccctccagcccttttataaagcactagtcccatcaatgaaggtggagttctcatggcctaatcaatctcccaaaggcccacctctaaataccgttgcattggaaattaaatttcaacctgaattttggaagagacacaaaccttcaaaccatagcaccagcactggatcagcaagactggattagaccactgggctcatatctgcaccgtggggagtaggggaacagtcgcaaacaaaagtggggctcttcccacgaagaagacggaggtaataactattgcgcggctatctcatgatacctggtacagttggcataagcatgaaaggaagaaattaaaaattcaagtttagcatgtatgcctattgtaattaaagcaaatgtctgttcccctccccaggacagggggatgtagttcttccattcagcagctgactggagctctgaaatgtgttgccattgttgggtgctcagggttggttgtgtaggggaacacaaccatcttggtgacaggaagcccctattgttcagcccatgtgcattttctgtccttgctaccctatttgctttgtttatcacccaactgagtaagcaccgggatggtcaaggaaggcagttgaatgccatctacagatagagggtcatattgtccatctgcttatgaagagcctctttgtagtgggagggggcttctgataagcagaaatatatttatgtatattttcacgttctgggctaattttattttattttttattttttattttttattttttttgagacggagtttcgctcttgttgcccaggctggagtgcaatggcgtgatctcggctcaccgcaacctccgcctcccgggttccagtgattttcctgcctcagcctcccgagtagttggaattacaggcgcccaccagcacgcctggctaattttgtatttttagtagagatggggtttctccatgttggtcaggctggtctcgaactcctgacctcaggtgattcacccacctcagcctcccaaagtgccgggattacaggcgtgagccaccgcgcccagctatattttcaggttctgggctaattttaaaagattcacccacttagtgtttccccgtacctccttgaaaccagtcttcaaattctgcttcatctaagactttttgtccaaccaaatcttttgaaaaagggacaggccgggtgcagtggctcctgcctgtaatcccagcactttggtagactgaggcggggggatcacctgaggtcaggagttcaagaccagcctggccaacatggtgaaaccccatctctactaaaactacaaaaattagacgggcatggtggtggagacgcctgtaatcccagctactcggcaggctgaggcaggagaatcacctgaacccaggaggcagaggttgcagtgagccaagattgtgccactgcactccagcctggtagacaagagtgagactccatctcaaaaaaaaaaaaaaaaggaaaggaaaagaggcaaaagaagtccatgctagaccaggaacggtggctcacgcctgtaatcccagcactttgggagaccgaggcgggcggatcaggaggtcaggagatcgagaccatcctggctaacatggtgaaaccccatctctactaaaaaaatacaaaataattagccgggcatggtggcgggtgcctgtagtcccagctactcggcagactgaggcaggagaatggcgtgaacctgggaggcggagcttgcggtgagccgagatcatgccaccgcactccagcctgggtgacagagcaagactctgtctcaaaaaaaaaaaagcccatgctaaaaaatctgtctataggataagtttaagtccttcattaccttttgggtccaagctgatgtgagtgacctattcatgggaaactttggggtccacattgggcaagtttggtttataccacttctattcagtgatggagtgctgcaggggacactcaaccttagtaggagggtgtcatacagcacccagttatgatgagtacatggccctgtggcatcccgcagcctggtgtttattccccactagggcctagtgacaaggccaggagctctttctccttaagaggttagcaggctgggcatggtggctcatgcttataattccagcactttaggaggccaaggcaagaggatctcttgagcccaggagtttgagactagcctgggcaacatagcagaaccccatctctacaaaaaaacaaaaaatagaaaaaattagctgggcatcgtggcacacacctatggtcccagctactaaagagtctgaggtgggaggatcacttgagcctgggaggtcgaggctgcagtgagctgttatagcaccactgcactcaagcctaggtgacatagtgagaccctatctctgaatatatatatatatatgtatatggatagtaatttgctgaaggagagtagctcaacttaaaaagctttggttttgcattgtgatccccttttagggtattttaactgccactttgagcaccacaggctctcctaaagctaaagggttgagtggcagagctctttgaacttggcttggggccacgatcatgtatagttgctagtactctgcgatgtgaatttggcttcgacccactagagaatatacttctcttgcttagcaccactcaaagctaccaggttttcaagtcacctgataaatgtgccaggtcacgacacctgatgtggtattctgctgcctccaaaatggaaagaagctctcagaggtttgtccctccttcttagaggaaggggaccaaggtgcagcaatttgtcatgcactttggagaaaatacgctgccacctcttagtcctctagacctcaggaacttcgttggagtggcagccccctatctcgttattaatcttctactctttgtcacactgtgccttaccaagacttctagtgcacttgctgcttcctcttctccaggtcctttctgtgtgaactcatcaaaatagtgggacagcagcatgtcctgtgggatgcacagctccctgtggaatggactgtggcctgcagctgggcagctgctatatcctttttattttttttgcgacggagtctcgctctatcacccaggctagagtgcaatggcatgatctcggctcactgcaacctccgcctcccgggttcaagagattctcctgcctcagcctcctgagtagctgggattacaggcacgtgccaccacgccctgctaaattttgtatttttagtagagacggggtttcactatgttggtcaggctggtcccgaacccctgacctcaggtgatccacccgcctcggccccctcaagctactgattacagacacgtgtgtgtgtgtgtgtgtgtgtgtgtgcacgcgtgtgtgtagcatggtggggggagcacagtgcaagaccttgaatttatttattatttatttattagacgggttcaagcgattctcctgcctcagcctccccactacctgggattacaggtgcctgccaccatgcctggctaatttttgtatttttagtagagatggggtttcaccatgttggccaggctggtctcgaacttctgacctcgtgatccccccacctcagcctccaaaaatgctgggattataggcgtgagctgctgcacccagctgctgctatatacttaaggcagatcggaggaggtatatgactgttccagcaaggtgaatgctaagtgtttttggcaatgtctgtgtattgaaatggagcaaaatgcactcactagattgaagtacttaattattattaatggatttattaattccagtgaggaaaatgtatattattgtaattataattattagttacaattggagttaccactggatcgagtttgttataatctactgtcatttttcattctctagacacaagagacctaagctttggctcatattttatcaccaatgtgctggtgactttgagcagaacactggccacttctggtcttcagtttccctctcagtacagtgagctatatgatcacagtgagctctcctgggtgatctgtatggcagcacttctgagctcaatatgaggagccaaagctaatgcttcatcatgatggagcaggtgacatttccaatgtcccctccttgggttggtgtctgtcccattgaccaaggcattgagatatacagccattctgagttgtgagaagtgactctgtaatacatggaggaaaatataaggaaactctacttgactatctatacgtctcttccttcactcttaaagtccctgttcttcctccctggagttttattgaatctgagaaattacatattagtaccttcattgttgctgttgagacagggtctcactctgtcaccgaggctggagtgcagtggcgtgatcatggctcactgcagcctcgtactcttgggctctagcaatcctcccacctcagcctcctgagtagctgaaattacaggcgtgcgccatcatgcatggctaatttttttttttttttgagatggaattttgctcttgttgcccaggctggagtgcaatggcgcaatcttggctcaccacaacctctacctctcgggttcaagcgactctcctgcctcagtctcgagtagctgggattacaggcatgtgccaccatgcctggctaattttgtattttttttagtagagacagggtttctccatgttggtcaagctggtctcaaactcctgaccttaggtgatccacccacctcagcatcccaaagtgctgggattacaggcgtgagccaccgcgcccagcctaattttttttgtattttttgtagagatagggtttcatcatgttgacctgcctggtctcctgggatcaggtgatctgcccgcttcaacctcccaaagtgttgggattaaaggcatgagccaccatgcccagcccaatttttacagatattttaaaaattatgtgttacaacagacgtgtaagtgtaggagctctcatctcatttgacagcaaggataccaggactcaaagtagttaatggcatactacatacatttgtgtgtgtgtctaattaaggcttgttacagttgcaaagagtggtccccagggatggtcccgctggactgaatcacagcctctctttctgtgtgtttcacttcccccaaggaagaagtccctcctggtgaataacatctttgtggtgtcagcagcaatcctgtttggattcagccgcaaagcaggctcctttgagatgatcatgctgggaagactgctcgtgggagtcaatgcaggtatggggtgggggcttctcatcctgcctctctatgcctattaattaataaattcattaattccttttatttcatttcttccttcatttcctccctttattcattcatttattttttatttatgcctacctttgtcacaaaaggatgtagtatagtttatcttaaagggctcatataactagatatttaaagtaggtacagaacaatggaaaagttgtgtaggggtgggggaataagcatctccaaacttaacactaatacaggtcccatgtttgagtaacactctaagccatgagcttcctggtagccaacgtgtaaagggatataggatgagttttctgatcttctctcagaagcagaatggcctgttaggtactcctcgatttctggggcttttcatgtgagagagcagaattttgagcacatccacctgggtttttaggggctccaaccaacaagtcatctcttgacgccctactgtttatacagcccagtggtgatgttatctatatgatgctatctatattagttatctatttgtgtgaaacaaataaccccaaaattaagtgacttaaaataatcaacatttataatctcacagtttctgtgggccaggaacccaggaatgtcttaggtaggtggctctggcttggggtctctgacggggctgtgctcaagctgtcagggctgcagacatcagaagggttggctggggctggaggatccacttccaagatgctccctcacgtgccattggcaggaggtctcagctgcccactttggggggctctccacagagctgcttgaggatcttcacaacatggcagctggcttcttccagagtgatctgagggggtgaggaggggagggagagagagggagacagggagacagagagagggcatgcacaaggagaagtccaggtgctttttatgtcctaattccagaggtcatacaccattattctgctcattagaagtgagttactaagagtagcccacgatccaggggaaaggaaccaggtcagactttgtcttcatgtcccaagtacccatcagagaaggaatccccagctaaatgtttgtaggaagagcaggggcacctccgagactccttggcaatcagcatagctgccttccttccagttatctttgcccaactcgtagatagaggggcaggaccttgatgggagaacccctaggtcagggagggcatactgcattcccaggggcgtgacaccacaacacagtggcctcttagcttttgccatttgtcaccctctgggagggcgctggggtgctctccagctctctgttttcctgagggcagtgtaggtgccagggtcttccctgggggagccagggtgaggtgagagcagctgtagtgatcaatgaaggaattgacatgagtgctgggacagctggtaggcatccaggatgtggtcctaccttcctcctcccacccccccgcacagccccgtcagagtccttcacactcgggtcccagtgatgggacctaggaagagcccatgaacatgtggtactgtggccagggaccaggatgggagcggatctgagaaagccctccctcagaagttctgaagagtagagttgggatcctgttggcccttcatcaggtgaagcagaacccctgagtgtggggggtgagggatcagccctcagtgccaggatccagttgagtggctggacagtgctgagtggggcaggggagacaggctgggtgtcgtggagtgggggtcccagctggtggctgacgtgcctctgctgtgcacacgtccaggtgtgagcatgaacatccagcccatgtacctgggggagagcgcccctaaggagctccgaggagctgtggccatgagctcagccatctttacggctctggggatcgtgatgggacaggtggtcggactcaggtaagcacccctcccccacatgcattgagtatttcggagataccagtaaaagcgtttcttcacctaaatgtctcccctacccactagtagattaaagcattattgctttgcatgaaggcatcgaatcctctatccacatctctgctgccaattcacgaaatgggtatcagtcaacacactgcaatgtgaatcaccttttcccatcctctccaggtcagggagcaaagaacaggtcttcacagaggagagggtgaagatttgggctttcaaagacaaacgtgttccagtcattccagaaaaaagaggagaaggcagagcctggacccttgggaagaggagttgctagggatgaggtggggcagtggccctgtcctctcttggtcccaacctgggtgggagggatcttgatgttcagacccagacttggataggaagaggcacggggcaattgcagactccctgcagggaggtgtgtaggtgggcaggagagcagggtggtaggactctggcaaagaggcatctggcctggcctctcctctgcctccttagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcaggtgagtctctgtccttgggctcccagactgcccttgaccaagggatgcatctccccagagtatacgggtccccatttcataggtttcatttatcaaggaaaagctatccctctctttgtgcctcaatttcatgatctgcctatacctgccttcaatcagaactctatcaagtggttgtcctaactgccaggcagcagaatggatcagacctagccactgttactcaagaactccagagcggtgcggagaaacacacgcgcacacacacggtgaaacacctgtgcaagacctcacctacccagtgccaactgggtgatggtcatcttatatcagttaactttggctacagtaagaatgcctaaggaacaatcgcaacatttctgctttaaagcaacaattatttactgcttcttttattcatgtacttgcctggctggctgcacagctctgctgatctcagctgggctagttcacagtgtggggcgggggaggggggcagtggtgaggttcagctgctggttggccggtctaggctggtctggactggagccattcagctttgctgcactttctgtcctctcacttttggtaccaacgagttagcctaggaatagcatggtgatggcagagaaacaagaaagcaaatccagttgcataagcgctttccaaacctttggttccctcgtgccattaacattccattggccaaagcgagtcagtcatactgccaaatcccaagtcaagggatgggaaaattgatggcatatcctctcccatcgcaagggctgtggatttaaggaggggtgaagaccggggcccattagtgtactcttctctgtcaccatggccgcaattattacttatgtctctcctctgtgcaaaatgtgttcagtcccatcccaggatcccccaaagtctcatccaatcatggcatcgggcttgaagtcccagatcttacgccacattaagtctatatgggccttttcttgatccagaaacctaggatctagaaagatgagtcttcttcccttcccacactcagcatgcaatggtaaaaagtaagatgaggtaaccaaaattaatgctctcatttcaaaaacgaggaagcaaggcaggcacagtgcagtcactaatctataacaattctgaagcgcccctaggaaaatatggccatgtcccctgccttgggggtagggagtattctttgttcaagttccagctctgtcccctaccccctatgaagggcaccccaggccatggttcttttattttttttattttttttatcttttagagacaggttctcgcttgtccaggctggagtgctgtggctgttcataggcatgacgccattgttgatcagcacggaagttttcttcttttttgttcttgtttttttggttttgtttgggacagggtctcactctgtcgcccaggctggagtggtgtgatctcagctcactgcaacctccacctcccaggcccaatcaattctcccacctcagcctcctgagtagctgggactactggcccgtgccaccacgcttggctaatttttttttattattgtattttttgtaaagatggagtttcacctctttgcctgggcaggtctcaaactcctgagatcaaatgatcctccccccttggcctcccaaagtgcgtggattataggcatgagccattgtatctggctagcatgggagttttgaactgtcccatttccaacctgggccagtgcattcctccttaggcagcctggtggtccctgctcctgggatgtcactatattgatgctgaacttagtgcagacacctgatctgcctagcgtactacaacccagagctcctgggcccaggcgatcctcctgtctcagcctcctgagtagctgggactctaggcacacaccactatgcgtggctctccatgcttcttgggtctaccctctgagatgtttttccttttctttcaccttccttgattccttctgaagagggcgttgcacaatgtgctgcttttgatggttgagcaaatttctcagcctccttcctgcctatagagagttggggcaggctgggcgccagctcacgcctgtaatcccagggaggctgaggcgggcagatcacgaggtcaagacatcaagaccagcctggccaacatggtgaaaccccatctctactaacaatacaaaaattagctgggtatggtggcacgtacctgtagtcccagctactagggaggctgaggcaggagaattgcttgaacccgagaggcggaggttgcagtggcaggagaattgcttgaacccgagaggcggaggttgcagtgagccaagattgtgccagtgcacactgcactccagcctggtgacagagtgagactccatctcaaaaaaaaaaaaaaaaaaaagaaaagaaaagaaaacaaagttggggcacagaagtctttatatttcaaattgtcctggtcttttttttgtccaaactggcagagcttttgccaatacaactttctcaaaaatgatgtgaattttctatgtattcgaggttttttcatgtgtcaacaaaccacgctcacaattatttttgagacaggcttctctcccaaggcctaattgctggtatttagggtatgtcaggctaccgtgaatcaacgccctcaagcctcctaaatgcccccttttctagttgtgagggtctgtgaggcactgctttaagctatacccttgatttgatctttactatgagtccatggcttcctggcagtgctctggatttgatctttgctcacaggctgttacttaatttgggattcttttgctagctggagaggatagaggcgagaaaacattttttgttgttgttttcaactaacccagtgtttctgaaatatgctacgtttaattaaattttgttgcctctgaattctgcttgcaaactggccagttattttctgagctaattcttcatgtcttacagcaagcttagaatatgcatctaacagcaaccagttcatgctttcaacatttggagttttctttgctcaagtccataagttcactgagcccattttctttcttccgtgttactgcactatataacatagcttttcatttctccagcctcatcgccgtcctctgcctcgtcttggaactgataccatatttcacaggtctttgttacggtagcaccaactcctggtgccaatttattgatcagctttctattgctgactaatagatgatcataacatctcggtggtaaagaaacaaaaaaagcaattatttagcctaagcctctaagtcctctgggctgggctgatctaggatggttctggctgatggctctgctgatcttggtcattcctgcaactgcagctcagctgggcattggctggctgatctagaatagtcccagtgagggtggcttagctgggcccctttggctgtccatgtcttgtcatcctcctggctagcctggaatgttctcatgaaggcagaagagcaagtagaagtgagcaaggcctcttaaggcttaggctggaacatggtacgccctcactgcagcctcatcctattggccgagcccagagccaggagcagggatgtaggcagtacttgcccctttagtgggaggaactgcaaaatcacacagcaagcagtgtgggtgcagggaggggtgaagaattgggtttgataatgtgctgcaatagtcatgtcctgtctgatatgtccgcagaaccctgcgtttctttctaaagccttttttcatccatggtggcaacaccgcaacagccctgagaaatgtcagggcaaggaagatcatctccatctgaccagggaggcaaacagagacagagagattgagagagacagaggcagagagagagaaacacacacacacacagacagacacagagacagagagattgagagagacagaggcagagagagagagaaacacacacacacacagacacagagacagagagattgagagagacagaggcagagagagagaaacacacacacacacagacacagagacagagagattgagagagacagaggcagagagagagagaaacacacacacacacacacacacagagacagagagattgagagagacagaggcagagagagagagaaacacacacacagacacagagacagagagattgagaggcagagagagaaacacacacacacacagagacacacacagagacagagagattgagaaagacaggcagagagagagagaaacacacacacacagacacagagacagagagattgagagagacagaggcagagagagagagaaacacacacacacacacagacacagagacagagagattgagaggcagagagagaaacacacacacacacagagacacacacagagacagagagattgagagagacagaggcagagagagagacacacacacacacagacagactcagagacagagagtgagccaagaaggaaaggaatggtgggatggaggggggcgtccctgtagggggaccaaagaggggcttggggacggggagctcagtaccctcctccctggctcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgagacccctgccccgccgcacaccctgggccccgggggcttggtgttgcaggccgctgggagccatgggaggtggaagggagcccaggcctgaaagccaccctctcccaggtgtacgcctacgcctcctccgtgttccggaaggcaggagtgccggaagcgaagatccagtacgcgatcatcgggactgggagctgcgagctgctcacggcggttgttagtgtgagtctggagggtgcccttcctccaccagccctgtggggagggacccccaggtcctctgcattaaaccagtttacactccagcttatggtgttaaaatgcagtgaggggccaggtgcggtggctcatgcctgtaagcccagcactttgggaggccgaggtgggtggatcacaaggtcaggagttcgagaccagcctggccaacacagtgaaacccccgtctctactaaaaaatacaaaaaattatcccggcgtggtggcgggcgcctgtaatcccaggtacttgggaggctgaggcaggagaatcgcatgaacccagtaggtggaggttgcagtgagccgagatggtgccattgcactccagcccaggcaatagtgctgaggtgggatcaggagttggagaccagcctgggcaacatggtgaaaccccgtctctacaaaaaatacaaaaattagccaggcgtggtggtcttcgcctgtagtgctagctactggcgaggctgaggtgggaggatcacttgagcctaggaggttgagactgcagtaaaccgagattgtgccactgcactccagcgtgggctggaccagtgagaccctgtctcagctcagtgagaccagtaagaccctgtctcaatcaatcaatcaatgcagtgagttagagagcatctattgagcatctacggtttgcgggtcacttccagcaccattttgagatgcggaaactggctgaagttgggtgattgattgaccaagttcctttgggaaattaataaagtcacactgaagcaataaactaccctcacctccaccaccagctttctcaggagaccccttcccattgcctgccccagacctcagggaccatggctgggtgtgtgggtctgtgctttctgcctttgcagtgtgtggtaatcgagagggtgggtcggcgcgtgctgctcatcggtgggtacagcctgatgacctgctgggggagcatcttcactgtggccctgtgcctgcaggtagctggggtggatgagggctggggggtccaggccgggctgacttccacctcacccccgccccgtccacggcagagctccttcccctggacactctacctggccatggcctgcatctttgccttcatcctcagctttggcattggccctggtgagtgggcccaaggggctctgggcatccatcatcacatagaaggagtgatgggtgcctgggtgcacagtgggtgggtgtgaatgcaatgtcccctgcaggccctcagagaccacctcatgccggggcttctgggagggaatggcaggaggagagcactgaggggccccccatacagactgggcctgggctcccactcccatgtctgggctggggtcggggagaggcaggcagggaaccctggccagcagccccctgtccctgcccctccttctagccggagtgacggggatcctggccacagagctgtttgaccagatggccaggcctgctgcctgcatggtctgcggggcgctcatgtggatcatgctcatcctggtcggcctgggatttccctttatcatggtaggcccgcccctcccgctgggggccctgccttaggctgtgtccctgtcatcctgagaaccccagggggaggcttccatccagggagactgagactgaaagggaggggtcttaggggagcaaagaggggggcaaatgcctcctcacgacctgtcatgggccttctgtttaggggttgatggagacacaccaggtcttggggtcttttttaatccgcaggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaaaaaaaaaaaaaaaaaaaattagctgggtgtggtggtacatgcctgtggtcccagctactcaggaggctgaaatgggaggatcacttgagcctgggaggtcgaggctgcagtgagtcctaattgagccactgcactccagcctggacaacagaaagagaccatgtttcaaaaaaaataaatacaggttgtagtgggtatgggtatgcataccaggaggcccgacctcgtctgagaggggagtggtcagaaaagaattttctgaggaattgatgtttttaatcaactttattgaggtataatttatacataaccaactgcatccattttaagtatatatttggcgagttttgagttctaagtatagttttggtgagtgtatacacttgggaaacaccaccgtgatcaagatggaacctttaccctaccccaaggcacccacatgcccatttgctatcagtaacccaccccagtcccagacctggggaaccactgacctgctttctgcctcaattggtcagatttgccttttttcagaatctgaagtcattccgtactgtatgtacacatttgtgtctggcttggctccagataaagtttttgggattcatgaatgttgttgcacgtattaggagagactcctttgtattgctgagtagtattcccctctgtggttagaccatgatttatttatccatctacctgttggtgaacattttggctgtttctaattcttggccatcatgaataaaactgctgtgaatgttcctacaataataattgtctaaacatatgtttttatttcttttgtgtcttagtccgtcgggctgctataactaagaaccacagcctgggtggcttataaacaacagaaatttatttttcatggttctggaggctgggaagtccaagatcaaggtgccagtggattcagtgtctgttgagggcccatgtcttgattcatagatggcggtcttcttgctgtgttctcctagacatggcagaaggggcaagggagctctctggggtctcttttataagggcaccaatcccattcatgcaggctctgccctcatgacctaatcacctccgaggaggcccaaaggccctacctccaagtaccatcatatgagggattaggtttcaaggtatgaacctggggaggacataaacagtcagtctagctttttgggtaaatgaattgctgggcttaataataaatgtatatttaactgtataaaaattgttttccaaagtggttgattatattgtttcacattctcattaataatgtatgagttctggatactccagatcctcatcagcacttggtattgtcagtctcttcaatttagccattctagtgagtgtgtagtggtatcttgtcatttaattgtggtatttccctaatgactaataatgtttgacatcttttcatgtgctcagtatggccatttgtgggttttcttttatgaataatttgttcaaatattttgtctacttttttttgttgttgttgttgagacagggttctctgtcgcccaggctggagggcagtggaatgaactcagctcattgcaacctctgcctcctggactcaagcgatcctcccacctcagccccccaagtaggtgggaccacaggcgtgagccaccatgccctgctaatttttgtatttttggtagagatgggattttgccatgttggccaggcaagtttcaaactcctgacatcaagtgatccacccaccttggcttcccaaagtgctgggattacaggcatgagccaccgcacccagcccttatctgctatttttatcaggttggttgtcattattttttaaatgtgggcattttttatacattctggaagctagtactttgttaaatatatagtattgtaaatattttcctgcagtccgtagcttgccttttttattttcttaatgctacctaagagcagaattttttttttttttttttttttggagatggaatctcgctctgtcacccaggctggagtgcagtggcgcgatctcggctcactgcagccctgcctcctgggtttaagcaattctcctgcctcaacctcctgagtagctgggactacaggcacgtgctgccatgctctgctcatttttttgtatttttagtagagacggggtttcaccatgttggccaggatggtcttgatctcctgacctcgtgacctgctcgcctcggcctcccaaagtgctgggattacaggcgtgagccacctggcccggccgaacagaaatttttattttggtaaagtttgatttatcagtttttggtttttgtgattcatgctttttgtgccataagatatctttgcctatcccaatgttgcaaagattttcttccaaatgttggatagttttagcttttacacttatgttgctgatgatgaatttcaagttaatttttgggtatggtgtgaggggctgaggttccttttttttgggtgggtggggggaacagggtctcactgtgtgttgcctagactggagtgcaagtgacgtgatctcagctcactgcaacctctaccttccagactcaagcaatcctcccacctcagcctcctaagtagctgggactacagatgcgtgccaccatgcctggctaatttttttttttttttttttgagatggagtcttgctctttcgcccaggcaggactgcagtggcactatctcggctcactgcaacctctgcctcccgggttcacgccattctcttgcctcagcctcccgagtagctgggactgcaggcgcccgccaccgcgcccggctagcctggctaatttttgttttgttttgttttattgtttttctttgtttttttgtagagacaggcttttgccatgttgttcagactgttcctgaactcatggactcaagccgttcgtttgccaaagtgctgggattacaggaatgagtcaccatgactggcccttttttcttttctttctttttttttgaaatggctatctggtcgtaccagtaccatttgctttaaaaaaagccattttttcttcattattttactttggtgcctaaataaagaaaatcagtggactattgttgtataagaaagaatttggcttttgtcaggaaacagtgactgttaaagagaagtggtggggctgtgggttctctggggagagagaaatctctgggtcagggtgtcagtagaggtctcagggagaaggtgactctgagctggcttcctaaggataggctcagctgggggccttttaaaagctagagccttggtggcatgtgcctgtagtcccagctacttgggaggctgaggtgggaggatctctggagcccaagagttggagattacagtgagctatgattgcaccagtgcactccagcctgggccacagagcgaggccttgtttctaccaaaaaaagaaaaaaaaaaaaaaaaaagctggagccactgggaggcagcagcgttgcaggatgggaatgaagctaccgtgtccagtcactgtggagtcttcaggaggcaggggcagccctcccaggagccctgtgtgtggtcactctgcccctctgtgtccatccaccctgatcctgcctctgttgacctgctccccagcttacctttgtgctccaaatggcttccctggccgccctggctgcagacctccaacgtggagtcatgagtaagaatccattgacaagcacccctgagatcctggggtacgtgccacgagcagagcaggcatcaggtgacacccaggtcccggcctgcctcggacacacatggtgccccggtccccagcctgagccctgccctctcactcaccacccacccagccggaattggctctggccactctgggagggcggggtgggggttgcaagtcccttgttacgcagggagcccctcagttagggagaggagacagggtctcaggacaggaccttgaagacaaggaagggcagtgcagagaggggtgagagagccagactgggtttctagggggtggtccagggtgggagctgacctgcctctgctgagactgcgttccaggtgtgagcattgatgtctagcccatgtagctggagaggagtcacagccatgctccccagctccagcccacctccccagaccccagacccagtgtggcctctccccacctcccagagcatgtggtcaagcccctctcctagcccgaatccctccctcatttgctaattaccaggacctacatgtcccagcttcccagggccaggggacagggccccgcccatctggcaggctcaagttggctgcctggctgccgggatccaggcggcgctcacaaggatctgggcttgcacagcctccaaagggctgttgtccattctcttgtatttgttctcatcctctcctttcttggaccctctgagtctctggttccctcttgttgggacccagatcactctgtgcctcagctgaatcatttttcccttcagtttacacatatccacctagggtccactacatccagaggcttccgcctcagtccttgtcctcaggctgtgcccagggttgtgaggatggcggtggtccttaccttgcaaaacagtctcccagtgacaacaatgttcagggataacatctatggagggctttctatgtatcaggaccattctgagtatcttccaagtgttagctcctttaatcctggaaaggaccccatgaaattagtacttttattacccctgttgtacatatgagagactgagtaaaagccggtggcttgtccagggtcacacagctaactggaatggccaggagtagacctggtgaccatggaccccagaccttgatcactgcacacgctgcgtctgggacctcgcctggtacctgaggtccgtggcgcgctggtgctgatcattcagagtgctcatgggaagtgtagtctagagtctgtgtgcttcctgatctccttgatctccattttattgaggaggcctttaggccacccgaggggtccagagtgaccctgtggattagcagtggagctcagcttgagccagcgctcttcaggggtcgtgttctgcccccattctctggttcattctgcaggtagcagggaatcattgaagattagagagaatcaaacacctggagagagatgactctgcccggggagcccaggctcctgtctgggtgcacactccagggctagatggtgacttctcagctactctagcttcataggctcatagtgcatgtgagcactcatgtggacacacgtgcacgcgcacacacatggacacacacacacacacacacaccgctgtctttggaatcagaccatgaaaatgcttcctcagaggcctaggggtgaggaagctgaggtgagttgtgcctccagctggatgtgctgggatggggtgggagatgaggtggccacacctgggtggcaggaactctggggcagtgaaccttctaacgaacagatctgggatgctgccatgaggaggaagagggagtcagcagccatgcctgccaatgcctcctagcgcatttgtccatggttagcggataattattgtgtccctatgggtcccaaggtgtattattttttttttgctcttataataaatcaacacaaatttttagcagcttcaaacaacacgcatttattatctcacagtttctgtgggtcagtagtccggcgtgacatgactaggtcttctgtgtaaggactcgcatggccaaagtcaaggtatctgaagggacaagggaaaaatccacttccaagttcaatctggttgtgagcagaattcagttccttgtggttgtaccatgaggtctctggtccccttcatcttcaaagccggtaatggacatcgagtgtttctcttgcttggaatctggcactctagctggagaaaattatctgcttttaagagttcatgtgattagattgggtgtacccagatgctccatgctaatctccctattatgcacagatgcataatcctaattgcatctgtgaagtgctttttgccaggtaacatggcatacttgtaggttccagggattagtgcttgtcctccccctgctattctttagtgggcagggggtcatctgcctaccacggaggtaaggggtcaggaggtatgcatacagcaatgcccaaaaagagactgtccccactgggatggagtttaccgcctagacatgcagtcttaactcagaaatatggagatagcctcgaaggacaggacaggtactgggcacgtgtgggaatggaccaagccaggtgctccgggggctttcccaaggaactaaggctgagccaagaactgaaggatgagttggagtcagatgagggaaaatgtgggcaaactggatttcagaaccaacccccaaccctggagccaggagccatggtactgaaggacagtgcgccataactcagagaaccagggagggttggcggaggctcacagggaccgggttaccccagggccttgtgacagtactacccctagtatcagaggagactgtcattggcatttaggccacttggtgctcataacacctctatgtcaggtgaacactattgtcatccccaaattacagatggggaaagtgagccaaatgtccatgctagtaagaggcaaatcatatcacttctttgggtacccttctagaaggatgaggctgactgccactggaaacagctggggagggtacaaggagatgacaagtggctcagaggctgtcctggctataagaattaaagaggaaagaaacaccaagggtggctcgacagtcaacaaggacaggtttattttggaaaacaaacttgagaggggcttctggccaagttaggtcagagccacactctcttacaaactaaggatatttaagggttttggagggggttcttatcataggttctgaatgtttctgtgtgagggaaagtttattgcggggatggaatgtctctggtcagaagggaggctgtctccgggttggcatgtttctggtcagagaagggtttatcttagggttggaatgtttctggttatgctgacattagctattaggctgatattttcgggctggatttaggcggcttttaattaagggggaacttagaatggtggtgtttgttcaagatggcaatgctcctgctccgtcactggccaggtaaggcaaccctttgttatggtaacaacctgagattggcaggggctcacctccaggggcagctcatgtgcttgctggcgaggctgcaccttgtcattcaggttcacagggcacaggtcaaccaggccctggctcttcagtcttctgcctggagtgacttatgtaattctgctcagctttcatagggcacagggagtcggggctaactctgctgcctggggctggaaacagactcctcccttgaggagcagcagtccaccatagggaagtcacagtggtccaggccaaaggggatgcaggtagtgtagactaggcggtagttcagggaatggagagaagtgggaataaagggatagtgaaaggaagcatattttactggcaggtgatgaggtgtaggaggacaagtcatacatttggactttacagagcagtggacactcagtcagctgctgtcagcgcctgggacttaggggagtgcccctggctggagacatggtatggagtgccatcagttagggagccctgggcacaggtaagagaaggtgtgacaccaggagggaaagagtctggggcccagctgcaggaaccaatacccataggctatttgtataaatgggccatggggcctcccagctggaggctggctggtgccacgagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcattcattcattcattcagcagtattagtcaatgtctcttgtatgcctggcacctgctagatggtccccgagtttaccattagtggaaaagacatttaagaaattcaccaagggctctatgagaggccatacacggtggacctgactagggtgtggcttccctgaggagctgaagttgcccagaggcccagagaaggggagctgagcacgtttgaaccactgaacctgctctggacctcgcctccttcccttcggtgcctcccagcatcctatcctctttaaagagcaggggttcagggaagttccctggatggtgattcgcaggggcagctcccctctcacctgccgcgatgactaccccgccccatctcaaacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccaggtttgccgggaggggacaggaagaggggggtgcccaccggacgaggggttccgcgctgggagctggggaggcgactcctgaacggagctggggggcggggcggggggaggacggtggctcgggcccgaagtggacgttcggggcccgacgaggtcgctggggcgggctgaccgcgccctttcctcgcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggtacgcggagtcgcggaggggcgggggaggggcggcggcgcgcggccaggcccgggactgagccacccgctgagtccggcctcctccccccgcagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaggagtgcctcggggttccttggcttgcgggaggaattggtgcagagccgggatattggggagcgaggtcgggaacggtgttgggggcgggggtcagggccgggttgctctcctccgaacctgctgttcgggagcccttttgtccagcctgtccctcctacgctcctaacagaggagccccagtgtctttccattctatggcgtacgaagggatgaggagaagttggcactctgccctgggctgcagactcgggatctaaggcgctctgcccgccggaatccgttgtacctagggccaccacgtggggtgctggaggtgagccgaccacggaagagggggaggaggagttggagttgggaggagtccgaggtcttctaggcctagacctttctctcagccccaccttccccagccttcttgttgggcagagggtagccagaggacagaaagatcccacccagagccactcactgccatccactttgttaggtgacttcaggagagttttcaggcgggtgggtgggggaggtgcagagttcttggtcataccgccccgtccacccccgaaccccacgccttgggttctgctcccctcagacacccaccaagcctccgccacagcagttccctgaggaaattgggcgtggggtttccattgggaccgttcgtgttctgtggtgccacagacatgtctgtaaaaccttcagttatgtttgggcgcagtggcacaagcctgtgatcccggcactttgggaggtggaggtgagtggagtgtgactcctctgcttctctcagtctccagccacatctcgtctccagtcccctgttcactcggtcatcccgcgcagtactggacagcgagctctccttccagaagagcaatggggctgggtggggtgaagattaggaagaggaaggagaatagaagctccagggagtctggaagggtggcacccatcttgggatggggcaccccttccatgaaggtctctaaagcaaggccctcctcagcttactccctgccagccgagggcctcagtctcattgttaactcagtgagagggcggtggagcccctcgtctacctcccagctgggggagacatggggggcatgggatggctccagctgtagcgggaaggtcccactcctctcagcctggctttcaggcttgaggtttccttcttggatctgagtacctgtggtgtaacaggcaccctcctcggccctggcctttatcacatcccctcagctcctgggtgcccccagccccagcctcccaaggcctgaggctgagctttgcccaggacccccagttccccccacaacaaactctttctgcctcgggccccacaccccaccaagccctggctggccccctggctcccaccccgcctcagcggtctttgctctcggctgtgtcacagatagggagagcaggggcgcagtgccccatgagcatctaatgcaactccctcatttcacagatgaggacactgaccccaggatccagggcatggtcatacactcaatgccatgccccctgcaagggccctgtggcctcacatgagcaagttagactctgagggccgaggagatgggcagggcaggctgggcacctgctgtgtgagggcaggagggttggtgagagctgtcctccaaaagcaggtgagtgtctgaggttctgtggccccctgggggcatccacaaggtcatgggtccttggactccaggaacaaagggggtgtctgtgggtcagggacctatccgcttgccctgcccaaagtgttcctaagtcccctgggactaataaccggcctgcctgctggggaggtcagctgctacatcccaccttcaagccacacctgcccccattgacccccatcccatggccagctccatttcctccaaagcacaggctccactgcccaccaggtggtgggtctcttcctcaaacccctgtttgactgccccaggacctgcagggtcagccttggaaatgcatttccaagtaacgccacaaactctgaggtacaggacagacaggtgtggggtccatctgcctgttctccatcactctggtggtactatgtcatctgctgagaaagacccccggcctacagggtgaccctcactctcctcagggccactgtttgcaacagacagacagcctggcaggccttgaacctcattttgtaggttcaaggcctgtcccccatctgtccactataagcctcacacacaccattcttctgggataccttccctgaggccacctggtcaacacccacaggcccctttgcttcagcccaggtcctgttagctgaggtttccatttctggacatagctccacccagttctgtgatccgttgggctggtggcaccaggggcccctcggtacttgtccattctggacagcccagcaatgtaggcttttcccaagacttcccaccctgcatgtgtcccacctcatcccctccaggaattttgctttgttgcagagactccctccccaccaccccccaccgccagcctccagaccccactcccttctgggagcccgattccagcaagatcaggatcaggctcccactctgctccttctactggcctcagtttttcccatctgtgaaatgaagggattcatcagaagtccttcccacatactcaatcacggaggcatgacagggacatctcacatcctcagaggcacggttaatccaaggaatgccatgggaagggaggagacagcaggtggcctgtgcctgcactcaggtcttgataaattgtgaaatctctccctcaccccttcctcggagggcactattgttcctgatgtgccagccttgatggcagtggatagggaggcagggacagagacaatgaggaagtgtggttaggtatctacttagaagtctccagatggagccgggaagtgctaggaggccagtgaggccagtctgtgcagcagggcaaacgagtggtatcctgctgggatgcaactcaaatgccttcactgggaactgctcccccaccagccccacactgaagggctggctctaccactcacaggagctggcagggcaggcaatgagacaaccctactgcctctaatgcagtagataaaattaatgcagggccaaccctcatatcagagtggtttttcagttacctggacaagtgccaagggaggggcccctggggccaccagcccaaagaccacagaactgagtggagctctctatgtgcaggagacacacacagagatcaactgatccttggagcttgggagatttccaggatttctgggccactgacactgtttctataaagccctctttggccatctcagttcctttccaggctaagcagtgaaagccaagtcttagttctccaggcctgggccttcctgagtaatttacaggactggtgtgagggacaatgtcaacccaccagccaactgcccagatttcccctcctggcgagtgaggccaagccacttcatttctatgtttgaagcccatgtaaaagaaacagagattgtcagtttcagaaaccgactctgtcccttcagtcctggaacctcaggcctcatctggtgactatggggtctcaacttacagtttagctctcaaaacagccagacagagcaccaaattgaaaggctacaaatgagaagtatcgtccccaccgccccagtgacttggcttcttgcgtacctagttctcttctcagtttaataggtaatagatttatatggctcaaattcaaagcatgcccaggggctccagagagaaggctccctcctgttgcctccctccacagggtaatcctttctcaaattcactagatcactgcatccagacagggagacactggatccctcgttcatcatggctgcgttcttacccctccctaactccttcccaaacatagctacatcccttccactgttatataaccctccaattttggccggtcagggagatggattcaagacttatctcccattctccttggctgcagcacctgaataaagcccttcctcccggcagtgattggctgtgcagcatgcaatgggacccagacaaaacccctggtgtttcagtaacacattcagactatggaacagattaaccccggctccctagaatttgttttctgaagaacaaacaaacaaggcaataatgtcttatgaaaagacatcagtaaccttaagcctgtaaaccccatccatctgtagggcaccccatctcacagcaaagcatgggtgacagctgtgtgctgagaagagtcggaaaaggagccatgcttccaagaatgtctccctcataacatgatgagatgagtccttagtgaattgccaaccaaaacaaaaaacacagctgctaaaaaagaaggttcctcctttggaatccttgtactaccatatcaaaatattgagaaggagcatctcttgtattgacagtaaggatgctgatgactattagtgaataaaaagccagaatgaaggacatgaacttacacacatttaacatttcggcacaggtcaagtaactacaataacctatatacaagacaaacaagacaaagtatatttagaatacatgcgatgagtattgatgcagaaatggacatttctcagaataagatatgactttacagataccatacagagaatatgatttcatgcagatggagaagatgtggtgggagttgtgggagagcaatagaaaatacatttcctggctgggtgcagtagctcacatctgtaatcccagcactttgggatgccaaggccaggagttcaagaccagcctgagcaacgtggtgagaccctggtctatataaaatatatttttaaaaagtttcctgtacctagaaacaaatccaagatgtactctacagagaacctctacagagaaaactaacaccctgaacgttattggagaactaaataaatgaagagactgaccatgtctctgtgttgggaacaggccccccaaaatctggccataaactggccccaaaaccggccataaacaatatctctgcagcactgtgacatgttcatgatggccataacacccatgctggaaggttgtcggtttaccagaatgagggcaaggaacacctggcccacccagggcggaaaactgcttaaaggcattcttaaactacaaacaatagcatgagtgatctgtgccttaaggacatgttcctgctgcagataactagcccaacccatccctttattttagcccatccctttgtttcccataaggtatacttttagttaatctaatatctatcaatgctaatgactggcttgctgttaataaatacgtgggtaaatctctgtttggggctctcagctctgaaggctgtgagacccctgatttcccacttcacacctctatatttctgtgtgtgtgtctttaattcctctagcgccgctgggttagggtctccccgatcgagttggtctcagcatctctgtactggaggcaatattgtgctcgtaacagttctgtctggttgatgattcagcacagtcccaatcaaaattctaacagatttttctatgggaattgacaacctaattctaacatttatatgagactctaaatgaccaagaagagtcaaaacattttcttgtagaaggcaaggtgtgaggatttgctttttcaatgttaagacacatgatcaagctacacaattaaggcaaagtggaatcagaacatggcagacaacagaccaatggaaaaaagagcaatccagaaacagacctctccacacacatggacacaatatcagactgggggagcattgaaatccacatgaaaagaagaactcattcaactaggggtgctgggcagctggctaccatgtaaggagaaacatcaaactgggctcctatttaactcccacacaaaagtcagttctacatagattacagccataaagaaaaggccacaaagatcttaaaagatggtgtagaagaatatcatctttatgatttaagtaagataaaatgagtacatacaataaggaaagattgacacactattagtgagacaccgtaagaatgaaagacatgctacaatttctgcaacttatcttaatgcaagtgagccccaaaactggggctcagcctgagagcgttcttggctttgcacaggaaataatttgagagtgacccaacagaaaagagtgaaagcaaagcaagtttattagagcaacagagtacagaaaagtgggtttcatagagcatccatacaggtggatggggtttacagggctaccccataggcagagcagcactcctggactaccagctatctatatgtatagctacttcttattatatgctaaataaggggcaggttattcatgaattttctagcaaagggatccggagttcctggaactgagggttcctcccccttttaaatcacataagataacttttgggtattgccgtggcatgtgtaaactgtcatggtgctggtgggaatgtcttttagcatgcattatcactagcatataatgagcagtgagggacaaaagtgaggtcacttttgttgccatcttggttccagctggtttcagctgatttcttcactgcatcctgttccgaccagattctgttttgatcagcgggatcatgaccaaggtcttgaccagtgcttggaaaacaagttctgctgatctcctatctcaacattacattattaggaaaccctatttaaaaaaatgagcaaaggactttagaagccacttcacaaaacagaatatccaatggaaaagttgttcatcgtcagtagaaatcagggaaataagaaccaccatgacacaccactactaacctcctcagctgtaacgtgcccacaatcccactcctcgatatatttatcccggagaaacttgtatctcgaagcaacccaatgtccatcaataattggataaattatgcttgttcattcatggaatattcaacagcagtgaaatgaacaagctataggtacaaatatcaccacggtcaaatctcataaacatattgagcaaaagccacaagatatatatatataatgcagttccatttatataaagtttgaaaacaaggacccccaaactgtactgttcagaggaccacgtgtaggtgggaaaattgtgatgaaagccaagaaatgatttctatcactgtcaggacagcggtcccactggccaggggcatttgggaggtggcagggtgctgcagtatttttctctctgttcttacaagtgcctatatatatttattaaaccttatgcatttatgcatttttccatatctcatactccctgatacaaaagttaacatgcacagtagaagggagtgaagaggaagtgaagagcaccaccaccaggccgaccgttgggtaccgtgccatgcagaagcactgcccaactgccccatcccactaagaccttgccagacactggcccatacggagggctgttcccactttgttggcctcttccccagcccacccccagcctccctgagcttcccaccacagtgtttctgctgggagtgggggccgttcttcctcacctccttgtttccccatgaggtgcttatgtccctaaacaagcacctccttagcgccccccgtctagctcagtctttctgggccctgctttgctgtgtgctccctgccttctggcatgtgctatgaccctcacaactgtggtggaggccccaggattggaatgggaagaaaggcgtgttctatttaagcccccttaaatccagcagaggctttgagctttgagtcctcaagtaaccacataaagtctgaggctttggggatgcctggtgtgtgcgcgggggcttcacagggaccacactggcttctggccttggcagttccccacagagctttggagccacgagctgatccttacagtcttagggttggcttttaactagtggcccaggccggaggttccatcttgctggtataaagtaaggtccatgtggggatatgacctttggcaactcagggcagtgctttggggatggtcacagctcagagccgtgttctctgactcctgcacgggcctcctattaatccaaagagagacagtgcagaggaggctacagaagggtcccaacctctgaggcatgaatggaggagggcaggcccaggcttgctgcctttactgtgttctcagccaggtctgagatcaccacttccaactgcgaaggcagcaaggggccggtgcaacctggtatgagtcttgtaccacccacagtggagttgtgccagatgagctgtcctcaaagcctcctgccagaacagggactggggagggtccctcctgagcccacgaaacacatccctaggtctgctgagttagtccccttgtgcggctcagcttggctctcgatttgtgccttacatacattttgttttaatttgttgtttctttttagagacagggtctctccctgttgcccatgctgcaatgcagtggtgcaatcaagctcacagtaaccttgaactcctgggattaagccatcttcccgccacagcttcttgagtggctgagactacagttttgtgccaccatgcccagctaattatatttttatttttgtagagacaggatttcactaggttccccaggctggccctaagtgatcttcccgccttggcatcccagaatattacagggatcacaggtatgagccaccgtgcctggctattacgtacattttgacccaggaattgggagactaaagtcgtggctttgcccacagaaaggtaagagtttgttaatggacaacagcattaaaaggaatcagggcccttcagagaatatgctattttcttgggttgagatagagaaacaatgaaatcaatacgcatccaaagctagcaagggccatacaaatggcttgtgctgagaaccgtctgtcccagggaattgggtttacttgggagatccagaaggaactggaatggtttgaaaaacacaccacagtcttacccttagaatgggagcagtggtgtcaggaggcaggctgtgcagagatgagggatcatgggaccctggagtgggccagaccaacttaggggacaggaaagctccctgatgtgaggggagggcagacgttgggaacagacaaggtcaccaccagggaaccaggtgacccagaacactcttgagggggggccattcaatgctgcagacagcaactccgtaagaatcagaagccattccatgagccagggcagccctcagaggctgtagggaatttgggcaaattaaaggacagaagatcagcatcaaacattgaaaatattttaggtatacctggggacagcatagttactgtgggtgggtgtctggggttgctcaggacctaagggaatgcattttttaaatgtagggattaggtgtcaaggagggctcagtggagtcctccctgaggagagcacagccagtcaggagagaggggctgacggcagggaggctgatggccatggccgccatctcttgggcgcagctgtgggactgtttcaacagcaattcttgtggcaaacctgggattgcctggttttgttttctgttgccaggggagacccccaagtgacaaaatctagaggaacagatcagaaaaagtaaatatatgggccggaaagcaaagagaaagtaaaaggagggaaggcactggggttgaacacaaatgaccagccctgtgtgtgaagactgccagcagccagcacaactgccagggccccagctgagccatgctggggatgcaagccagcagtcgcatgaggaagcacagctgtggacatctgtccccaactgctgacaactgtgctgcagaaacagtgctgctcaagactgggaacatccccagtggaggacagctagtgtcctgagagccagtgggacacagccactgctccctggtgctcagctcagcaacctgctgggctgtgctgcactgactggggcaggatctcttaggactgaagacatccatgcaatgggcatacagagggaaatggaaatgatgagatttcacacatatgaaaaggagaaggtattataaataagacccaggcaggtgatgactgcttgtacagatacgctcagggaggaggacagcagaaattgcttcctgctccaccccagcggggtcgccagggctaatgctaaccctccacctggttagatatgctgtggggtctagggtttgtcttccctgtctactctctttccatcagctgccagggcattcctgctggagtactgaggtagcaggaagagagggctacatggggctgggtccgggatcctggagacatctcatggcctgcatgctgctctaaggacttccctgtggttggcgagcaggaggctgaggctatcaccatctgctcattcctagtaactctgggtcttttaaaactggagcacatggcaggctagtgaaaatgctgagatgtggagagaaggatctcactttccaggacacccagccctcccgtgcctactgggccactttgctcactgggtgagcacagagcctcggggaggaggttaacaccactgggctctgacggatccctgggctctctttgattgctttgggcttgaatcctttgaccttaagacttttttttccctttggactttaacctaaaaggacaagggaacttaattttttgacttgaatttgaccctaggaaatttatgaaagacatttctaggttgactttttatctgggtatctggcatcttatatatctgcagaacctctgactcaaatttgaactttgaggttggacctaatttaggatgggaaagtaggaagagtagtaaaagaatgtgtcgtctggagtccaggctacccttggaattaaatagcattgaatgatgacccattccaagtcctgggtggggggaatctatgctgccccgaggtctccaagggggagtggataacacaggggcaactgggcttagcaagtagcagcaatatcgctgacccctgagttcaggagcagggggcagtttcaactcggctccttgggtcttcccttgggatttggccactttgccatgtgggtgtccagcagtgccctctaatctggggtgaagcagagcagcctgcccaacttgtgaaggtctctctccaccaccccagacccctaggaactcccaactgactgctgatatcagacctcctgcctctgtctgggccctaaggaagtggtgtcctatgtggtccccaccctactctgggactcctccctcctttttatccccaatgctacagtcagccttggtatcactcccgatttccacaggcctgtcccagaaccccttacacctgttttctcttctggaagtgaaccctgagctaacattttaggtaattttttttaaggacccactctgtccatattgcaagaggcagaatatgttctgatagcggaggccatggggagcgggagagggaagaggagagcttacaacagatatcacccactgtccatgctgtgagcctgcggtcccctgctgctggggcctctgcagggagttggtgagcctgatccctggacctagagactgaagtgaggctttgcagtccctcgctgagtgagaccccttgctgatccctgcctggtgggctcccaaggcccccctgttgcagcccctgctgagcatcctcctgcatgcactttccaaccttgggggacccttctcctggtccccccagccttagctggttctcttccctgaaggcccccggaggcgtaggctgggctaccccagcagcgggggcctggctatgtggggaaaagaaaaagagatcagattgtcactgtgtctgtgtagaaagaagtagacataggaggctccattttgttctgtactaagaaaaattcttctgccttgagatgctgttaatctatgatcttacccccagccccgtgctctctgaaacatgtgctgtgtccactcagggttaaatggattaagggctgtgcaggatgtgctttgttaaacagatgcttgaaggcagcatgctcgttaagcgtcatcaccactccctaatctcaagtacccagggacacaaacactgcggaaggccgcagggacctcttcctaagaaagccaggtattgtccaaggtttatccccatgtgatagtctgaaatatggcctcatgggaagggaaagacctgaccgtaccccagcccgacacccgtaaagggtccgtgctgaggaggattagtataagaggaaggcatgcctcttcgcagttgagacaagaggaaggcatctgtctcctgcccgtccctgggcaatggaatgtctcagtataaaacccgattgtatattccatttactgagatggggaaaaccgccttagggctggaggtgggacatgcgggcaacaatactgctctgtaaggcattgagatgtttatgtatatgcacatcaaagcacagcacttaattctttaccttgtctatgatgcagagacctttgttcacgtgtttatctgctgaccttctctccactattatcctatgaccctgccacatccccctctctgagaaacacccaaaaatgatcaataaatactaagggaactcagaggctggcgggatcctccatatgctgaacgctggtcccctgggtccccttatttctttctctatactttgtctctgtgtctttttcttttccaagtctctcgttccacctaacgagaaacacccacaggtgtggaggggcaacccaccccttcaggctgcatcagcaactcagttatccaggcgcaggttctagggtacccacgtgttgagctcagtccctctgactcccaagccaggactctgtctgacggcacctgcttcggtcagggcgtgggagattggcctgggcaggctcttcctcccaaggcagggtcagtgttgagtaaaggccaggaccatttccccagacaggcaaggcagggcccaggcctgggtccagggcctctaagtccacgtccccactttggccacatgggtcatgaggggtttctgtgtgagtggccttttacactttcccaagcaatttccccagacattatctcatgttatcctcatgaggaccaccctgtgaggtaggaattagcaaccctgttttaaaggggaaactgaggtaaggtatgacgctttcctggcagggccagcctctggcacagcaacagggggacagtgaggatggccagatctgggtgcccctccccactgccttctcttccaagctacagtcttttattcaaattcttctcctctttttctctctcatttcccctcccccgctgccatgttttttatgcttgtggatgtctcatgcaagagtgttcaatagctcctcccagcagtcttagaagggagtgtaaagatgaccagacacggaaccccgagagttcactgggggttcccaaaggcatgtataggatccaacgtgttttttctgcctcccactctgccccctttcaagaagtgcacctgtggttcaaagttcagcttttactgccggtgcatgtgtaggagaggacagggcaggctagagccctgctaagggccagagaatctcatcccacccagaggagggttcttttaggcggtgggtacaaatctcagaacatccccactgtattgttgagagggtgaggtgggacatgttgggggaagagcgagctgcaaccggtgcagctgcgattattcagagcagaggtggcttcagagacaacattaagcttaaccctcaggggccctctttgccttgggaggagccctatcaatgcttttgtcatgtgcttttggaaaatatgtagaagacatttttacaagttggttgaggcctagtgtctcttttcagttcatattctccctctgtcacgcgtctgtcctgttggaatggctgtggctattttggatatggctaagggagaaggtaaaattggggatcattttgtatgagtttagtgggacacatttctgggctttgaagtcacttctgtatctactaaaaattgctatagttatctttgtgcataaattacttctggctgatgtaagcaaatccccgtatcgggactcagccggggagggtttttggctttgctcaggaaggaattcaagagtgagctaacagacaaaactgaaagcaaagcaagtttattaaagcaacattgtacagcaaaatggctgctccacagacagagcagggctaccccacaggtagaatagcactccaggattgctggctagctatatttataccccctgctaattatatgctaaataagaggcaggttattcataaactaggaacaggaagttcctggaaccatataagataattcctgggttattgccgtgggatcatttgtaaactgtcatggccctggtgggagtatcttatgcaaatgcattttaattcctattccgagctggttttggccattctttgttattgttatgttctgttttgatcagcagggttttgacaggtgcttggaaaaatcctgctgatctcctccctcacagggacatgcctactgccaaaggagagacggaattatctttctattctccccatagaaaatattacaaaatcactgtcacacgaaaatgtgatcaaagagtctgcagccaagaaatatgggggggacagagtgttttaaaggcgaaggtgtgtctgtcacttagtaaaaatgtcaggattcttttttttctggagtttgtggtgtttgtcggcttttcaaaatttgtcattccttttcttaatctaaataatcattttatagagaaaaaaaattactcatcagtgttgatgatgccctggttttctgttcagctttgttttccaatcaactcttcacccaagactcaatcctccaccctccaactcttcatccaagactcaattcacccaacactcaatcctccaccctccaactcttcacccaagactcaatcctccaccctccaactcttcacccaagactcaatcctccaccctcctccaactcttcacccaagagtcaatcctcccctcccagtgtttactgatcagcctcctatcagctattaatgggacctcaaacattctctatggctctgttctcacgcaatgcaatctgctaatctctaggaactgcagaccccacttaatgcatttaaagtatgtataatgtgacccaatagcttctttatcccaagcttattgattcctataagaatcatcatcctcaagtcacacatgaggaaactgaggccaaggccaatgctaaggctgatggaagtgacagatgttgaagatgacacagcatgacacgagggatgaggtcaaggctattgatgaggtcaagacagctgttgtgctttgtcccaaggccattccagttggtgacaaaataactataacagattcctggccagggcttctccctcacagcagctgcctcctactggagtcagaaatgccttggtttatatagtttcattcataggctgtcttaactctatttaagcagaaaagggctgaaatgtcttgcccaagatccctcagctagtaagtgacagatgcaggtttcaaatccaggtcgctggactcagggcagggccagggggaatgagggcaaacagactggcagctgatcaaactgacactgccttcctggtaaaggggacagtgaggagaaattgacaatagcaggaggctctgaccacaacaggctgcctccagtctcttctctcaccagtggcccccaaagccacgtgagttgggctttctgaccacactttattgcatttgcagaccctacatgctttaaacacacttttagtatctcactgggtctctaacaaccccaggagtgggcagggcaataattatttcacagttgacaaagcagcttcacgaaaacattgggagctcaataacttccctattgggatgcacccccaggagctgttcagttaatgtcatagcaggttcagggaatgggcttaaaccccaagatatcctacaccattttgtacacagcaggttctgtagggagaaaaccaacaaggtcttcccggagggaatgggcttaaaccacaagatatcctataccattttgtaagcctccctgtgatcatttcccatccaagtactaaccaggccagaccctgcttagcttctgagatcagacgagattgggcgtgttcagggtggtatgtgaaagattctccccggggcctgaaagtttggggggatgaataactcctcccttctcaggcccagtcccaaggcacaagaccacttgtgctagcagcgtgtgtcagcaagatagcagaagcaggaagagagctggccaggagacacgtacccctgaagatcaagagagaggccatctgggtaccatgtagcagttacatcagactgggacacttcctgtttacaggagactataaaacccctgccccgtcctcacctggggctgacgccattttaggcctcagcccatctgcacccaggtgctcattaaaacagcgtgttgctccacactgccttgtgttctttgctggcaagctctcggggttcgaaccaacacaagagccttacagtatggccgcagatgtctcccaacatttcacagaacctggtcagaataaaacattccatgggggttcaggtcataaaaaaatactgcctaaccacctaaccacaggaacatctctattacatcctgctggatgaagggcccaaggaacatcttcaacatcctgcaggggagcaagctatactgccccttctcccccggtccagacccataactgacagagcaggagcactgccatcttgaacaaataccaccattctaagttcccccttcattaaaagccgcctaaatccagccccaaaacatcagcctaatggctaatgtcagcataaccagaaatattccaaccctaagataaacccctctgaccagaaacatgccaaccccgagacagcctcccttccgaccagagacattccaaccccgcaataaactttccctcacacagaaacattcggaacctacgataagaccccttccaaaacccttaaatatccttagtctgtaacagaagttagtctgagctaactcggccagaagcccctctcaagtttattttctaaaataaacctgtccttgttgactgcccagccacccttcgtgttgctttcctcttccttatagtaaatgtcccagtctgtaagtgggactcgtgctctgagactaagctggtcccccctccacaggtttgtgctggcaataaacctgtgttgctgttaagctgccaactctttaaccctcaccttcccttcaaaacctaacaaagatgaatgaggcatgaacatgaagacagagggtcaaacccaaagagcagattccgtgagaagtctccctattgacaagggttactaaggatggggtcttctctggaccccctagtcttagacttagtccaccacatccagaagcccttgaaataagattgcagtgcttctggcatagccaaagacatagacttctctaaaaatcagtgcctagctctccccaggctgggccctaatttttagtccaagctgtattattttgtaaatcttcctgccatttcatagaccctggtcacagtgaaacattctgcaggggtttgggctgtaagtaacatcctccccaactgtctgacttctttatcacatcttgttgggacaaaggtttaagaaatatttttattaacatcctcttgggcagtaagtcctaccattccagacccctcatccaggcctataatgattccagcctgtaagtgctagtggggctttggcattaagttggtccccacctctgtaggttgtgttaataaacctgtgttgtagagtggtcaactctcttgtctttaaccctcgtcttttttcaaaaacctaacactcatgtgtcctctccctcaccttctcctggcatcccttgccactgtccctctgtccctctttcccctccttaacccaaagggaaatctctcccaaaggtaaaagtctcccaggggttaagagggagcttgaggcaccagaaagagctatagtcacagccacctgtgaaagccatctctgaggtcccttcctgtcacaacagctgggctcctgactcagaccaagacagcttttgtttcttttcctttctagccccccacttcccacccacctttctgctttctcatatgggctcattatggtttatagggctggggaacgttgcctcttctgccctccatttctcccatctcccttctttcccctccactttttctgagtccacttctcttcccttcttcttccttccctctgggacgctgcacagttccttccacccggcacggcctgggactctagactccctctgaaggcacggaagtatttccttccctccctccgacccgatctttctgcccttgattcaaaacaatctgaggtccctaggcccttccctttccgcctctgcgctccccatggggtccggtgtagttttcccgccccttccctgcagctcccgagaccacccggacacaacggagccatccagcgccctcagaggccctgggcacacgggcagatggtcaccgcctcctaagggagcagcgcgcgcccgttgctcgctgcccgttggttgttgctggtagctccggagggcggggttggcgaggaaagtgagtccgtatgtccccagcatgctccgcgcgggggcggggctctaagggggcaggcgaaggcggaactggcgtggtcaaaccaacctatcagcctccagcatgctccgtgtgggagcggggttcccgggggcggggcttggtttgtgtgcccttccggcgtttcgcccctgcgttctctgagatgctcccacgca

SEQ ID NO: 160 - DNA, 509834 bp, Homo sapiens
aatcacatcacaagtcataaaagatagcccaggcctacaattatcttctaatggcaagtcaagggggaatatatgttttttttcaaagaaaaatgttgcttttatattacacttctggtaaagtacagcgacatctggtggaggcaactagtattacaacccatcaaatggctatcaggtatcaaactctactgtcatggttatagcctatagtactcccactaataatgggattctttttttttattttttattttattatactttaagttttagggtacatgtgcacattgtgcaggttagttacatatgtatacatgtgccatgctggtgcgctgcacccactaacttgtcatctagcattaggtatatctcccgatgctatccctcccccctccccccaccccacaacagtccccagagtgtgatattccccttcctgtgtccatgtgatctcattgttcaattcccacctatgagtgagaatatgcggtgtttggttttctgttcttgcgatagtttactgagaatgatgatttccaatttcatccatgtccctacaaaggacatgaactcatcattttttatggctgcatagtattctatggtgtttatgtgccacattttcttaatccagtctatcattgttggacatttgggttggttccaagtctttgctattgtgaataatgctgcaataaacatacgtgtgcatgtgtctttatagcagcatgatttataatcctttgggtatatacccagtaatgggatggctgggtcaaatggtatttccagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtatgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcagaggagtaggttgtgaaaattttctcccattttgtaggttgcctgttcactctgatggtagtttcttttgctgtgcagaagctctttagtttaatcagatcccatttgtcagttttggcttttgttgccattgcttttggtgttttagacatgaagtccttgcccctgcctgtgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattggtctatatctctgttttggtaccagtaccatgctgttttggttactgtagccttatagtatagtttgaagtcaggtagtgtgatgcctccagctttgttcttttggcttaggattgacttggcgatgtgggttcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttggagaggtccttcacatcccttgtaagttggattcctaggtattttattctctttgaagcaattgtgaatgggagttcactcatgatttggctctctgtttgtctgttgttggtgtataagaatgcttgtgatttttgtacattgactttgtatcctgagactttgctgaagttgcttatcagcttaaggagattttgggctgagacaatggggttttctagatatacaattatgttgtctgcaaagagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttctgcccattcagtatgatattggctgtgggtttgtcatagatagctcttattattttgaaatacgtcccatcaatacctaatttactgagagtttttagcatggagggttgttgaattttgtcaaaggctttttctgcatctgttgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgtcagtattttattgaggatttttgcatcaatgttcatcaaagatatgggtctaaaattctctttttttgctgtgtctctgcctggctttggtatcagaatgatgctggcctcataaaatgagttagggaggattccctctttttctattgattggaatagtttcagaaggaatggtactagttcctccttgtacctctggtagaattcggctgtgaatccatctggtcctggactctttttggttggtaagctattgattattgccacaatttcagctcctgttattggtctattcagagattcaacttcttcctggtttagtcttcagagagtgtatgtgtccaggaatttatccatttcttctagattttctagtttatttgcatagagatgtttgtagtattctctgatggtagtttgtatttctgtgggatcggtggtgatatcccctttatcattttttattgcatctattcgattcttctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacaaactgctttgaatgcgtcccagagattctggtatgttgtgtctttgttctcgttggtttcaaagaacatctttatttctgccttcatttcgttgtgtacccagtagtcattcaggagcaggttgttcagtttccatgtagttgagcggttttgagtgagattcttaatcctgagttccagtttgattgcactgtggtctgagagatagtttgttataatttctgttcttttacatttgctgaggagagttttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatttaatggccttctttgtctcttttgatctttgttggtttaaagtctgttttatccgagactaggattgcaacccctgccttttttttgttttccatttgcttggtagatcttcctccatccttttattttgagcctatgtgcgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcagctggtaccggttgttcctttccatgtttagtgcttccttcaggagctcttgtaaggcaggcctggtggtgacaaaaatcccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacctgacctttctctctggctgcccttaacattttttccttcatttcaactttggtgaatctgacaattatgtgtcttggagttgctcttctcaaggagtatctttgtggcgttctctgtatttcctgaatctgaacgttggcctgccttgctagattggggaagttctcctggataatatcctgcagagtgttttccaacttggttccattctccccatcactttcaggtacaccaaatcagacgtagattttggtcttttcacatagtcccatatttcttggaggctttgctcatttctttttattcttttttctctaaacttcccttctcgcttcatttcattcatttcatcttccatcgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgactttggtttgaatgtcctcccgtagctcagagtaatttgatcgtctgaagccttcttctctcagctcgtcaaagtcattctccatccaggtttgttccgttgctggtgaggaactgcgttcctttggaggaggagaggcgctctgctttttagagtttccagtttttctgttgtgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctgggggggtgcctcccagttaggctgcttgggggtcaggggtcagggacccacttgaggaggcagtctgcctgttctcagatctccagctgcatgctgggataaccactgctctcttcaaagctgtcagacagggacatttaagtctgcagaggttactgctgtctttttgtttgtctgtgccctgcccccagaggtggagcctacagagacaggcaggcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaatctgtgagactccgtgggcgtaggaccctccgagccaggtgcaggatataatctcgtggtgtgccgttttttaagcccgttggaaaagcgcagtatttgggtgggagtgacctgattttccaggtgccgtccgtcacccctttctttgactcaggaagggaactccctgaccccttgcgcttcccaagtgaggcaatgcctcgccctgccttggctcgcacacggtgtgcgcacccactgacctgcgcccactgtctggcactccctagtgagatgaacccggtacctcagatggaaatgcagaaatcacccgtcttctgtgtcgctcacgctgggagctgtagaccggagctgttcctattcggccatcttggctcccagcgggattcttaatattcatattcaaaccctatattctaaaccttcttgtaaaatttatctcttcttgcctagaagctattaaactccaaatggtgctgcagatggaaccacacatggacatgcctttcttccaagaacctttagatcaactccagaaggagccttagctgctgttccccacatgatgcccctcttcagcaggaagtagccagaaagagttgtcctccaatacccctaccagctgtagtgtttccactcctcaggggggaaatatgatacagggggtagaaagaaattattaaggcagatagtgagggtaaaagagtcctcagcagagcttcccttttaacaaaacgcagtacaagaaattatttttttccagccaggcacggtagcttatgcctgtaatcgcagcactttgggaggctgaggcaggcagatcatttgaggtcaggagtttgagaccagcctgggctaacatggtgaaaccccatctttactaaaaatacaaaaattagctaggtgtgttggggcacacctgtaattccagctactcagggggctgaggcaggagaatcacttgaacccactgcactccatcctgggtgacaaagcattactctgtctcaaaaaaaaaattatttttttccaacaaagagaagcctgaaaaatcaagctgcaaacatagataagcgagctggaatcttgcacaggggaatgtcagcagctgtgtcaatagaaaagggctacctgtgggccaggcatgtccaacatagaggctccatcttccctttttttgtttgttaccacatgtacagtaaaggaatgggcagtgtggcacaggccaggcagaggacccacctgcataataaaatttggttaggggtgaccagcttttcataccctatgcaaatggcacagctattcctaaccagtttttagtgtctatgcacacctggtctaatcaatcttttgcaccctatgtaaatcagaaactgcctcctcaccaggcacctataaaaacccctgcatttcactgcagatccagcaacttatttctctaggacccctctctctagcagggagctattctttctttcacctattaaacttacgctctcttaaactcactctttgtgtgtccatatcctttatttccttggccatgagacaatgaaccttaggtatcaccctagacaacagggctgcttcaataccagaatctctgggacacagctaaggtagtgttaagagggaaatttatagcattaaatacccacatcaaaaagttagaaagatctcaaattaacaacctaatatcacaactagagaaactaaagaaacaagaggaaaccaaccccaaagcaagcaaaaaacaagaaataaccaaaatcacagctgaactgaagaaaatttagatgcaaaaaactattcaaaagatccacagcctggatatggtggctaatgcctgtaatcccagcaatttgggaggctgaggtgggatggtttcttgagctcaggagtttgagaccagcctgggcaacacagtgagaccttgtctctacaaaatatcaaaaaattagctgggtatgatgaagtgcacctatagttccagctacttgggaggctgaggtgggaggattgcttgagtatgggaggttgaggctgctgtgaactgagatcacgcaactgcgctccagcctgggtgacagagtgagaccctgtctcaaagaagagaaaaaagatcaacaaatacaggagttgtttttttgaaaaagttaatgagatagagactgctagctagattaataaaagaaagacagaagatacaaataaaaacaattagatatgacaaaggggatgttaccactgaccccacagaattacaaaaaacatcagagactactacgaacatacgaggtataaaacctagaagaaatggataaatccatggacacatacaaccacccaagactgaaccaggaagaaactgaatccctgaatagaccaataacaagttctgaaactgaatcagtaataaaaagcctgccaaccaaaaaaagcccaggacaagacagagtcatagccaaattctatcaggtgtataaagaactggtaccattcctattgaaactattccaaaaattgaggaaggactcctccctaactcattctttgaggccagcatcatcctgataccaaaacccaccagagacacaacaacaacaacaaaatttcaggccaatatccttgatgaacatagatgcaaaaatcctcaaaaaaatactggcaaatcaaatccagcagcacatcaaaaagtttatccaccatgatcaagtaggctttattcctgggatgcaaggttggttcaacatatgcaaatcaataaatgtgatttatcacataaacagaactaaaaacaaaaaccacatgatcatcttaataaatgcagaaaatgcttttgataaaattcaacatcattcatgtttaaacctctcaataaactaggcatttaaggaataaaccttaaaataataagagccatctatgagaaacccattgccaacatcatgctgaatgggcaaaagctggaagcattccccttgagaactggaacaagacaggatgcccactctcaccactcctatttgatatagcactgcaagtcctagccagagcaatcaggcaggagaaagaaatgagaggcctccacataggaagagaggaagtcagactatctctgtttgcaaacaatgtgattctacacctaggaaacgccatagtctctgcccaaaagctcctagatctgataaacaacttcagcaaagtttcaggatacaaaatcaatgtacaaaattcaatagcatttttatacaccaacaacctccaaactgaaagccaaatcaagaacacaatcctgtccacaatagccacaaaaagaataacatacctaggaatacagctacgaggaaggtgaaagagctctacaacaagagttataaaacacggcttaaaaaaaaaaatcagaaatgacacaaacaaatggaaaaacattccatgcccgtgataggaggaatcaatactgttaaactggccatattgcccaaagcaatttatagattcaatgctattcctatcaaactaccaatgccattcttcaccaaattagaaaaaagtatttaaaaatttataaataacctttaaaaaaagcctgaatagccaaggaagtcctaagcaaaaagaacagagctggaggcattatgttacccaacttaaaactatactacaaggctacagtaaccaaaacagcatggtactggcacaagaacagatacataggccaatggaacaggttagagaggccagaaataatgccacacgcctacaaccatctgatctttgacaaagttgatgaacataaacaacaggaaaagattccctattcaatcaatgatgctgagataactggccagccatatgcagaagattgaaactgaaccccttccttacaccatctacaaaaacaaactcaggatgcattaaagacttaaatgtaaaacctaaaattataaaaattctggaagatagatagcctaggaaatacacttctggacataggactgggcaaagagtccatgacaaagatgcctaaagcaaatgtgacagaaacagtaattgacaaatgagacccaattaaactaaagggcttttgcctagcaaaggaaactatcaacagagtaaacagataaagtatagaatcagagaaaatattttcaaactatgtaaccaacaaaggtctactatccagaatctataaggtacttaaatttataagcaaaaaaccaccccattaaaaagtaggcaaacgacatgaacagatacttttcaaaagaagacatagtggggtggagccaagatggccaaataggaacagctccagtctacagctcccagcatgagcgacgcagaacacaggtgatttctgcatttccaactgaggtacggggttcatctcactggggagtgtcggaaagtgggtgcaggacagtgggtgcagcgcaccgagtgtgagccaaagcagggcgaggcattgcctcacccaggtagcgcaaggggtcagggaattccctttcctactcaaagaaaggggtgacagacggcacctggaaaatcgggtcactcccaccctaatactgcgcttttccaacagtcttagcaaacggcacaccaagagattatatcccgcacctggcttggaggatcctaggcccaaggagcctcactcattgctagcacagcagtctgatatcaaactgcaatggggcagtgagtctgggggaggggcacccgccattgccgaggcttgagtaggtaaacaaggcagccaggaagctcgaactgggtagagcccgccgcaactcaaggaggcctgcctgcctctgtagactccacctctgagggcaggacattgccaaacaaaaggcagcagaatcctccgcagacttaaatgtccgtgtctgacagctttgaagagagtggtggttctcccagcatgcagctggagatctgagaatggacagactgcctcctcaagtgggtccctgacccccgagtagcctaactgggaggcaccccccagtaggggcagactgacacctcacatggccaggtactcctcagagacaaaacttccagaggaacgatcaagcagcaacatctgctgttcaccaatatctgctgttctgcagcctccaccgctgatacccaggcaaacagggtctagagtggacctccagcaaactccaacagacctgcagcttagggtcctgactgttagaaggaaaactaacagaaaggacatccacatcaaaaccccatctgtacgtcaccatcatcaaaggccaaaggtagataaaaccacaaagatggggaaaaaacagagcagaaaaactggaaactctaaaaatcagaatgcctctcctcctccaaaggaatgcagctcctcaccagcaacggaacaaagctggatggagaatgactttgacgagttgagagaagaaggcttcggacgatcgaactactccaagctaaaggaggaagttcgaacccatggcaaagaagttaaaaaccttgaaaaagaattagacgaatgactaactagaataaccaatgcagagaagtccttaaaggacctgatggagctgaaaaccatggcacgagaactacgtgatgaatgcacaagcctatttgatcaactggaagaaagggtatcagtgatggaagatcaaatgaatgaaatgaagcgagaagagaaactgagagaaaaaagaataaaaagaaacaaagcctccaagaaatatgggactatgtgaaaagaccaaatctacgtctgattggtgtacctgaaagttacggggagaatggaacaagttggaaaacactctgcaggatattatccaggagaacttccccaacctagcaaggcaggccaacattcaaattcaggaaatacacagaacgccacaaagatactcctcgagaagagcaactccaagatacataattgtcagattcaccaaagttgaaatgaaggaaaaaatgttaggggcagccagagagaaaggtcgggttaccctcaaagggaagcccatcagactaacagctgatctcttgacagaaactctacaagccagaagagagtgggggccaatattcaacattcttaaagaaaagaattttcaacccagaatttcatatccagccaaactaagcttcctaagtgaaggagaaataaaatcctttacagacaagcaaatgctgagagattttgtcaccaccaggcctgcctaaaagagctcctgaaggaagcactaaacatggaaaggaacaaccagtaccagccactgcaaaaacatgccaaattgtaaagactatcgaggctaggaagaaactgcatcaactaacgagcaaaataaccagctaacatcataatgacaggatcaaattcacacataacaatattaaccttaagtgtcaatgggctaaatgctccaattaaaagacacagactggcaaattcgataaagagtcaagaaccatcagtgtgctgtgttcaggaaatccatctcatgtgcagagacacacataggctcaaaataaagggatggaggaagatctaccaagcaagtggaaaacaaaaaaaggcaggggttgcaattctagtctctgataaaacagactttaaaccaacaaagatcaaaggagacgaaggccattacataatggtaaagggatcaattcaacaagaagagctaactatcctaaatatatatgcacccaatacaggagcacccagattcataaagcaagtgcttagagacctacaaagagacttagactcccacacaataataatgggagactttaacaccccactgtcaacattaaacagatcaatgagacagaaagttaacaaggatatccaggaattgaacttagctctgcaccaagcagacctaatagacatctacagaactctccaccccaaatcaacagaatatacattcttctcagcatcacaccacacttatttcaaaattgaccacacagttggaagtaaagcactcatcagcaaatgtaaaagaacagaaattataacaaactgtctctcagaccacagtgcagtcaaactagaactcaggattaagaaactcactcaaacccgctcaactacatggaaactgaacaacctgctcctgaatgactactgggtacacaacgaaatgaaggcagaaataaagatgttctttaaaaccaatgagaacaaagacacaacataccagaatccctgggacacattcaaagcagtgtgtagagggaaatttatagcactaaatgcccacaagagaaagcaggaaatatctaaaattgacaccctaacatcacaattaaaagaactagagaagcaagagcaaacacattcaaaagctagcagaaggcaagaaataactaagatcagagcagaactgaaggaaatagagacacaaaaaacccttcaaaaaaatcaatgaatccaggagctggtgttttgaaaagatcaacaaaattgatagaccgctagcaagactaataaagaagaaaagagagaagaatcaaatagatgcaataaaaagtgataaaggggatatcaccactgatcccacagaaatacaaactaccatcagagaatactataaacacctctatgcaaataaactagaaaatctagaagaaatggataaattcctcaacacatacaccctcccaaggctaaaccaggaagaagttgaatctctgaatagaccaataacaggagctgaaattgagacaataattaatagcttaccaaccaaaaaacgtccaggaccagatggattcacagctgaattctactagaggtacaaggaggagctggtaccattccttctgaaactattccaatcaatagaaaaagagggaatcctccctaattcattttatgaggccagcatcatcctgataccaaagcctggcagagacacaacaaaaaaagagtattttagaccaatatccctgatgaacattgatgcaaaaatcctcaataaaatactggcaaaccgaatccagcagcacatcaaaaagcttatccaccacgatgaagtgggcttcatccctgggatgcaaggctggttcaacatatgcaaatcaataaacataatccaacatataaacagaaccaatgacaaaaaccatatgattatctcaatagatgcagaaaaggcctttgacaaaattcaacagcccttcatgctaaaaactctcaataaattaggtattgattggacatatctgaaaatagtaagagctatttatgacaaacccacagccaatatcatactgaatgggcagaaactggaagcatcccctttgaaaactggcacaagacagggaagccctctctcaccactcctattcaacatagtgttggaagttctggccagggcaatcaggcaggagaaggaaataaagggtattcaatcaagaaaagaggaagtcaaattgtccctgtttgcagatgacatgactgtgtatctagaaaaccccattgtctcagcccaaaatctccttaagctgataggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagcaatgtgaaggacctcttcaaggagaactacaaaccactgctcaatgaaataaaagaggatacaaacaaatggaagaaccttccatgctcatggataggaagaatcagtattatgaaaatggccatactgcccaaggtaatttatagattcaatgccatctgcatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactgtactacaaggctacagtaaccaaaacagcatggtaccggtaccaaaacagagatatagaccaatggaacagaacagagccctcagaaataacgctgcatatctacaaccatctgatctttgacaaacctgacaaaaacaagaaatggggaaatgattccctatttaataagtggtgccgggaaaactgcctagccatatgtagaaagctgaaactggatcccgtccttaccccttatacaaaaattaattcaagatggattaaagacttaaatgttagacctaaaaccataaaagccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaataaactaccatcagagtgaacaggcaacctacagaatgggagaacatttttgcaatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccgttgtggaagtcagtgtggcaattcctcagggatctagaactagaaataccatttgacccagaaatcccattactgggtatatacccaaaggattataagtcatgctgctgtaaagacacatgcacatgtatgtttattgtggcactattcacaatagcaaagacttggaaccaacccaaatgtccaacaatgacagactggattaagaaaatgtgccacatatacaccatggaatactatgcagccataaaaaatgatgagttcatgtcctttgtagggacatgtatgaagctggaaatcatcattctcagcaaactatctcaaggacagaaaaccaaacactgcatgttctcactcataggtgggaattgaacaatgagaacacatggacacaggaagggaacatcacacactggggcctgttgtggggtgggggagggggagggatagcatttggagttatacctaacattaaatgatgagctgctgggtgcagcacaccaacatggcacatgtatatatatgtaactaacctgcacgttgtgcacatgtaccctaaaacttgaagtataataaaaaataaaaataaataaaaaaataaagacttcaaaagaaaaaaaaaaggagacatacatcctgccaataagcatatgaaaaaatgctcaacatcactaatcattagaaaaatgcaaatcaaaaccataatgagatattaatatcatgtacgccagtcagaattactattatgaaaatgtcaaaaaaacaacagatgctgtcaaagttgtggagtaaagggaaggcttatacactgctggtggaaatataaattagttcagccattgtggaaagcagttttgcaacttctgaaagaacttaaaaacagaattactattggatccagcaataccactattgggtatatacccaaagggatataaatcaatctattacaaagatatatgcacatgtatgttcaccgcagcactattcacaataacaaagacatggaatcaacctaaataccaatcaatggtagactggatgaagaaaatgtacatattttggtgtgatacatatacaccatggaatactatgtagccataaaaaaagaatgaaatcatgtcctttgcagaaacacagatgagctggagaccattatcctaagaaaattaacacaggaatagaaaaccaagtactgaatgttctcacttgtaagtgggagctaaacatcaagtacatattaacacaaagaaaagaaaaacaggcaccaggatctacttgagggtagagggtgggtaaagggtgaggactgaagaactacctgtccagtactattcttattacctgggtgatgagataatctgtacatcaaaccccccatgacatgcaatttacctatataatgaacttgtacatgtaccccatgttagtccgttctcacattgctataagaactgcctgagactgagtaatttataaagaaaattgactcacagttctgtatggcttaggaggcctcaggaaacttacaatcatggcagaaagcgagggggaggcaggcaccttcttcacaaggtggcaggtgagagaatgaatgaagaagaaacttgccaaacacttaacataactatcagatctaatgagaactcactatcatgagaacaacatggggagaactgccaccatgatccaatgacttcccactgggtggggattatggggattacaattaattcaagatgagatttgagtggagacacagccaaaccatatcaacccttgaacccaaaataaaagattaaaaaatcaagattttctcttaaaaatgtcatctatactattatagataaaattaacataggtagtaataaaagaagatataaaactgtccagggatatgaaataccaattcatagaagtagaaaaccaaatagctaagtaaatggagaatgcttaacactgaccgcagacagaaaagtgcacattaaaacaaatatcagtaaccaaagagggcagagcaagatggcagaatagaagcctacaccatttgtccccccgtcccctaaacaccaaattttaacagttatctacacactgaatagcactatcacaagaacaaaaacgcaggtgagcaattacagtaactggttttaacttcacatcactgaaagaggtattgaggagggcaggagagacagtcttaaatcatcaatgccactcctcctccatcccctggcagaagccatgtggtgcagagacagaatctgtgcattttgcggatggagagcacagcaaccgagggaccttacattgaactccgtgctgccctgtcacagcagagaataaagccatgctgggctcagctggtgctggtgcacagaggcagaatttggactagcccctagccagaggggaatcacccatctcagctgttggaactgaagtttcttggccagccttgccaccattggctgaagtgcaatggagttctagataaacttgaaaggcaatctaggacacaagagctgtaattcttaggcaactcctagtgttaggctgggcttagagtcagtgaactagggtggcacatgacctagagagacaccagctggcgcagctaagggagtgcttgtgccacccctcccctaaccccaggcagtgcagttcacagcaagaaaagtgtctccttccttctacttaaggagaggagagctagtaaagaagatttcgtcttgtatcttggataccagcttaggcacaggatagggcactgggaagacttgtgaggcctcattccaggccctagttcttaaacatttctaaacacactcttggccaaaagggaaaactgctttcaagggaaggactcagtcctggcaggattcatcacatggcccttgataaccctagctccctgacaacatttctaaacacaccctgggccaaaagggaacctgctgctttgaagggaaggacctagtactggcaagattcatcccctgttgactaaagagcccttcggccctgaataaccagcagcaatactgagggagtacactatgggccttaaggcctgagatgtcctggcttcaggggtgatggagcacatttccagatgtagtggctatggtgaaagactcaaacagaagtttgagaaaagcagagggaaaagtaaaagagagtttgtcttgcaccattggcactggctcggccacagtaaggtaaagcaacaagcagcctcttaaggtctctgagtccagacctaggttcctggacagcatttctgggcccactctgggcaagagaggagttcactgctctgaagggtgagtcccaggcctggtagcatttaccacaacctgtgggaagatcccttgggctttaagcaaatattgtcagtggcctggcagaaacccccatgaactggtggtggtagccacagagaggctcctctgcctgtggaaaggggagggaagcgtgggaaggactttgtactatggtttgagtgccagcttagctgcagtagaatagaatatcgtgtaaattgctaaggtgcttgactccactcgctggctcccagacagcatctctggacacacccagggcctggggaaacttgccaacctgaagggaagggcactgggcaaagcccagtgctgtgttggcttcgggtctgacacagcaccagtggtgggggccacaggggtgcttgcatcaccgcaccctcagtttcagatggcttggaaaagagagagattccatatgtttggcagaaagtaagggaaaagaacaagagtctccgcctggtaatccagagaattcttccagatcttacctaagacaaccaagatggtgcatgtacaagtttgcaaaaatcacagcattattgggcttggggtccaagtcccttcaaatacctggaaagccttcccaagaaggacaagcacaaataagcccagattatgatgactacagtaaatcaccagagacatttaagagtgtcaacatgatccaggaaaacatgacctcaccaaatgaactaaataaggcaccagggaccaatcctggagaaacagagatgtatgacctttcagacagagaattcaaaacagctattttgaggaaactcaaagaaattcaagataacacaaagaaggaattcagaattctatcagataaatttaacaaacagatcgaaataattaaaaagaatcaagcagaaattctagagctgaaaaatgtaattgatatactaaagaatgcatcagtctcttgagagcagaaaggatcaagcagaagaattagtgagctcaacagactatttgaaaataccagagaagacaaaagaaaaaagaataaaaaaacagtgaagtatgcctaccagatccagaaaatagccttaaaaagcacaaatctaatggccttaaagaggaggtagaacatgagatagggatagaaagtttattcaaatggataatatcagagaacttcccaaacctagagaaagataccaacattcaagcataagaaagttatagaacaccaagtagatttaagcctaagaagcctacttcaaggcatttaatcaaattcccaaaggtcaaggatcctaaaagcagtaagagataagaaacaacatacaatggagcaccaatatatctggcaggaggcttttcagtggaaaccttacaggccaggagagagtggcatgacatatttaaactgctaaaaaaaaaaaaaaaagaaaaaaaaaaactttaaccccagaatagtagatccagtgaaaatattctttaagcatgaaggagaaataaaaacctttccagacaaacaaaagctgagggatttcattaacacaagatatgtcctacaagaaatgcaaaaggaagttcttcagtctcaataaaggatgttaatgagcaagaagaaatcatctgaaggtccaaaactcactggtaatactaagcacacagaaaaacacaaaatagcataattctgtagtggtcatgtgtaaacttctcttgacttaagtagaaaggctaaatgatgaaccaataaaaaataataattacaacaacttttcaagacatagtataataagacataaatagaaacaacaaaaagttagtaagttgggggacaaagttaaagtgttgagtttttgttagttttcttttgacatgtttgtttgtgcaatcagtgttaagttgtcatcagtttaaaataacgggttataagatagtatttgcaagccttatggcaacctcaaatcaaaaaatatacgatggatacacaaaaaataaaatgcaagaaattaaaacatattaccagagaaaatcaccttcagtaaaaggaagacaagagggaaagaaggaagagaagaccataaaacaacaagaaaatacaacaaaatggcaggagtaagtccctgcttaatagtaacattaaatgtaaataactaaactctccaataaagacaaggtagctaaatggatgtaaaaacaagacccagtaatttgctgcctacaagaaacacacctcatctaaaaagatacacatagactaaaaataaagggatggaaaaagatattccatgcaagtggaaaccaaaaaggggaaggaatagctatacttatatcagacaaaatagatttcaagacaaaaactttaagaagataattaaaaaaacaaagaagataattatataatgataaaggggtcaattcagcaagaagatatactgattacaaatatatatgcacccaccactggagcacccagatatataaagcaagtattattggagatagaatccaacacagtaatagctggagacttcaacaccccactttcagcattggacagatctcccagacagaaaatcaacaaagaaacactggacttaatctgcatcatagaaaaaatggacttaacagatatttacagaacatttcatccagtggcttcagaatacacatttttatcctcagcacatggatcattttcaagtatagaccatatgttaggtcacaaaacaagtcttaaaacatttttaaaaaatcttgaaataatatcaaacatcttctctgaccataatggaataaaattagaaatcaatgataagaggaattttggaaactatacaaacacatagaaattaaacaatatgctactaaatgacccatggatcaatgaagaaattaagatggaaattttaaaattttcttgaaacaaatgataatggacacaacataccaaaacatataagatacagcaaaaacagtactaataggaaaatttatagctccaagtgcctacataaaaaactagaaaaacttcaaataaataacctaatgatgcatcttaaagaactagagaagcaagagcaaaccaaacccaaaagtagtagaagaaaagagataataaatatctgagcacaaataaatgaatttgaaatgaggcaaacactacacaagaccaatgaaacaaaaagttggttttttgaaaagataaacaaaattcagtaacctttagttaggctaagaaaaaaacagaagacccaaataaataaaatcagagataaaaaaggagatattacagctgttactgaagaaattcagaggatcataagtggctactatgaacaactatatgccaataaattggaaaatctagaagaaatggataaattctagacatatacaatctaccaagattgaactatgaggaaattcaaaacctaaacagaccattaacaagtaacgtgattgaaaccataataaaaagtctcccagtaaagaaaagcctgagacatcatggcttcactgctgaattctaccaaacatttaaagaactaataccaatcctattcaaactgttcggaaagataaaggaggagggaatacttccaaactcattctatgaggccagcattaccctgataccaaaaccagacaaacacacattaaaaaaaataataatactgaccagcctggccatcatggtgaaaccctgtctctactaaaaatacaaaaaattagccaggcgtggtggcagacacctgtaatcccagctatttggcaggctgaggcaggagaatctcttgaacccaggaggcggaggttgcagtgagccgagaaaccgccactgcactccagcctgggcaataaaagcgaaactctgtctcaaaaaaatcaataaaataaataaataaaataataataataatacaggccaatatatctgatgaatattgatgcagaaatcctcaacaaaatactagcaaaacaaattcaacagtatattaagaagatcattcatcggccaggcgcagtggctcatgcctgtaatcccagcactttgggaggccaaggtgggcggatcacctgaggtcgggagttcaagaccagcctgatcaacatggagaaaccccatgtctactgaaaatacaaaattagccaggcatggtggcatatgcctgtaatcccagctacttgggaggctgaggcaggagaatcacttgaacctgggaggtggaggctgcggtgagccaagatcgtgccattgcactccagccttggcaacaagagtgaaactccatctcaagaaaaaaaaaaaatcattaattatggccaagtgggatttatcccagggatgcaaggatgtttcaacacacacaaatcaatcaatgtgatacatcacatcaacagaatgaaggactaaaaccatatgatcatttcaattgatgctgaaaaagcatttgatatagttcaacatcccttcataataaaaaccctcaaaaaactaggtatagaagaaccacacctcaacatattaaaagctatatatgacagacacatagttagtatcgtactaaatggggaaaaactgaaagcctttcctcttatatgtggaacatgacaaggatacccacttttaccaccattattcaactgattactggaagtcttagctacagcaatcaaagagaaagaaataaaggggatccaaaccggaagggaggaagttgaattatccctgtttgcagatgatatgatcttatattggaaaaacctaaagactccaccaaaaaatgattagaactgataagcagattcagtaaagtttcaggactcgaagtcaacatacaaaattggtagcatttctatatgccaacagtgaacaatctgaaaaagaaataaaaaaggaatcccatttacaatagccaccaataaaatacctaggaattaaccaaagaagtaaaagatctctacaataaaaactataaaacaccaatgaaagaaattgaaaaggacacataaaaatggaaagatatcccatgttcatggattggaggaatcaatattgttaaaatgtccacagtactgaaagcattctagagattcaatacaatccctacaaaataccaatgacattcttcacagaaatagaaaaaaactatcttaaaatttatatggaaccacaaaagacccagaatggccaaatctatcctgagcaaaaagaacaaaactagaggaatcacattacctgacttcaaattatactataaagctacagtaaccaaaacagtatggtactggcataaaaatggacacacagaccaatggaacagaatagagaacctagaaataaatccacacacctacagtaaaccgattttcgacaagggtgccaagaacacacattggggaaaagacagtctcttcaataaatggttctgggataagaggatatccatatgcagaagaattaaacttgactccatctcttgccttttatttgaattaaatataagacctcaaactgtgaaacacctacaagaaaacattgaggaaactttccaggacactggtctgggcaaaattttcttgagtagtaatatctcacaagcacaggcaaccaaagcaaaaatagacaaatgggatcacatcaagttaaaaagcttctgtacaacaaaggaaataatcaacaaagagacaacccacagaatgggagaaaacatgtgcaaactacccatctgacaagggattaataatcagaatatataaggagctcaaacaactccacagggaaaaatctaataatctgactaaaaaatgggcaaaagatctgaataaacatttttcaaaagaagtcattcaaatggaaaacagcatatcaaaaggttcttaacatcactgaccatcagagaaatgcaaatcaaaactacaatgagatatcatctcaccctagttaaaatggctgttatccaaaagtcaggcaataacaaatgctggtgaggatgtggagaaaagggaaccctcatacactgttgctgggaatgtaaattagcacaaccactatgaagaacagtttggaagttcctcacaaaactaaaaatacagctaccatatgatccagcaatcccaatgctgagtatatacccaaaagaagggaaatcggtatatcagagagatatctgcactcttatgtttgttgcagcagtgttcacaatagccaagatttggaagcaacctacgcatccatcaacagatgaatggataaagaaaatgtggtacatatatacaatggagtactattcggccattaaaaagaatgagattctatcatttgcaagaacgtggatggaactggaggtccctatgttaagtgaaataagccaggcacagaaggacaaaaattgcatattctcacttatttgtgggatctgaaaatcaaaacaattgaactcatggacacagagagtagaaagatggttaccagaggctgggaaggatagtgggggcctgggggagaggtggggatggttaattgatacaaaaaaaatagaatgaataagacctagtatttggtagcacaacagggggactatagtcaataatactttaatttaattgtacatttaaaaataactaaaagagtatattacatgcctataccaaaatatctcatgtgccccataaatatgtacatctactatgtacccacaaaaattataaattaaaaagtttttaaagataaatatcactttacacctacccagaataataaaacttagaaaaactataaagtaagataataccaagtattgataaggacataggaagacaagaacccttatgtactacttgtgtgagtgtacactgaagcaactattttgaagaacaatcaggtggcaatttttaaaactacatatacatatactctgtcatccatcaatcccacttctgggtaaatactccaggaaaaccctggcacagtggtatatgcaaaagatgttcacaaggttgttcattgtagcaccatttgtagtaagagagttataagcaacctaagtgttcatcagtaagggaagagatgtgtgaaatgtgtttagagcatatattgtagaatactctgcattagttaaaagtcagtaactaggctgggcgcggtggctcacgcctgtaatcccaacactttgggaggctgaggcaggcagatcatgaggtcaggagatcgagaccatcctggctaacatgatgaaaccctgtctccactaaaaatacaaaaaattagccgggcatggtggcgggcgcttgtagtcccaggaactcaagaggctgaggcaggagaatggcgagaacccaggaggcagagcttgcagtgagcggagatcgcaccattgcactccagcctgggcaacagcgtgagactccgtctcaaaaaaataaaataaaaagccaataactagatggacatatggcaagaaggaaaggtcttaaaaacaatgttgactgaaaaaatcaagtaacagaaagagctcaagaccatattaccattatgtaaattacaaacacattacacacaaaataatatatattttacaaagataaatacatatatgcaggaaaatatatccaagataaaagtagacatttatatgaaaacaggaaatgggagtaggaattaaggatgaaagaaaaaaaataagagggtaagaagaactttgaagagattaaaaattatactgtattaggacctgagttgtattgtaaacagaagtctctgctcctaagttatacatatgtacacatgataaagaacctaagaatgaggttcaatctttcagtctaaagaatcattggtatataattttaaaaattaaaaccaatctaaattattgttagagtttattacattatgggaagtgatgggagtagggtggcatagatagatgcatattaaaattttcttattaaaaaagaagacatgtatttggttgattctaggtgttgatagacaaaagtgagttttaaaatgtgaattaaaagttttagggtaatagccaggtgcagtggtcccagctacttgggaggctgaggcaggaggatcacttgagccccagagttcaacaatacagtttgagcacgatcgtgtaaccgcacttcagcctggggtgatagggtgagactctgtctctaaaaagaaaaaaaaaaaagttttagggtaaccattagagatacagacatgagatttcttgctttaaacaattagtgaaaagattggaattgaaagaaaacttagtgctcacaagaagaaaaaaaagaaaaagcataggtaaatagaaaacacactaatggtagaaataaggtgaaatgtatcaataatcaccatgtgagttaaattcttctatgaaaaaagactcattaagaatcatataagcaaaaatatgcagtactatattgtttttaagatatcctaaaataaatattcatatcaaacaaaatagaggcccaagtcaaaaccaaaattatttatctacctgggatattttacaacgattaaaatacacaacctaccaagataaaagtcacaaacctaataacagagaaccaaaccaacttcacagtaaaaaaaaaaaaaaaaaaagccagaaatgcaaggagatactgacaaatctacaacagtggggacagactttaatatacctatttccaaagttaacaaaccaagcagacagaaaattattttagggagaatctgaataacataattgtgccctttattaagttgttactattattatttgtagagacagggtctcactctgctgccaggctggagagcagtggcgtgatcatagctcactacaggctcaagggatcctcctgcctcagcccccagtagccaggactataggtgcatgccatcacacccagctaattttttaattttttatagagatagggtctcgttctgtcatccaggccagagggcagtggcatgatcatagctcactgcatgcctgaaactcctggcctcaaacaattctccagccttggcctcccaaaataactgccactgtgcccggccagttattagtattatttttaactttgaaatccatctttctttattctgctttagaatgctggagctgaggctctcaaaaccgtatttctgctttgaccgctggtttcctgttagactctgacaatatgggtggtgctaaagggagactgcaaagctggaagaggaaaaaggggcttatctcttcctatctgcttcccatgggtttcctaactgcttgtgcttcctgtgaatgccactggaataatgtggtttttgatttgttttgtttttgctgtagtctagcaagtctttccccagcagtagctgaatctagtttgcagtttttccaacttttataaactagcttcactgtgactcctccacaggcaccagcaccagctggccagtatcctcagagatctgggtctcagctacatgaagcccatcatagctcggagacaccagcagccaagcagcaccgcttccccagaggtctaaatttcaggtgtcaggagcacctcttccaagcttctaaagttgcataatttcaacctcattctacaaagaaaactccaggctcaggtggtctcatggtgaattcttccaaaatttaaggataaaataataatagtatataaactttcctaggaaacagaaataaaacttccaaaacacattttatcaggcaagcataaccttgattataaatcctaacaagaatactgtaacaaaagaaatcaatacaccaacacatctcccaaacatagatgcaaacatccttgacaaagaatcagcaaattcaattcgtgatattcaccatgaccaagtgagactttcagaataaactctcagaagtgtatttccaccatgagggtagaatttctgggacaaggggtgtcactcacctgtccggtcaacatcctttttcatgggcagtacagtataatccagttgctcatctgagtcctcaagcatccttggcttggactgcagcatgaattggggctctttatggggacttcccctgcctccattccagtctactgactcgtcatagagctgaacttgctgtaggtatgggatcctgataatcctgttttcatccaagcttaacttcttcagtcttcaattaaggaaagtgaatatagaatcatagcaataatgatacctcaggattgtttaccaagcaactttagggaaaaaacatggaatcaggcttggatacttattcctcttgtgtgacgttgagccggtgacttactctctctgggattcaatatccctgtctctaaaatggggataatatttattaacctttcagggttcttgtgaagatttaatgaggcaatatgtaaatggcctggcacaaagtagtattcagtaaatggtagttgaaaccaaagtaaattttccagagaagtaaagcttaacaatgtaaatgccactattttctttacttcagttagaattcaggaattaaatttctctttctgattctcaatattttaaaaaattttcctgtctctactgtcagggtccgaatcctatcttgggtaaaatctcctcctgttttcctttctctttgctgcttctaattcagtcatgtgatcagaaatgtcctcactcatggccatttttatggaggagccaaagctcagaggggagaaatgacttacccatggccacacagtagagataaattgtggagctaggctttaaacccaaaccttttggcttccagaacagcactcagagtgtgagcaagcctggggattagaggaggcccagcagagaaaggcttatggctttacctcctgagcccagccaggctggcaaagcaactggggttggagagtctgttgtcatccagcatcagtgtctccagcgctgggaacctcaggatgtacctcttgcttgtcagcgatgttacagatgcctccctgtgagtgcaaagatcttgggtaatgagcaaggtcgagggacaaattccaccattcccaggaagccatggaggacagggaatcaattaggaggactaaccagcttaggaacggttctagtgcccaaaagaggtccccatagggatgcacagaaagtataattccttccccaccttctcctttcccaaacactattatacataccatattgtcttctgtatggagaaaggttacacacatcattgaaaccaggttagggcaggatgggggattgtataggtagtgcttatagaaaatgccaggtgaaagaggcatgaccaagctggagggagcattctgcagatcactgcacaattttgactcaggaagactccttgttatgctgtgtcacctagtagactggtaactgggagcaccaggagacaatgcccttgttatagaccacagctttgccacctagtagggtaaagtagggtgggttgagggcaccacccctggctgcagtgaggctctcttctcaagtggcttcataaaatgaacacatgagtaaggagtggagaagtttctccttaaactcaaactctctgaagattcccagaaatacctaagagtgagatttatgggggtgatgccctgaattacaggggtgggcaggaagtggtggcattttaagtaccgccattaatgtgacctcacttgtgtcctccaggtagatgagacctaggtaactctcttccacacaggcagatgacacaaataacgttttcattcttccctccatactgtatgccacccacacaccaaaatagtacacataggcacaaatgcatatagtatacacatatataagccacaaacacacacacaactagaggaagggaaacaaacatttctttagcacctaatgcatttctggcattgtgcgatatgttttgtatgtgttatccaaggataggtattatttatctcctttacagattaacaaaatgaagctcagagcaacttgcctgaagtcgcatagctagaaagtgggatgactcaaactagaacctgggtctgcctgactccaaatcccatgccctttccactgccaaatcacacctttcacattcacctctactagccccatgtggattaaagggtggggaaatggaagggggagctgatgcctgagctagagagagcttaacaaaggttggcagtgagttcaaaagctaggacagtaatgtatacctgaagtcagggatatttcacaggtgcatttagagagggtatattctaaatgaatgtattactaattaattcgttcattcacactcatgaatttctttaacatatatttatgtggccaggtactgagactacaaataaaagaacacatccctcccctctaggtggagtaggtggacacgcagcctgtggtgagacaaacaccataaaagaagtatgtggggaaggcgcctattcgggaaaggcaatgtttaagcaaaaccatgaggaatggagagggaattgtcatgcttttaaccaatgtgaaaaagagagaacagggaaaaaaataatctcttcgtggctggatctgtaacataattagtagctataggcagccatgtttcccatcatgaggtctagaaagacacaggcagcccacctgtaaagaaaaatgtggcaagtcacagagaggaggaggtgtgaaagctgagagacagaacttccaggctgctccacggtgctcagggtctatgttcagcatgaccctcaggcacggctgtgagattccccaatgttcttacaatcaattcccccctgcctttttttctgtatcctaacactgacagacttctatagattatgacagttctgactggaaaaagggacaggtcagataaactttcagaaagagacctggcagcactgtagagaacaggcttgaagtccaaagaccagagacacttaacagagaaggcaggaagcttttatacttcataatatttcaaggtcatgagtgtgccctttcctctttctggaaggaccaactttcatacattgaatttttaatctctatctgagctattacagaacagtgcacagcagctgtgttgatttataattgattggccaatcttaattttactctagtgaaatatgaaacagctaagaaataagcctttaaaaaattcctcttaagctccataatgcagaagctggctctgtctcgtctcttgtgacaagttacactacttcgtctttttaaagttctaccctaattatagcatgggaaagtttcattttttgtctctaaaatagacatcttaaaatagaggggcagccatcagatgggtgagaagacagatgtctagcttcagaggaaagcagcaggctttcccaccgagcccctcctgtggcagttttggaagaaaagctcttcaaagtggcaaagtctgtcagtagtggagaagccggggtttccagctgttcagagtggtgctatttttattatcacttctcttgccaaacagaattactactacttaaaatctgagagatttaatgaaagtttttcagaagctaagggtatgtgcagtggttggattcagcaatgggaatttgtgtaccatattagaagatgcatgggaagggtggccaggatccctgagctctggctccggtgctgctgctgctttgcttgctgtgtgacttccggctggtgttgagcatctctgggcctagatcctctatctgtatggtaaagggggatttcttttactttacactgtaagactttcgattaggctaaaaatattgctcaaaagactgaaccaagggctgcaacaaacaagatgaaacttagcaagtacttacattacgacaaatgtcagatcagcttctgtgttaagatacagaacaccaactgtgcaaacacacagaataagggagacatggcttaacaaactgtgtgtgtgtaaaaggggattatgatgtggctactaaaaagctagtgctctttcaggtggcgttatttggaatatagtgactaaaagaaaggaggtaacaattcatcctctgctctgtgctggtcgtgcctgagaacgccgacttgtatggtctgaagcagaaagagagtaggcctaatgaaagagccaaagtagcagattccagctcaaaacaagcaatagagtagtctacgtatagaatgggtcaaatatgattcccctaactcacccagacaaaaaaaatagcaagaaatggagacacaaatagttcagaatagatgaggtatatgatgaatggaaaaagtgaagagaaaggaggatggagaagcaggcagagtcaggccatgaaaagctttgagcgatgttaatggagtttatctttaggatagtgggaacctgctaaaggactttaagcagggcagtgatagaatcacatgtgcatttcagaaagatcactctggctgacagataggaggatgggctgggaggcaagaaactgcagactgggaccaaacaggaggataacagcaatgagcaggtttgagaagaatttagaaagtacaattcacagcacctggtgattgaatgtatgtgtggaatgagggaggccaaaatttgggctaatgctcaggttctagcctggacaactacatagtaggtgggaagaagtgccagtcaatgaggccaggaaaggaaagaaaggaggagagagcgagaaggagggcttaatggcatggggatgtgtgtgaggagtttgataagtaggctaaacaggcttataattcagaagacttgcgaagaggaggccaccaataaagagtataaagataaagaaaaatagtaggttaagggtggatgactggggagcaccaacgtttaagaggctagcagaaaaggaacccacagagcatactgaatctagatagatgagtgggaagaaaataatgacaatggtattggtctggagccccacagctttatttttatttttgtagagataaggtctcactacgttgcccaggctggcctcaaactcctgggctcaaacaatcctcctgcctcagcctcccaaagtgctgggattacaagtgtgagtgaccatgcctggccaacccacagctttcaaagcgtgctgatttcaactgctactctgatgcaggtaggaatacatttattctccccctcatatataagaacatgaaagtgcagggtgggggagacttgccttattttatgtaactaggctttccactgaaaacaactagaatgatgaataaaatataaaaagaaaaaagatccatcattttatttattttcttttgtagagatggggtcttgctatggttgcctaggctggacttgaactcctggcctaaaacgatcttcccaccttggcctcccaagtagctggcactacaggcacacaccaccattccccgtggtggtggatccatcattttaatatgtataagagatgtgaagagagaaaggaagcagtatgccaaatctaaaaacccagagggagaaacttaacataggaagccactcaagccttgagggcatatacttatcctgttgaaactgaactatggtttaacagtatcatggggctagagaatcaaagcccagggtaccctgaaggtggggagtttaatcagagaccctttatatgaatttcggatcctaaagggatacaccctcagggtgaaattaaccaaaactaaacctattctccttatcccatagccaggagaaaactgtcttggagtgaacagagaaagacaaggggaagggcagactggtcctcttgcaaaactgtagcccaaatctgtatcatcagagtgattcagaaaacacccagtcaggaatttagcttaagctgattccatcctgagtgactctaggtaccaaaataaatagaaaggtttatagtgttgcaaactaaataatgtgggaccaactcttccctgagtaaaaaactagaaaacccagacaaaatatacatttaaaaacaatctgccttaagatacctgggaactaacaagctgtgaagaattatggcgctaagatttgaaaaaagaaggaaatccaaaggggttcatgcaacacttttcccctaggactgtctgctgactccagaagtggctgagaggctgagaagttgagcagagattctgacaaccctgctgggccaggggcgaaaattggaatccaaggcatgccacagaatagaagcctgactactcatgctctaagttaggtcattagaaaaccaaaccctcggaggacgtatacactagaaatagtatggacgttgcagagactgaagactagcttcaaataatttcaatttttataattgaattaagatgatttgaaattattagtgatgtagatcaccagaaaacccttgatctggtgggcaaaaagtgatttgagttgtccaaagaaagagccatggcctctcattcagttcctatttacatttaacttaaaactaattaagcttaaataaaattgaacattcagttcctgtatcacactagctacatttcaagtgctcaagagctcaatatgcctagtagctacactatgaacaacacagatatagaacatttccaacactgtagtaagttctactgaacagtgctaaattaggccttgtaaggattactagacagtgtctgcaaattggtgctcatctctggggatatgaaaggcatggtggaccatcactcaaaagtgggggatcataaaggtcagatggaagaatgaaaatttagccaaagtctgtttcacaatggacccagtgaagtcacatatctaccctgaacgtgtaactgaaactgacatactaaacaactggcagaacacccacatttatttactgagcaacaaagtatatagcccattatagtaggaagtgtccaattgaaaccccaggaacttttcttcccaatagtaaaccaaaaacaatactgaatccctgaggtaattgcagagattactgccatcactaaagattaaaaagatggaaggataatgattcctatgacatccctgtttaacatctcttgtttagaagattgttatgtattgtgaagaagatatcctttgtttatttagcttgtacagaaaacaggttttgaagaatgattgtagattcctgtaagcttaatcaagaggtgactcccactttcagctgctattccaggtgtggaatctttttactggagcaaatcaaccaagcccctggcactgtggatacagctaaggacctatcaaatgtttctttctctctctttatcaattaataagaactaccaaaagcagtctgctttcacctgacagggacaacagtacacctttttcctcttctcttggggccatatcaactccgggatcttggttattttgatatcctacagaatatcatactgactggacctggcgagcaggaaaagttgcaaacaccctagatgccttagtaagatacctgtgtgttacaggatggaggtaagccccctcccccatcaaaattcagggtactacgatatggattaattttttgttgttatccaggtatctgaagcatgttgtgatgtacttctaatgtgaaagacataatcctgtaccttgcttcttatttatcttacactacttgtaggaaaaaaatcacaaagtttcactggcctttgtggattttatttttatttattttatttatttattttttgagatggagtctcactctgtcgcctggggttggagtgcagtggtgtgatcttggctcactgaaaccactgcctcccaggttcaagcgattctcctgcttcagtctcccgagtagctgggattacaggcgcccgccaccacatctgactaatttttgtatttttagtagagacagggttttgccacattggccaagctggtctcgaactcctgacctcaagtgatccacctgcctcggcctcccaaagtgttgggattacaggcgtgagccaccgtgcccatcccccttttaaattttagaagtgacataaaatatttggtgctgttctaactcatttactaagtatcccacaaggctgctagttttgagtgaggtccagagcaaggcaaggttctacaacaggtcccaactgtaatgcaagttgctcttccattgggcatatgactcagcaggtccaaatggcttctaaaggactatggcaaataggtgtgctgtacagatagggtaccatacatcctggatttcaatgatagcctgagttttcacctgttatcgccaaataattattactactgtcccttttccctctcatatatgtcctggtttggatgataaagtacatggtcattctatgaatagagccttttctcggtacccatagcagattcatttttgagcaaagttatgccctattctgcagataaccttttttttttttttttgaaaaacaatttcttgcttactagtgcatgttggtagaggccaaatacctgaccacaggatactatgtgatcatgcaacctgagccactcatcatgaactgaacatgcaacagaaatcccccatcaagtgaaagcaatatttgaaatcaggctccagcaagactggaaaagttgcaggaatatatggcttagattcctatggcgcatactcctgctgtactgctacctcttcatcaacccttaactaaggtcctgtggccatctaatataggaagaaaaacctctagcttggtttacaaatgacttagcatgatatgctgataccttctcaaagtcaactattacaatattatagccccacacaggagtgaccaaaaacacaggggaagagaaatcttctaagcaggcagaacttagagcaatgtatctgattggccatttgcttggtcagagagatagccagaaatacagatctatactgattcacgggcagtggctgatggtttagctgaatagtcaaagcttggaaaaaatatgggaaagttgcttaaagtatagagaaaaattatgtgacttaacctctcagaatggatagagtgtgaagaccgtgtctcatatgactgtttccccaagacaatcccctgtggcggagactctcaatggtcaggaagataaggtaacccaatccatgaatgtcagttgccctctttcccttggtggcagggatgaaggctacacacttcctttcaccatagcaaatctggttatgacccttgctgagtactcaacctgccaatggcagaggccactgctgaacccctaatatggcaccgaatttctagagggattatacagctgtctagtatcaagttgactttaaaaagcagcagcaagtttcctttactagattataaatgtatttttggatatagatttgccttccctgcccacaatgttctacaagtggaatagaaactgttgatacaataatactagcttttgtaattgcccatgtatttacctttaatgagagctttattccttcttacagctttgagttactgtctagcatcctttcatttcaacctgcaaaactccctccagtatttacgcagggcgggactggtggtaatgaattttttttaccttttgtttatctgggaatgtcttaatttcttccatactttggaagaacacttctgctggatgtaggattcctgattgacaggtttttttttcttttagcactttaaatatttaatatatcagcccactgccttctggccttaaaagtttctgacaagaagtctgctgataatcttattgaagattccttgtatgtgatgagttgcttctctctcactgctttcaagatcctctgtcttttaacagtctgattataatatgactcagtggaggtctctttgagttcatcctatcttggagttcactgagcctcatgtatgtttatattcatgtcattcatcaaacttgggaagttttaggctattatttcttcaaataatctctccgtgctttctctcttctccttctgggactttcataatacataggttggtttgcttgatggtatcccaatcccacaggtcccttaggctttgttcaagtcaatctttttttttcctcttgtttctctgacttgatacatttaattgttctgtcttcaagtttgctgattctctcttctgactgctcgaatctgcctttgaaactctccagtgaatttttcatttcttattctaattttcaggttcaaaatttctttttaggttgtctatctctttgttgatatttccattttgttaatatatcattttcttgactttattcatatctttcattagttctttgaaaacctttaagacagctgttttaaagtctttatctagtaagtactcactttctcagggatagtttctgttgcttaattttttcctttggatgggccatatttttctgtttctttgtatgccttgtgatttttttgttgaaagctgaatatttgaatctattaatatggtaactctagaaatcagattcttccctttaccagggtttgctgggtttttttgtttcgtgtttgattattgcaggctgtctctgtgtcaaggatcaggctgatgtgtaaatgtaagttcttctcaggtcttttctaagcctgtgcatttctctggatatatgtggtgacattctaatttcctctgtatatgcagctgattttgaatgtcctagactttaatgcctggctcccaaaagatggggaaaggaatgaggattaagaaaagaaatcctttaaattccctggaagtctcttcagctggagcagaaagggcttatgacagttgtggatgggtgtgtgtgcaacaatggttgtgtgcctctgtgtgcacctcaatgatgagaagtagcaatcagtgatcacagcacaaatctctaaaatttggaggacagagatctttttgtccaccctggctcctgcaagctgcatgtgaattacccaatgaatatatttcttattctaattttcaggtttaaaatttgaaccatgagattgggagttaggggatgggtagctgctaccgggttaaagctgtaattgactgaaattagttgcagtttgtcatctaaatcttcccctggaagacgtaaacttttaatagagtgtgaagattatttgtgtccacagtttcaaaattgttacatcagactgattctggcaatgaaattgttgtctagatgaggagacagattcttggtgcttcctactccatcatcttcccagaatcctctagtgaaatagtctttgatgatttatctactataccaattagatatagttagggaagttgggaccctaacttaacagcataggatatcacataaaccaaaactgatactgtttttctcataaccacaacctaaggtcctaggaattaatggaaatgaaagtagctcctcttacaattatatctaatagtccacttgcagaatttttgcttctcattctacaacttttggcacttctgatttacaggtcttagttcctaaggaggtacttttaccaagagacacaatcatggttccactgaactggaagtcgagattgctaccagccacttgcatttctcatttcactgaaccaacagtcagacaaagaggggttcattctactggctaggtgactgatattgtttataaaaataaatataattgctgttataccttgaggttaaaaaaaaaaaagtatctctgggactagagtattatctggtgctcctctaagaagttccatgtcttttagtcttttaatgaagactacagcaacccagtaaaagcaggaccttaaaggactcagacccttcagaagtgaaggttcagaagaccacatcagttaaagaaccccaaccagccaaggtgctggaagatgacagaggaacattaaataggtgatggaaaaaaggatttacaaatatccactatggcctcctgaccagttaagaaaagatcactgtagcaactatgcatattttcgtgtgcattttcttccttccttagtgtgtgtgtgtgtgtgtgtgtgtgtgcactcgcatgcacacttaaactgctagtggtgactgactttacaacttagtttttaggatataaaatatccataaatttctttagaagagaaaataatatcatccagcaatggctacagtaactgatggaactgtgtctcatccttcttgaggggatggtgaaagtgtcttcagtataagaggaagagttccttcatgttaggtaaaagcatgttgcagttgctattgttgtatggaaattaaatatggagggaagcaggagggtagctattggggttccaagggttgaatggtgccagttatctgcctatttgctctcagccttcaccccttccttctgtgttcttctatgtattgtagggggctggagccatctccttaactacacttcccagactgcctttccaactagttggatactgccaatagaagggattcatgagagactggaaggccagagccagggagaagcaactctcttgtctggcttctgatagcatttctgtcagcagcagcagtgatagtgcaacagcaatggcagtactaaccatggtaactgcgttggcagagattccagccttggttgaggcatcacatcttcagcaggtctacaattacagtgacaccctccctgaaagcccagcagtggatatagacttgttgacttcagtttagcagtgatgcagcttctgatctctggttatcaacgcttcttactttttgttcttcccatacccctcttctccacttagctcttccatcccttctaacagccatgtaaccaattccctctctatcactggtgatattttaggtggaataatggttctctgggtatgatttttaagagtgcttaccttttagagctacatactggaatatttatagatgaaataatatgaaacatttatggctgtatatatctgagatttttcttcagaatattccaggagggggcgtgatgggggcatagatgaaacaagattggccatgacttgataattgtcaggtgataattgttggtgataggtacctggagtcaattttatgatagactctaattttatatgtgtttaaaaactttccataacaaaataccaattacctctccctgccaagaattaataaatgaataaaccaatcagtaaaccaattaataccatctatttgtaataccttgagtgggttttgtatttctgtctacagcctgactggctcatggagaaagcctacctaagaatgaagccgggacccggcagaatggctcctgtgaagaagggtggcaagaagaaaaagggccgttctgccatcaatgaggtggtgacccgagaatacaccatcaacattcacaagtgcatccatggagtgggcttcaagaagcatgccccttgagcactcaaagagattcggaaatttgtcaggaaggagatgggaactctagatgtgcacaactgataccaggctcaacaaggctgtctgggccaaaggaataaggaatgtcccatgccgaatccatgtgcagttgtccagagaatataatgaggatgaagattcaccaaataagctctgtacttcggttacctatgtacctgttaccactttcaaaaatctatagacagtcattgtggatgagaactaatcactgattgtcaactatatcaaacaaagttataaaactgcaaaaaaaaaaaaaaaaatgaagccaacaccaaggaaaacaaagatgtcttcatgtgtatgacagaacaagtaacagactaacagaagctgcacacatgctcaagaaatagagatgcacgcagagacctgacaacatcctgtgcgcctatatccagccaaagcatccagcagactgacctcatgatttttcacatacatgaaccaataaattcccttttttgtttaagccactttgaattggacttctgttacttgcaaacaaaacaaccctaactaatgaaacccctaataaatgatcactactattatctcaacccccttgagcaactagccaaccacaatcatcaccatataaaatctaagtaacttattacatatatacacatatatatattaggcataagccacaatagaatgtgctaagtattaaattaactgtggaaacactaaattaaactgatccttagagaagggattaagaggcatgggctaaagcagtcagagaaggctcctggtagggaaaggaggaaggtctgagctgggccttagaaaatgtacagaatctacatgagaatataatataacagtcatgagtatggtctctggagtctgatagacttgattcaaatcctggatctgttaccaactagctttgcaactttgggcaagttacttaaatgtctgtacttatttcctcatctaaaaaatgtggataataataggagacctacctcacagagctgttatgaggatttaatgagttaacatacataatgccgagaatactgtctggcacattgtaagtactacatatgtgtttttattactattaagaggaaggaccagccagaggaatggcctcagcaaaggtgcagagtgggaaggtacaaaggttatctagagaccagggaacagacttactgagctgacacagggggctcatgaaggagaattgtctggcaagacagtttacagatgaccagtcagaggcagggaaagtggcttgccaaacacctggatctctcctaacagcacacaggaaattgggggcgtgtgtctgaggcctttctgggagcttcagtaggtgccattatccctgctttgagcacttacagcctatctttatggcacttcaagctgctatgggctatttccttggatatttgtacacaaaaacacagaatggactccaggaggtagaacttactgttctgcgacggccaaattgggcggcagggaggtaaggccattgcctgtgaggagcaggacacggaggtgtggcagaatccccaaatcacagatggcctccacagtcaggctgttgaaggaaaggtccaagaactgccatgcaaagatgaaagatggggaaggtaagcactctgtgtgacaacaatgctcatatatgatgtgggagctactttctagagtgccccatcgcccacaggacaaaaccctcctggatctccagattaatattcaaggtctactagagtcagtacccaactggttttctagccttagttgccactacaaatctttgtttatcctgtagtgctaggcaaatagactcctccccgctgtttgcctcatccacctatagatctttgcttgtgctttttgcttaaatgggaatgccattcttccatgtatcctaatccaagcccccaaaagacagctcaaaagctgcctccttgtaaaaccttctcaattccccagacagatggaatctctacctcccctaactttgactgctttatctaaactgctttcagggtacttatcaaagtcggctaggtatctggcatatgtatatgcctagcacagtgcttggcacacagtggtggactagatcataaactggtacttggaagactgtggggtcaagtgccatgccactgtaacactgtatccttgtaagttagcataagacctggcacaaagtaggtgcacagaaaaaatgagctgaataaactggcttcagtggctcacgcctgtaatcccagcactttgggaggcagaggtgggcagatcatgaggtcaggagattaagactatcctggctaacacggtgaaaccccatctctactaaaaatacaaaaaattagccaggcatggtggcacacgcctgtagtgccagctactcaggaggctgaggcaggagaatcgtgtgaacctgggaggcagaggttgcagtgagctgagatcacaccactgcactccagcctgggcaacagagcaagactctgcctcaaaaaaaaaaaaaaaaaaaaaagacaaaagaaataaactggcttatgaggacaataaccccaaattgtcaccctattgtcaaccaccttctaactggccttctggattcatgacatagttgactggggtcaaggggccaaggggtcagtcagaaaaccgtgtttctctgcagagacaaagacaatcaggataaatgacatctgtccaatatttgttctccttctcctaagcctccatagacactatatatacaagttggctcccttccatcacccctatttcttatgtgcttccctgtgcccccctcctcaacatacattgaagtctattgaatggggtcagtttcagcaacttattcaattggtacaggagcaagtctttggtcagccacatcagtattacatagtcagacatatacacgctacaggttaccctcagagaaggactgggtttggtctgactctgctgtaataattgatagctctgcagacctgggtgtttaagtcctgactaaccatgtgatattaggcaaattacttaatctgggtttccttatctgtaaagtagaaataagtggttcttatgtagataaagcctttatactggagtctagtatacagtaaatgcttaatgttggctgtcatcatcatcatcatcatttcattcctcaaccctatgtataaggcttactttgtacctgtccctgccctttaggagctcccagcctactcagctaaatacatgtatatgttcattatgtagcaatgctgctgggatagatgtctgaagacagaccaatcagggcacaaaggaaggatatggtcaggtctaccaggggatcaggacaggcttcacagggtaggtaacatgtgagctgtcctcagagaccagtaggtattcaccaaattgttaagggcaaagagacattcagggcagaaagtggcatgtatagaagccaggaggcaggaggcagcctttcttgttctgagaaccatgaatagtttgggtatgactgaagtccctggcataagaaatggcttgataggactagccaagtactacagaagctccaagttcatgccaccatcagcaaattccaaggtttgagggttcagacaatgaggcaatcccacttggctggagcaaacagagaagcctacaggaggaagacctggaaaggtgcctgagataagcacagggaaaagtggggaacattctcccctcatactcatgtgtgaacagtcagcctatggattctatctacctccttaatatctctcatgcttgttctctctaatctattttttatacagaagccagaatggtttttctaaaatgcagttctgaccctaccacttagcttaaaacccttcaatggatccctattctccttaaggtttaaactcctcagcaaagtttccaaggttctccccagtctcttttctgctacccctccaggttcacatatcactacactctactgtgtctcagtctctattccagccatacggagctgtttcattagggttctagctcagaagctgacctactgctattttgtgtaacccaggagctaagaataatttttgcttttttctttttgagacagggtctcattctgttacccattggtatgaacatggctagagggcagtggtgtgaacatggctcactgaagcctcaagctgctgggctcaagtgatcctcctgcctcagcctcctgtgggtccacaggcacgcaccaccatgctaattttttttatttttgtagagacacggtctcattttgttcccaggctggtcttgaacctctgggctcaagcgatcctcccatcctggcctcccaaagtgctgggattacaggtgtgagccaccctgcccagccaatttttacatttttaaatggttgaaaaaaataaaaaaaaagagtaagagtgggccgggcgcggtggctcacgcctgtaatcccagcactttgggaggccgagacgggcagatcacgaggtcaggagatcgagaccatcctggctaacacggtgaaaccccgtctctactaaaaatacaaaaattagccgggcatggtggcatgcacctgtagccccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaagaataagagtgtgtttcatgtgcaaattatgtgaagttcagatttcagtgtcatgaagttttaggctgggcgtggtggctcacgcctgtaatcccagctttttgggaggttgaggtgggcagatcacttgaggccaggagttcgagactagcctggccaacaaggtgaaacccttctctaccaaaaatacaaaaattagctgggtgtggtggtgcacactcatagtcccagctacttgggaggctgaggcatgagaatcgcttgaacccaggaggcggaggttgcaataagctgagattgtgccacttactcctgcctgggtgacagagggagactgtctcaaaaaataaattaattaattaaaataaacaaagttttattggaacacagccatgctcatttctcatttgtttacatattgtctatggctgttttccattatacaacagcagagctgactagctatgattagttatgaccatatgaaccacaaagcctaaaatattaggcctgctgtacagaaaaagtttgctgacctcattctagctgctttggctatttaatgtaggatccgaatttgctttctatagaattaagggcaatttaaagaaatgaatagccttagaatcacaggctacagaatttcagagctgacccagaatttacagaggggaaatgtcccagagagggtacgttgtttggccaggtaggcatggcaaagtactggcaaaaccaagacaaaaggtcttctgactgccagggcagggctccagctgaaccttcttcagatctgtaatccgagaatcaaaccatggcaaagttaagtttttctaaattgactcctgaagaattattctactctgggcttttcctcctggggcagcctttttggcaaacaagaacagaagattcctaacctggctactacatctgctgagtcacatcaagttttattacacatcaaaatattacattactgtgagctgcaaattcaggatatttgacaggtttatacttcttcttagggagcccttgcaaatcacagatagatgaaaacagatgactgggcaagagatttcctgttttcatttatattctgcatcttaactttggtctgttctcttacgtaaataccctttcgtaagggtaggtctgctggataaatcatcttcatcagatgcgatcacactataaagtaaagtaaggcctccaaaaaagtcactcatgatcaatcactagatccaagctagtcagttgtggggtcagagcctatagtcatgtctcctcccttcagcccactggtacttgaaacaggggtttgaaatggtaggggaagaagacaagatgcatggtacaacgcacaacacaggagctcaatgactactctctgaaaaagtaaaagaacaaataaatgcaagttcttaagaagctcccaggctcaaaggtcagggacatggctccctgtatctctagaccatctgaaacctgtttcctgctgtctattccaaaatctactgttaaatatttataaacacagaaaaaaaatgcatcagttgttgtaaacttactttctctctattttattcaactttcaagagctttgcttcctagacaagtgtgaggactacttttgtctcaaatcatagaaaattactgttatcttcaatatgacttgagaccatggagagaaggttccattacagtcagcagaatatgctttaaaaatgcaaagatatataatccaattaggaaggtggccatcccaagaggttaaaaccttttaaagctttggcatatgaaggccatcaactctgaaaaactcactcttgtagaaggtccccctcactgacaagaccaggttaagtgaggcttttgtgaagaatggctgacccttgatgtttgcagatgaaatcatttaagttaacagctttttggggttgacctcaaggttcatgacacgcacacattttactgaaatttgactctgaaacacttctactccaggatgtggagaagagtctattactcagtgagtgagcgtggtcagatgcccagcccacacacgtggctccacctctgttgtcctttactctccacatatgttgtcctttactactgccgtgactctcaggtagtgacaaaagctttgttcctttgtaaaaagtggcccacaaatcttcatgaaagctaaataagtaatcaacttgaactataaggacatgtgcagaaaatgcatgactatgggaaaatttaggagaaaaccaagaatgcaaacaaaattttctgtattttctaatttgcggtttgaagaacagctgtgaatgtacaaatgttcaagactctgctgctgatcccaaaggatccctattcatactcatctccgaggttatggactaggcctatagcctgctctatcccagccaccgagactgattcagctcacttagaccaggatgagtctctggaatcagtctataatgtctctagttcagccgatccaatctgctgcacctagctcttaagctccatggctcctcaatccccactagatccagatctcccctcaaaattctccctccttcaatactctgttttaaaactcacttttctgcacagactcccttggacatgacctttggcatttattttccaggaccatgcaccatggttaagtctttggtatcaactatttgctgccacttctaccattaccactatctccatcactgtaactacccttacaacccccacccccaccctccctggaggccagcaatgaagcaagggcctggctgtacaggcccagcaagccccttcccaacagttataatcagtaaagctctatgctcattccttacaggggaacttggtgggcaccaaaaactccctacctccaacttacttctaataacttaaagtctccatatttcacgtagatagttttgatgccattaaatgcgagatccagttcctttagggctggaaacgtgtgaaatgcctctacatggggaagagaaagagagagtctgcagcttgtaaaggacttaagagaaagatattaataattaccatttactgtgtccctactgggttaggccaggcactgtataaggtactttacatacatggcctctaaatctctaacaacccagaaaaatagggattactacttccattctatggctgactaaggctcagccaagctaagtgatttgccagaatggaattgctggtaagtgaaagagccaagaattgaatctaagtctgctcaacagcaaagcccattttaaaaattatctttattaatcctgattacaaaaattaaaacacaactaagaaaaacagtcaaacatcacagaaaaataaaaagttctgtttaatcccaacatccagagacaagtattaaaagttccatatatagcactcaactttttctcatgtatatatcaaaatacatacctcttttaacaaaaatagagtcatactgtacacactgtactgacttgctttttcccttaacaatgtaacttaaagattattccatgtcaaaacatatagatatgcctaatgtcttctgatgttctacagtatagatatatcctagtttactaatccatttccccattggtagcctttaggctatatgaataaaaggtaagaaactatatgaataaatgtttctctctttgaatgagaactgaactttttctagccttgttcctctggtaacctgaaaccaatgatacagtaactgcatttccaggcagtatcacttgcggtaaaaatcaccctaggttggcaaattacatctgggctaggagaaactataaatgaatgataaacacctgaagggggcaccataattttgggcttccctgtgtgtagtgattcctataattggatatatcctttgcagaaactctaggagctatgcctatacgtgttacaatgtatattggctcctgtgaggaatgagatttctaagccagggtggcttttgcatccacccaatgacagtctcactgtcttgtacctgagctgacactgggggccagatggaggggcacaaagaatgcctcatggatggctttgggaactccattgaagagaaactcctgatgctgttgtactggcattctgtgtggaattacttagagccttctaagtgaacctgatgttaaatatggtagtcttgtaagtcagaatgttcagtagaacctaataaaggctgctttgtgaatatttctggatgtttccaatgaacagccttgtacgagtgtgttactatagaataatttcctggaagtaaagctactagattaaaggcaatgactactttaaattttaagaaacattaccaaattacctccaagatgctacaccaatgactatacttccacagttcaatgcaagagtatccatctccctaccaatgctggctgtcatcagcccttttcactcctgccaatatttgacaggcagaaaacagtatcttgatccactgtaattattagtgaggttgaacaccttttcatatacctattggcctttgtatttccagcccaagctcctgacagaccaccctgtctcctaaagggcagggacctcatcatatgcttctttgaaaacaatcttcaaactcaatgcaacaaaactgaacttatcctatttccctctgacttgccttttctctaatgtgccctatctcaatgaaatgccccttgattcctccctctccctacatccctatcagtctatcaactaccaagtcctgtggtttctactcctcctaaatctctgtctgtctctctctctctcaatcctctgcacccttcttgtcacaatcctggctcaggcctcatctcccctcccctgaaaacctgaaataatctcccaggtttcctggcctccaccttcttcttctcttataatccactctcctcacagctgccactgagcttctctatttaaaacccttccaagactctcttttgcctgcagcattaagtccaattcactcccggtccttgataatccagtcgctgccaatctgtctagtttcaattgtcccccacatgcttcccttgcaagcatacaaaacctcttcagtcttcctgatcagacaatgccattccacatctgctccagcagccggaaatgccttcttaccttctagttcctgaatcactcctattcatttttctggtctcagcttaggtgctcctcttctcagttcctcctgacactctggcctggcttgaagtcccacgtatatgcttgcatagtatttcctgattctctctttcactgctctcccctcatcctgacctaactatctgtatctgagtccatctctctcaccaaaccatgagctcaccagagcaggactgtatgcactcatttctaaaagccaagtattcacacagtcctaatatccagcaggggtcgctgtggacttgctgaataagaaggctttatgctcctacaggagtactttacaggcttagaaacatttttatacacccatctcatatgagcctgcaaggtatcctgcaaggggaggaaaaaaagaagggaattatctccattgacagatagagaagtagaagatcacagaaaaatgttctaagtaggtagcgccagagcaggactggaatcgaggtctttgtgctctccagcacccagcctattgtactccaaaaaagagatgtgtggccaatcatagatggttggacagacaaatcctaacacacgtgaatggctgtgctggctaagaggaggaagagagctttcaagaaagaaaaagcttacctagaggcagcaggttttctgaggcattgatataaatcacagaatgaaaatgcttgaagtcattttccttggcctgtaggaaagcatttcagaaaaaaaaaaaaatccacaagattagttccctgcctagaagccttgctgaagcttcagggccactgtcagaagaaacaaagacctaaaggaataagggacatccctagcacaggagcagacacttgagtgctgtaagggttttcctgctttttttccactatgaaacatttcaaatgtacagaaaagtatacggaatgacactctgaagacccatataaccactatccagaggtaagtatttaatacagctgaatattttgctgtctttgctttaaataaatttccttaaagaaaatattatatagggtgaaccaccaccattaccacccctgtccatgtatcccctcactaatcccataacagctatcctgaattggagactatcattcccatactcaatagtttttgtgtgtttgtttgtttgtttttgagacagggtctcacttccattgcccagattggagtgcagtgacacaatcttggctcactgcagcctcaacttccccagctcgggtgatccttccacctcagcctcttgagtatctaggactgcaggcacacgccaccaagactggctaatttttttgtatttttagctgagatggggttttgccatgatgcccaggctggtctcgaactgctgcgctcaagtaatccgcctgcctcagcctcccaaagtgctaggattacaggcgtgagccactgcacccagctcccatatctttttttatgcttatacgtgtgtgtgtgtgtgtgtgtatcaactatatataatgctagatacaggtagtaaaactttacgttaaatgcaacaatattttaggtatcattctgcaacctgccttttcactcaacactgtttttgagaattacctgtgtcgatatatgctgcttttgaaatttacatatgttgacagttgtagttctagttcaattttttttttttttttgagacaaagtctcgctctgtcactcaggctggagtgcaatggcacaatcttggctcaccgcaacctccaccttctgggttcaagtgattctcctgcctcagcctcctgagtaggtgggattacaggtgtctgccaccatgcccagttaatttttttatttttagtagggacaaggtttcaccatgttgtccaggctagtctcaaactcctgacctcaagtgatcctcctacctcagcctcccaaagtgctaggattacaggcatgagccaccacgcctagccctagttcaaccattttaattcctgtatagtattccattgtttgaatatattgcaagtttattcattctcatttagtctgtttctaaattttattacaaacaattatgtaattaatattcttatacacacctcctattcataagagtttctttaatgatatgctcctatcaagctgtggggaatacacagctttatgagatggtagcacattgttctccaaagtagttaaaacaatttacagtcctacctgcagtgtatgagaagtcctatttctttaaatccttgcaattggcattataaaactaatttttgccagtctgattattgtaaaatggcactgcattttcctgattatttatgaggctgaatatctttttctatatttattggcctttcaagttcctcttctgtatactaacatatttatctgttgtctatttttctactgggtttctctttcttcctattgttttgtaggagctcttgacacattctggatcccaatactttttggttatattacttgctaatatcttctcccagtctcagcttatcttttacctttgtttgtggtaacttttgttagatagatatttttaattaaatttcatagatattttcctttatggtttaaccacaaagctagcaagcatccactcatcccgtgggtctcagctaagctaccaccctctccagggtgtgtttcctgtgtaaggctgagtcaggggcctgtcctctgaggtcatatttcgcaccctcgtgtttccctcattgactgcattagctagtcctgtctaactccatatccatctaagcccagcctcctccctctctactggactatatgctccagagggcaggcagtgtctgagccacctctgtaccctccagcaaatagcacagagacacaccaggcctcggtaatgtttggtgagcacgtgagtgaataagtaaaagaagaacatacggtatccaatgaggggactgagctttgaccagccatgttgtagccctcaaaaggtgaattgataaagagacctctgaaatcttctatgactttgtctcaccgttatatgtgaactatatattataatctctgggaccatgtgctggcctagaatggagggcctctcagccacaagatgaatatatttctaaggttaacctgtccctaagtaactcaattctgaaaacatgagtgctaaatgaagtgaagcagaaccctgttaaaggagcagtctgctttaccacaaacttggccatcctgtgggttagagcctctactctatggtttatacaagtaatctctcttggtatgccacgaaagccaacataccaaagatgtatgttataatatcctgtatatacactggctaatggtgggtcacaaatatggctccaagctgcctataagccaatacaaagaaagaaacatgattcattgcatgagtcacagcacctgtaagttaggaacgaaccagcttcttgggaaaaccattacaattgctggcattgaaacttaagaaatatctcttgtagggtcttgtgatgggaactcagtgtcacacaatgaattatgtacccacaaaattacatggcaaattcaaaaccagtttcataaggcaattttcttttcttttctttttttttttggtgacagagtctcactgtcacccaggctggagtgcactggcacgatcttggctcactgcaacctctgcctcaggggttcaagcaattctctgcctcagcctcccaagtagctgggattacaggtgcctgctaccatgcttggctgattttttgtatttttagtagagatggagtttcaccatcttggccaggctggtcttgagctcctgaccttgtgatccacccacctcggcctcccaaagtgctgggattacagccctgagccaccacgcctggcccataaggcaattttctttaattcatatcaaataggacaagggcaatataaaatttgtagcaaaagtttgtgtctgaatattgtttcaacccaataaatccttgtctgactctcctctccctccttcttcgtgaccagatttccagtccctagggactctggaggtgcaagagacaaaccacaacagccaggtgcgccacctcaagtctggctcaccccaatcacatctttgctggctgacctcaccttggagaacttcaggccactcacattaatggtgcacagatctgatggcttcctcacacagtggtgcttcagctggaacataatacaaagagttgtctcttaaggcccctacaaagtttaattaatctattaccactcagccttctcttgttgggcaatcatatacttgtcataatttgtttgcttgttcattcattcattcattcattcattcattattcatccattcattcgccaaatatttaccaaacactaaattgggccatacgctttgctgaatacattaacaaactttcttctaatcctaattaagccctttgattataaagtaagattatctcctctttttaatgagaaaaacaaggttaagagaagttatgtgccttgccaaaggtcccacagttagtaagtgacagatcttactaatccaaatctgtaatcactagactctatgcacttttgactgccatatgtcacccgacataatttaaaagttagaggtaaattttagctttggagcttccatttatgtttaatcaaacctcattctttttttgttaatcatttatttatggtacccaccatgtttaggcactgaaaggcattgggaagacaatgaagaaaaagcagagacattccataacctcatagagcttacagtgtcatgggaagccaagtagcaagtacgtatttataaatgtgataaatattttaaaggagaaatttaagatgctatgagacatataacaggaggtcctaacctcagtctgaatgaggaaatacttacttgaggaagtaatatttcagaaacctaagagctaaataggtctcatgaaagtgggtagtagggattatgaagtctaccaaggcaggaaaaagcaaggtgcttctgagaggatgaaaaacaagataaggttagtgagacggccattagatcatataagtccacgctggctctataaaggagtgtggattttatcctacgacaaatagaaagcagatttttagcagggggctgatagtaattttataaaaattgtaatgtcggatacacatagacatatcagacagagtacatcacatagatgagaagacaggaaaggaaggggaaagacgaatgtaccagattggttaattactttcctaataaccactactcctccttgttaaagaacaccaatgttattcacatttctccaaatggaatgttcttaagccacagctccaagcaataagtcgtgatctgtgtaaaccaatcatggaggtctcattcccctaactcatgactgttcgggcatgttatataggtctggataatgagatactggctgcttggagttgaggagggggaccggttttggaaagcattttcttacttctgaaaagacattagtcagtaacaatcccttctctacctcaggatgttatattctgtatgtgatgaccacaattgctgcagccatctcaggatcatgaaggcaatcagcccaagaggacaagataacatgtaaagtggcacagcacaaagacagaaggaacacaggccttgcaagacgtcattaagcctgtaaattaatctaccctaaacaatgcctctggcttatttttatgtgaaataaaagcatcctaattagtttacaacatatagaaagtttctgaattagtccaataagagatgatggtggcccagataagggtcatggcagtcgagatgagaagacagatttgacaactatcttgtaaaagtgccaggacttggtaaaagttggggtggggacagtgtgggagaggcaaatgtcaaggataacctcaggtactggcttggcaactgggtagatggtagtgccaacagagagagtaaagtagatactggaaaaagaggtctgttttgggatttggagtaggagcattggtgctgtaattcaactgtcaatgaaacattcaagtggaactatccaataggcagagtggataccccatgattctgaaaaacatccttgttgctcctgtctcccacggtggcaagacgggtaacaagctgtatttattgaatatgggaatgtataagtatttggaaacaagggaagaaaaaaaggccactatgggaagtgtttctgcccctcctcagtataattatttcagtcctcctcattcccaatgagaagtggacctaataatgaaactgattccacaggactgcaaaaagcttatactacccacttgaggtgagatgaaaccaacaaagttctctttcaacatctgatttatgcaggcacccatctcttgggaaccatagcagaatctggaaacaaagtaggcagccagggagttcttagggagctatgagaactcgactgcacattaatattgatttacaaaatgcatccttcttagcaaagccactgaggcattgcacagagcagatgtgaaactacctggctggtctccaacacagccaccccagtcctctttgtaaagcctgcccccggcactaagtaatatctggtcagctcccttggctttcagccagacactaaagtcaaaggacaaaggctgtgggagagcaggacccagtcccactcaatcctgtagagatcaccccaaagagcacagcaggaatctctcaaccctactaggtgctggaatgcaattttcaattgactgtttcccctgacctgctcctttgtctctccaactcagtaagagtttttacctcatataatgtaaaagtacaggctttggagtcagtagaccagagttctaatcctggatcagccatttactagctgtggaacctcagccaaggcaaactacttcttggagcctcagttttcccatctgcccaatggcaacaacacaaaagggacgacaatacctatctcactaggtagatgtcaagaaagctttacatgtcaagaaacttttgggtcccttcattatcctggctgtactcaatttgccaatatcactctaacagtttggagtagattgggggtagttgtgccagagcagggcaaatccttccccacttcctccccaccctagctgatgtgctggccactccaggatgcatttactctcaccagaaaagcctggtccaggatatgtccaggaaggtccacctgattttcccgccgagactctttcttccccttgaactcaaaagaagtcgccttcaggctttcccgacgttcagcttgtgctccaaccaaacccttgggcttcttcttgaggttacctttctgaaccactaaccagtgtccttggcctgttgagaaaattagaacagtgaaaaggggaaaactccaaagctacaacgagtgcagttatagactttgtttataatactaaaaccaaaaatagctcctgattatctaacatgcaccagatacaatactgcagctgggggtaggggagatatctacctatctatgtcatttaattggcctccaaacccagtgaaaaacatgtcactgtcatgattttatacatgaaaaggctgcgacaaaaggaggtggaatgacttgccgaattccttccttcacatttttatctccaaattctattattccttcaaaaactaagatcaagtatttcctgttctgtgaagtcttcccttttgcccctcagtagagctgatccctctttctcatgcatgccagttactctcctattggtcatctcttgagtaaagcccaatgtgtgacctcaactcaataggttccatcttcccagacctctatcagtatacagaaaagatggtgttagaaacttggaataagaaaatgtaggacagatggcattaaaaaaaaaaaacctaataatacatgtctactgtagaaagaattttaaaatgtgtataagcaaaaagaatatgaggtttactagtaagctcaccaaacaaaaatcataacgtattttggaatctgttctttctcgcaccagcagtttacttgctgtgtggtattcattgcaatctgtaattattttatttgttcacttattcattgtctgtctccctctctagagtggaagctccgtaagagcagggactttatctgactcattcatctcagtattcccaaggcctgcacagagctcaccgcattgtgactgttgctgaacaaatgactgaatgaaccctgtcttatagcccctgcccacacagtcatccattcctatcttttctgagcatctactttatgctgggaactgggagtatgagaatgaataaaaaggaagccctaactcaaaggagtcataataatataacatcttatattatatacaatagtataataataatataaggggtgctgtgggaaccagctttgtgcctctaaccactggctgtcttctggaaaagcccactatctctgccttgggggcttgccctggctcacagaccactgctgacaatcctgcttcttggatgcagttcctgccctatgtctcatatgagtcatttcccatttccattatgggcctgatactccagttaccccatttcccagggctgcccccatctggggcatgaactttgcttctactttatcctatcttcatatccctgactcctggggacctcagtctgagttggtgccaaaacccccaacaaggtcagaaaggaaggttcagagtgtgtcaggagatcaacgggagagaaaagagactatgcaaatatcctgtttctcatcatacttttacccacttattctagtatctgtgatggttaattttatccatcaactttgctaaagctataatatgcagttattcaatcaaacactaatctaggtgttgctgtgatggtattttgtagatgtaattagtatttacaataagttgatgttaagtaaaagagattatccttgataatgtgagtgccctcacccaatgaattgaaagacattaagagcaaaacaggtttcctagaggaagaggaaattttgctttaacactacagcttcagctcctccccaggggtttccagcttgccagcctgccctacgaattttggacttgccatcccccacaatcacacaaagtcaattccttgaaaaaaaaaatctgtctacccacctacctacctatctcctactagtcctgtttatctactaccagttctgtttctctgaagaactctaatgcaacatcctataatggttcttacctacaaaaattattactgtagtgtttgaatagtgactttctatttccctcattccttctacattttctagttggaattctactataagaaagagctggctgggagtggtggctcatgcctgtaatcctagcactttgggaggctgaggcgggtggatcacttgaggtcaggagttcgagaccagtctggccatcatggtgaaaccccatctctataaaaaatacaaaaattagctgggcatggtggcaagtgcctgtaatcccaactactcaggaggctggggcaggagaatctcttgaacctgggaggtgaaggttgcagtgagccaagattgcactgctgcactccagtctgggcaacagagagagactccatctcaaaaaaagaaaagaaagagctattttgtttccccccacatatttacatattcaaatatttatattagtagactcatttattattccatggtttacaacccaattccgccattatttatttcattgctcaaactgtcccagctttggtgattgggagcaccttcaagtcagctgcgtcctttcaacatgccctcattattttcctgagcacttctttacttctggcaccataagatactccaactcaacttgtattttttctgccctagtcctgcaaacaactatttctccaagaagcccatgttcttttcactggagaatggtatttagaaagcaagatgtagatactaggtatgctttttgctgctgaggtgtcattgctgtcagtggactggtaaatatacatatgtacactaaaacatatagatatatacaactatatttatttctgtagctatccatctatgtgtgtctgtgtgtgagagagtgacatagagagagagagagagagagcgagagcaagagagagagagagcgagagcaagagagagacaaagagagaaactatgagctcacactgatagctccatctgaaggtgtctgataggtaggtggccagggaaagtctctgtgtgaaaaacaaaatcactctagagaagcagagaggacaggcaggaagagaagtttcttccaatattccatatacagagtgaccaacaagttacaacatctggagtaaacaaggtttacttctcctttgccctaccctttcaaagcaacaaagccaatccagagaaccaatacttagtgtttcacctatagggctcttattatgacaattccctgctccagggaagtttttaactagataaatatttgaaaatctacctggcagagtcgaatttaagccattttatttaggagtttggcagaccatgatcactcatcaaataagaaatacagacaggaagacagctcacgagaggatgggccctgaggactagggtagtcagacatgctttactggaagaagtagaagaagagctgggatttgtggaatgggaagagtttggctaacaagaatgagggctggaacattcagggcaaataaaaaagctatgtgaaaagcaagcaccgtggaacagagcataaataaagaaatgggttatcacagaggataagagcaggttaaactcagaatgacacagaatgccagttaaaggagttagcaatgagaagtcactgaacagaaggggcactgtggttaaatatgcactttagaagtcccatggaggctactaggactggagggggaaggattaggtagagcagggaacagtagtgaaggggttggagaagaacaagtagatgtgagatggtctaaagcacgagctaggtatgaggaaaaggtagctatttgagaagtcacctgaccttcctccggcacgcgaagcagatttctggctgggaagcagttgttcaggtaaggcttcccatcatccagcttgtagattcctgagaaggccatctccctgagagccaggcaaggaaagcaaggaagcagaagagtgaaaaggcacagcagagcactcttactccagtgcagctcatgagcccaccaggaccaccacacccgcacacaccctgcctccgacaccctggaggccccactgcccttgcttcagaaatgggctggctgtttacatgaagagagaaacaagaccctgggtttttcagttcaaatcaatcctaacccaatggaaccctagaaagaacatgatcctccagctcagacttggtttgaatcctggctctgtctttccttgctctgtgactgggcaagttactctactcctctgaacttcagtttcctcacctgcaaaatgggggttataatacctaccttaaaagacaagaggatcaagtgagaaagacagtgcctaatacatattaagtctgtgctagatgttttgttttaacagagttcagagaagaggctcacattttagagaaaatagtgtacaaataatgagacttgaactggataaatagtatttgagggattgagttttctgatagagagaaggataaacattccaaacagcaagggccacaggagggcagctgtgcacagtaaagaaacaatgtgacccaagaaggagagggatgtatgtttagtagtcttgaacaataaagctggacaggaaggatggtgcctgctcctgaagggcttgaggtaccaggctaggagctcaggcttcatcttgtaggtgactgagagccatggataatttctgagctggacagagccataatccaagctgtactttacaaagagagatctgacaaaaatagcagtaggtgaaagtggcacccagtggcaactgggattgcagttaggggagtattgcagcaacccagggatagctgatgagagttcatgttaataaactaaagaattaaaaaaagaaggatggacagaaaaaaggaatgagaaagggagggacagtagagaaaaagaggagcaagaccaattagaagtatgagcatttcatgtgtggacacagcctaggcaacacagtgagaccctgtctctgcaaaaaattaaaaaaaattagccagcacagtggtacatgcctgtggtcccagctacttgggaggctgaagtgggaggactgcttaagcccaggatgtccaggctgcagtgagccgtgatcatgcctgggtgacagtgagaccccatatttaaaaaaaaaaatgtgtggacaaaggaggagaagcccctggaggattcagaaaagaaaataattttagagaagtaggagaaccggggggtggagagtgggagctgccaagtaagccaagggaagagaaaactctatgaaagaggcagggaagtcaggcaaggtggggaccgaaaataggccatgagcaagtaggaggtcagtttcagaagaagggtggagttaaagtcagactttatgtatgaaagagtgaatggaaggcaaggcaatacaaaaagtgaatataagcaagtttttcaagacgcttgattgtgaaagggagaaaagcaagacagcagtgagatggaaggtaaaattgcgagatgggtgaatatcagggccagcactgggggaaggtgagcaaggtgcctgaggaacacgtagggggacatgtgctctctctcagagttgtgcaaatgcagtgttagcacttggcctccaccctagtcccagccctggcagacagagtcactaccaagaataaattctggaagctcactgcatgggttcagatcctagctatgccatttactagctgtgtggccttgagcaagttacttgtctatgccttggctttttcctcagtgaaatgtagacagtaagtgcacctacttcatagggctgttttgatgattacaggagaaaatgccttagtatctgccacatggctaactcatgctgctcattttccattactatgctattaacaggatgagaaaagcttcactacatctagactgagaggaaggagacagcaagggaggaaaggctgacaatgcaggagagagatgggcagacccgcagagccatccctgagaaagcaggaagaagggcacccagcatccaggggaggggttccctcactgaggatgagggagggcaggctccttcagggacagttgtgatgggagagagacttcaaatatcccaagtgttccatttccctaacacctagagaataaaaagagcacaaaagaaataaccttccatcctctatctgctatggggtggctccgagactcttcaataccaatttacagtgagtcagaaattctttaggggtgtgtgtgtgcccatgcatgcacacacatgcaaaaaagttggaaaaagaatatagttctgactctagggtatgactcagtcttttcttcatcaaatgattattctcttcagagagacaggcataaaaacgattcctcaaaggcatggatagccctaatcacaactgcacttatcatttgtcattcacagattgttcaccacagtctgatgtcaaaccttggaaaaacctacattttaccgaggacttgcaaacacaaatggttacagaagttgggcaggctatgtgagtgagtgaagaaagctggaggcgaggggaagagagtaggagggtgtgtgtgtgtgtgtgtgtgtgtgtgtgtgtgtgtgtatgtgtcagagagagagagagagagagtgcacctgctcatagaggcagcaactagtcagctcttaccaactgctgccatgcagaaacctaagtcactgttgccagagcttcacttttttttcaaggaaagtctgccttatacgtgaaatctcctatttgagagtcagcaactaatttgccattttagaacaatgtgcaggccaaaccaaacacctgagaatcagattcaactccaggctacatttcttttttctgattcatcttttttttttcttttgagacagtgtcttactttgtcacctaggctacagtacagtggcacaatcacggctcattgtagcctcaacctcctgggctcaaacaatcctcctacctcagcctcctgagtagctgggactataggcacatgccaccatgtctggctaattttcgtattttttgtaggcacagggtttcgccatattgcccagactggtctcaaactcctgtgctcaagccatccacccaccttggcctcccactggaaggccagtggaaataactgctgcttttgctaagctgtgaagtctttcatcagtatttctttcgtggcccgacctcacaagattattaatgatcatgaaggggtaccttcaatggactatgaatttccaagtctggaaacacatctaattcactgtctctcttccaccattgggacttagctcataggaagcacgcaatagacatgtgagccaagtgaaggatatgatggcactcctaggaccaagacatatatatctgctacacacgcacacacacatatcctcaattagactctaaaaccttcctaagaaagggcaatatcaatggtagtcatcaatttattcctaacaaagcacctaacataacagatgttatgacataacagattccataaatatttgtggaataaatgaatcaatgttggtacctcctttggtccaacacagggcactatgagtttcctgatccctgattttccctgcaaagggatggaggcttgtcttatgtattcctacaacactccatacttcgcctagtatagcacttatgactttattataattgtttgctcccctcatcaacttctcacctgttgtggggcctataattaccttattcacctgtgtaatcccagcatgtagcatagagcctacgactcactaaaaatatgttggtaagattaatggatagatggatggatggggacaaatttatattcagtcaatatgtctttcaggaactctctctcatgaccaatcacacacatctgctagaggtaaatgaaagaatgaatgagtaacttgctggctggaaaatgttagatgtgatgtaatttgctggctggaaaatgttaaatatgatggctgttggagaagccttcagtaacttacagaatatggtgacctggcttcaggtctccagagtacttacttgatctttgactttgggaatggccccttaacttccttttttttttgtttcttcacttgtttctttgcctgtaagataaatattatattccttcttagcctgctattcagagctcttgaacttcctcattaattatattctactgtgagccttccactccaatatttgtcttgcctttagtccttgcccgtaggactaaggatccaagaaacagatagataccaatacagagatggagacaaagacaagacatagatgggaaggtggtataggagaatataattatgatagtggggtatggctggagtgcttaaatcagacacacgaagcacaaacctgaaaggacgggatcgtttacatgattatttacacaaaataaatttctgccagataaaaataggaaagtcaaagttgaaagataagacacagtctgggaaaagatatttgccatgcatataatacaaaagatgactcacactgaagcctgtaggaggcatgcagacctggatgctatcgcagaaattctagttccctattaggaatattaggtgagaaggtgtagatctacaactaatgggccaagaagggcacataacccctggttacattatctaagacaagtaagatctttatatggtagaaaaaaaagtcaaagttccagatttggaggctgacttcctggttagctttagttacctctggtctccatctcaaacttgatgcagctaatgccaatctgactgtagcgcttcctccaaaacaaacatctctctttctctctctctcacacacacacacacagagtaaggcatatttttgcttgttccattcctttggcctatcacatttctgcccctcttccttgcccggctacatacagattagctttcctgtatctccctctccttaggctgagcctcctcaagcccacttctttttttatttattttttctttttttcttgagacaaggtctcactctgttacccaggctggagtgcagtggcatgatctcagctcactgcaacctccacctcccagactcaagcaatcctcccaccttagcctcccaagtagctggaccacagacgtgtgctaccatgcccagctaaatttctatatttttgatagagatgggttttcaccatgttgcccaggctgcctcaaactcccaactcagcctctcaaagtgttgggattacaggcgtgaacccccttgcccagccatcaggcccacttcttaatggaggcactaacatggttaggctttgtgtccccacccaaatctcatcttgaattgtaatccccataatccccatgtgttgagagagagacctagtaggaagtgattggatcaaggaggtggtcccccatgctgtcctcaccatagtgagtgagctctcacgagatctgatggttttataactgacagttcctccttcacactcttgccctctcttgcctgttgccatgtaagacttgcctcttccctttccgccatgattgtaaatttcctgaggcctccccagccatgcagaaccgtgagtcaattaaacctctttcctttataaattacccagtcttgagcagttctttatagcagtgtgaaaatggactaatacaggcactataccacactgtattataatgcctgcttccttgtttgttccccacctcactacaggctgtgagtatctccaaggtcaggtcaggcctgggtcctacttacctctttttctttttttttttttttgagacggagtcttgctctgtcacccaggctggagtgcagtgtcgctatctcagctcactgcaagctccgcctcccgggctcacgccattctcctgcctcagcctccctagaagctgggactacaggcgcccgccaccatgcctgggtaattttttgtatttttagtagagacggggtttcaacatgttagccatgatggtcttgatctcctgacctcgtgatccgcccgcctcggcctcccaaagtgctgggattacaggcgtgagcctgtacttatctctttatcctgcatctcacacaggacctggcctactgaaggaagagtctcaatgattgttaattgaactaacccaacccatgaacaaaatgccacaggagcacttcatgcagtgggtgaagaaagaagaagcaagtatcagaaatagtttcacagggtaggtgacattaaagctggatcttgaaagatgagaagttggcctggtgtggtggttcatgcctgtaatcccagcactttgggaggccgaagcagacggatcacttgaggtcatgagttcaagactaggctgtccaacacggcgaaatcctgtctctactaaaaatataaaaattagccaggtgtggtggcatgtgcctgtagtcccagctacaaagactacagcttgggaggctgaggcacaagaactgcttgaacccaggaggcagaggttgcagtgagccaagatcccaccactgcactccagcctgggtgacagagtgagactctgtctcaaaaaataaaaaataaaataaaaagtgactagggcaatgctgtatcatctcactttattttaaataaaagaaaaatgagaagttgtaaaagataaactgcaacaacaagctacaggggatctgactagtgtccacggattgcttcacagaggtaatgaaatatcatctgatgttattgctatttagtgatatttattttctttttagtaataatttagttatttagtgataattattttcttttctttctgatctcggctcactgcaacctccgcctccccggttcaagcaattctcctgcctcagcctcccaagtagctgggattacaggtgcccgctaccacgcccggctcatttttgtatttttagtagagacggggtttcaccatgttggccaggctggtctttaactcctgacctcaggtgatccgcctgccttggcggggattacaaccatgagcccccacgcccggccgagataattattttcacatgaattttggcttccccaagacaagtttttgtctgttttattcagggatatatccctggtgactagaatagtgcctgttacatagtaagaaactcaaaaatatttgtttaattctttagacgcttatgggggatatataggaattaaaaaacaatacaacgtaatagagcatggtataatacaatactgctatttgataactctgtcatggagtagtagttccaccagagtagcaaccaggtctatcttgatcccctgtatccgttagtacaatattggtgctcaatatacatttgtgaaaaaaattaattaaaatacaacgtaatagagcatggtataatacaatactgctatttgataactctgtcatggagtagtagtccaccagagtagcaaccaggtctatcttgatcccctgtatccgttagtacaatattggtgctcaatatacatttgtgaaaaaaataattaaaatctagaatactattacatcctaaaaccgtaaaagcagagtgtcagaagggatatatattggttttgattttttttaaatgccggcttgaaaaccgagttcagatacatgctatctggctttgggtaggttctttagtttcctcctcatctaacagggctgttgtgggactcagtgagagagaggatggctggaagtgcacataggatactgcctggcagactgtaggcactcagtaaacgcgagttctccgttaacacgaaaacattacaaacagctaaaatgacagctgcttgagagaataatcggtaagtgccacaaccgggctagaaaaggatgaaggacaagctcctgcccactcctttggaaactccacacctgggccggagaaagactcgaattcgaaaactaagtttcagtcgcacctgcctccggcgtcgcttcagcctccgaggggtctgcggaggcgacgtcccagtcaggagggatgcgcgcctgcgagccccccggggatctcggagccgctccactgcggtgcctgccgctatcttccccacgccttagtaactgcgacgcgacggcagacagtgtaggcggcaaccgacggccgggacgtctaacctcaagtcccagcaagccccgcggccacgtcctctgactacctcgcgccagcaagacccaaactacggatcccgattgactccgcgcggcgcgtcacgctgtcagctccagccaatcggcttcagacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataaggtgaggagccggttcttgggaacagttgaatcctggggaggcctgggaggcggcgagccaaccttcccatcccggtctcccttattttctacggccttttgaggggagcccttgtgtgaccactatcacaaccctacgcacgcttggagcctgcccttgccctcatcacacttcaaacctggacccggtcctctttagaacttcttcttttctcgcaagtgttctggtcctggtcgccacacctttttcggtaatttgatttttcctatatttaatcgtgtccatctcttttctcctggggggctgggtgcactgttgtcagtgcccatttcacagacacggaaaaccgaagcccaaagattaaagaatcagtatcccccaaactctctaccaccatcacccttgcgtgctgctacagattccaaagtgcttcttgtccttttgcttactgaagtttttaggcgttttatcatgataggcgaatactgaaaatatttgagtattgactgttctactgggctgacaagaagcctttaagatttttctttttttcctgttgtttttccccgccctctcctctcttccctccacctccctctttgctaccaagtgcactgctgcccgctcacgcttgcccctttcctccctctgctcatccaaaaaaattttttttaactgcagtcctagcaacaagggtttaaaagaaaagaaaaaaaggaaaactgtccctgggttggcctttcttgctctttgcacagcatcttggaagaaacagttgcacggagaacaacgtcctggtgttgattttgcctctaattagctttgtgaccttgaaatatgcttgctctctctatatctgttttctcatctgcaaagtgagagatttagccttaaaatgagggacttaactctaaattcccttccagttctctcattgtagggccctgggctggtttgatgagaattgttaagcatggtgtctttaatatagtaagcagaatttttgaatataattgaaaacagctttcagacttccctgtgcataacacatggtaggtgcttaagaaatgaaaacatgattatgttgaggggttaagatccaggtctttttacttgtctttttgagtgtcattggttttgaaagacatggttctcacactcttctcttgtgagaggggtcacgctccattgcccagaatggatcttagctcactgcggccttgaactcttaagcttaggtgatcttcccaccccagcttcctgagtagctgggactgcaaatgtgcaccactatgcctgactaatttttttgcttttaacttttctgtagagtcagggtcttactgtgttgccctggctggtctcaaattcctgggcctcaagagatcctcccaccttggctccccaaagtgctgggattacaggcataagtcaccatgcacctggcctcacactcaaaccttaagatacagaaacatattctggaggttgggatggtaaattgcttcaagacatgtgagagtatggggaattgatggtcatttgtgtacacaaatccttccctcttgctaggtaagcacctcatagcctgtgcttacctgccccactaactgctcttgctcttccttgcacttggatcatcatcagcaaacattaagtatgggcattctgctaaggcagtatagaatactattattatggaatagtgtatatggcaccattgtgttattgaaagaacccggatgtggggatcataagatttcagctttgaagtatttctgctacttgctaacagtatgaagattggcaagtcacttaacctttcttcatttggaattttggaatctctggcacctagatcacagggttttgggaagaaccaagtaagacagtacacattaatgatctccattacctgtagtgtccagtacagatgtgtgatggtggaggagtaaatcaagaatcctactgtcagagagcactcagaatagccaaatataggagatggggtaattgaatctatttaaggaagtatatggtatattcgctcaagtgtgtacttgttacggaagttcaaatgagagaaatagagtgaaccctgcgagcttattgataagagtaagagcctcggccgggcgcagtggctcacacctgtaaacccagcactttgagaggccaaggcaggcggatcacctgaggtcggaagttcaagaccagccagaccaagatggagaaaccccatctctactaaaaatacaaaattagcgaagtgtggtggtgcatgcctgtaatcccacctactcgggaggctgaggcaggagaatcgcttgaacccgggaggtggaggttgcagtgagccgagatcacgccattgcagtccagcctgggcaacaagagggaaactctgtctcaaaaaaaaaaaaaaaaaaagagtaagagcctgaaggaaaggcctcattcctgaaagtggaactggcaccttatttggggggagaaaagaaagacatgccaggtaaaaaagtctccttgagtaaagttacacagatgtgatggtgttttatgtttctcaggtattgagttgactagaaggctctctaaaggaactgtagtgacaagtagatagcatctgattagggaggccgtggattgcttgaagtagaggaaagctgttgaagggttttgagactgtgtaaagtggtttttaggaaaactattcagatggtttggagagacagaaattagaagacttcttaataaggccgtatacacagtagtgtataatatataataaaaagagacaaatttgagttctagtgccgcatgttattaggttggtgcaaaagtaattgctgtttttgccattgaaagtaatggcaaaaaccacgataacttttgcacctacctaataaaagccacatgaccttggataagttgtgtgatattactgaatttaaatttccttatgtaaatattgtggacattcatacatattataggcttgttgtaaggatcaaattgtatagtgctggtaaatgttctttgggttttttagtttggtttcctctgccctttttattttatttttatttttatttttggtagagacaaggtctcactgtgttgcccagactaatcgtgaactcctggcctcaagtgatctgcccacctcagcctcccaaagtactggaattacaggcatgagccaccgcacccagctctgttccctgtcctttggaatctactagaagtaaatgttctttgtaaagggctgtctgtggtaaaaaatagaatgacaaggtgatgagaaccccaacatgagtagcagaaatagataaaaggtctcacaaaagagtgcttggaagatttaaccaataagtgagggacagaagagaatagtcaagagctgcttgagtgccttttcttggaaaacttagtttcagccttacattgaactgttccctccctgaattcctctagcacttacactgcacatgggaattaagctgtcacttaatatgacatactgtcttgtattatttcaccaatttgtatttgcccgttttcctgtgagtgcttctctgtagtgatcaacacaagataagtacttttagcattgaatttcgcagagaaaaaacttgagatctgccacctcagtcttcagaaacagctttagaggatggtgcctctaattgtttgaagactgagggtactgtgggagagaacttggggaaaaaaatgttattctcagtggagcaggatctgaatgaatagagaggcttttgctgtgtgggaatgagaagctattacctttaatataatttttttttttttttgagacagagtctcgatttgtcgcaatctccactcactgcaacccccgcctcccaggttcaaacaattctcctgcctcagtctcccgagtagctgggattacaggcatgtgcctccatacccggctaatttttgtatatttagtagagacagggtttcaccatgttggccaggctggtctcaaactcctgacctcaggtgatccaacggcctcggcctcccaaagtgcggggtttacaagcgtgcgccaccacacccagcctaatataatttatttaatttgatgtgtcttgatttgggcggggagggtttttattttatttctgcagctgtagtttcacttgccataaagaagtgtaataaagagatgcaaatatgctcctagttttccctaagcagatgtgaatttctactcttatgaaactgactttaagaacacagcaattcttgtttcctgatcttaaaaataagtatgcaaatataatctttccgcctccatcacagaataacttgacttagatcattgcagtatgttattttgccccaaatacatcaaagcattttcttctgcctggcagttataaagaaaagctgcttgcttaatttgttttggctattaaagttgatatgtggtgttaaaccatgctttccagaagctattatctagacccttttagccttatacctggatttctgtctcctggctggcctgtcagcctgatcttaaagcacagctttaatctgtttacatcagactcctttgagaattagttaaaattaacagatttttggacctttttttaggcctgaatatctgcatttttcttcacatgtctctattacctctgcattttaacagttacctccaggttgagaactactggcttaaatgattttttaaagtctcttctggttctgacattttaaggtttttgttttgtttttaaaagctattctgcttaatagtggtttctttaaaatgtttataatgaagagatcctgaaactcatatgatacttcagcctcattttgtagacaaggacacaagcaaagcaacttgcccaagaccacacagtgaattagtaacacttacagaacctggctcccccagtgcttaatccagtgctctttctttactcagcacattgcttcccataccagagtgtgccttgtgctatctaatgtgctagctaacgtagtagtgggatgagcatctgttgtgaggtggaagacctaggctgtggccttggctttgtcacccaccaaccatatgtccttaggtatctcctcttttactctactggaagatatcttagcttgtcagacttccaggtgatatgcttgtgccctgttacctagctctgacaaagaagatgaacggttttataacattactataattgtgtgtgtgtgtttaatgaaacaaggtgctggccttttaatactgttgcaaactgatctttattagcgtctcaaaactcattattttttatttcctcaaaataaaaagtatgtgtgtgtcaaaggccactatcaagaaagtgaaaaaagacaatctacagaatgagagaaaacattttcaaatcatatatctgataagggtctagcatctagactatataaagaattttacaactcagtaataaaaagacagcaacctagtttttaaaagggcaaaagatgtaaatagacatttctccatagaagacgtacgaatggcccatagcacatggaaagatgcgcaacatcatcagtcattagagaaatgcaaagtaaaaccacaatgagaaaccacttcacgtccactaagattgctataataaagggggaaaaaaaaggaaaataacctgttttggtgagaatatggagaaatcagaatcttcatatatcgctaacagggatgtaaaatgtggtggcactcttggaaacagtttgacagttcctcagaaaattcaacgtaaagttaaccatatgacccaacaattccactcctaggtgtatacccaagagaactgaaaatgtgtgtccacaggaaaacttggcacacaaatgttcataacacagttatcataatggcctaaaggtagaaacagtctgtcagctgatgaatggataaatgcaatgtgatatatctatacaatggaatataatttgaccgttagaataaagtattgatacatactacaatatggatgaatcctgaaaatgcgctaagtgaaagaaaccgatcacaaaaggccatatatagtatgactgcatttgtatatccatagagacagaaagtagattgttggctgcccggggataggggacaggaataagatgtgactgctaatgggtatggagtttctttttgagggtatgcatatattctagaattagatagtggtgatggttgcataaccttgtgagtatactaaaaaccactgaattggcattatttttaaatagtgaattttatagtgtgtgaactatatcgcaattttagaaacttatttttgtctttcctggagtaacccttaaagtttcaaattattatttctttaaactatatgtcatgtaacacagtggtatcacagacactgattactttaatactattactttaattactaattaaaatatatatatatatatatatatatatatatatatatctgcctgcctaggtacctttttcagctgttgctagcaccatttctctgctctgatctccatcttatcaaatttcaatagtagttttttatattacttagcctttcagtagcatttgacttattgatcacttcttttttcttgaaatactttctttacttggcttctaggacaccacttgcccccagctttcctcctacgtcaactagtctttgttgtcttcattgttctttggtcttcttcctgacctgtgtaaatattgccagtccctgagcttatgagcttattacccctggccctctcctctgtctaccctcatcccaaggtgatacccaatgtcatgacttaaataacatgtagaagttgctgacttctacatttatattctcaacctggacctttcctataagtcccagacttttctgtccaaccgcctacttgtcatctccacttaaatgtctaaaacatgtatcaggcatcaatagccagagccaatctcttgatttccgcttacccctcaaagtgcttctctcccagtcttcttcatttcaggtagatacctccattcatctaatttattcaaacaaaaacctgagagttacccttgattcttctctttgctttgtactccacagccatctcattgtcgtattttcctggctgtacatccagaatctgaccactcctacctagagagctgtagtagccctttcaactggtcttccagcttccgtgcttggctccgttacattttgttctccacacagcagccagactgatgttttaaaacatagatcactcactctcttgctgaatctctccagtaacttcccatctcagttagctaaactccaaatccctaattgtggcctattttatagcccctgcatgttcttgatcctgcttgtttctgtcatcctcatctgtcagtttctgcttgagtcattatactctggaaaccctggcttttctgctgttcctcaaacacgttaagcttgggggattttggtgtactgttttcactgggacactccagattttctcatgggttactcctttattcaactctgctcagatgttaactattttccctcactattttttagtctttttaaaaactctattgcatttttctgtataatcttttttagagcctggaattatatgcgtatttgtttactttttatcttccatacaagaagaagctctttgagtgcagaatttgtcttgtttatgactatatccctagtggctagaacagtgcttggcacatagcaagcagccattcaatattaatttaaagaaaataaagagtgtaattgccataaaggttgtgtttaaaaatattatttttttcttttaaaagaatgtccaacactggaatgaattgctattgagaggcttggcagtttccttaaaaagaaaaagaaacccagaaaagtcatataacagttaatatttttccaggcagtaggagatggatttcagatgaaacggctgtatggtcctctccctgaatttgcactcagctgcatttttcagaactgattgcatgtaattcttaaatggagcacgtgatctgccacctttctagaataaggactcatcgcacatctgtatcaatgtagtacattcctagccagtcttcgtgccttaattcaggtcttccttggcagcatccctctctcttccaaccctccccagtcagctttgctgcagattgatatccctgaggaaataggtaacattttatccaaaatcttttttgcagatccttgaacttgtagtgtgcccttgcccctctatgtctacttcttaccatttagcacttagcatagtttataattcattgtaagtataggattttccttaactaaattgtaaagaccattttttttgtatatctgatttcttgtctacccattgcaaaggtaagaaattcatactggatgattatgccaacaattcagtcagactttagaagatgttagttgctagtagtgaaaggattgttgactacatttcagtttgctggtagaaaaaaatacttcgttgttggagcattactgattaatatgctgaatcaagttgttttaactttaagctcttttcagccttagatctcacacttactgggttcagtggtgggatgtttaagtcatggatccagtgatctggccctcaaagagcttcagtcatgtaggcttctctattcatgggctgggttgatgtagaagcagccccgtcactgctaaatgcagtttgtggtggagtagagaaggcagtgtaaaacctaagaatcagtttctctggggttgtcactaatgtgtgtgctcataatttaattaacacatggtaatttcctaacttctaactccagtgatgaatgcagtcagtaataagcactgttaagctagtaattttctttgcagtgtatcttggccatttttataaaaaatagattgaaattgaagattcagtgtgttgctaagagcataatctctttgagataccatgtttttgctgaattgggatctaaattagatgacagtgcacattcttaagatagacatcattttcttcccaaactgaacattttcctttcttgctaaatatgtgtgtgtgggggggatataggcactatatatttccaactgaaattgtaatctcagcttctgagtttgccatcagtttttattatctccttattttagtttagaactccacatatacaaatgggtatttatcctttttcctcctgtattcttcttcttggaaaatgacatgatggctccaacaagtcatccaagccctaattctagtaggtggtcatctctgtctcttctctttcatgttccttataactagtctgttactaagtcctgccaattctacctcagaatactccctttcagtccccctactgctgctctgttgagcattgaggctctgcacttacatcaggccccatctgcatctctatgtccagtgttactcccctccagatcatctgccaggttgccactaaaatgacttaaaaaaaaaacgtaaatttgattgttattcccatgcttaaaatactctccattgcctgcttcagaataaagttcaagttctttagcctaataactaggaaatggtttctctcggatgcctcatctcctactactttccccctttgcagcttctgtctactttctaaactgggataaaggagagaaaaagtttatttttcttaaagccatgctcagttctgtctaaatcagaacagggtcaccattgacaccactctcacccttggtaattcttcatctctccagtgtgaattgaggaatcctttgagtcttattatcaagccagggaactttatgaagcaatccactcaggtcttttatatcactgcataacttctgttttcactgtgattaaaataagataattgaaggtgttcatgtgtcatactcaaaacaattttgttttgctggacatatcctaatgaccaaggattttgtccttttgttttttgagatggattctcactctattgtccaggctggagtgcagtggcacaatcacggctcactgcagcctatacctcctgagctcaagccatcttcctgcctctgtctcccaagtagctgggactttaggtgggcaccaccacacctggctaattttttaaattacatttttttgtagatacggaggagtcttgctatgttgcccaggctgatctcagactcctgaactcaagcgatccttccaccttggcctcccaaagtgctgaagttataaacatgttgccactgtgcctggcttattttgtctctttttttgatcccaccctatccctttgagtgtggtgagatgcatgggaacagaaggctgtattccctcaaatgagttaatttggaaaatgccttcctgtactgactacatatccttcagacctgagttgtgtttaatatccttcctaagcacttatggagttcctgatgccataccttcagtgaagtgtctttgtagaattttttattattcaaatgtgcagtggagaaacgtaactgaaatgattcttcataatgttctattaaagctatcaaatgcctgttttctttgaactggttagccagccagctctggcatcaggtgtgttagtctgacaaaagttgtctttatcttggccgggtgtggtggcactttgggaggctgaggtacgtggatcacttgaggccaggagttcgagactagcctggccaacatggtgaaaccccatctctattaaaaaatacaaaaattagctgactgtgatgacacttgtctgtaatcccagctactcgggaggctgaggcatgagaattgcttgaacccaggaggcggaggttacagtgagctgagatcgcgccactgcgctcagcctgggtgacagagtaagactctgtctcaaaaaaaagttgtctttatctcttcagtgggtggtgtaggggagtaatttctttaagatagtactttttgagctctgttttcagccaaattgcagttggttttacattggggggggaggttcaacatttttgataccctgtgagttttgtggtcctattcaagattaacatcttttttttttttttaggtttttaaaatgttattactagagcttgttaggaatcaagatacaatgtatagctgtcacttcagggatctctttgtttcctgttctttgtgtttttgatggctaataattcctttccttgcacttcatgggaaagcagtgtagaataatgagagagcatgggttttgagtcctggctttaccactttctgcctttcacctttggcaggttttttaaacccttagtgttatctgtaaaaggaggattttaactgttcttaccttgtagagttattgtggaaattaagtgagatagtgtatataaaatacttagcacatccgtagcacatgttaggcattcaggaaatggtagctatgattataccttctgtctgccctccatcccttaaagaaattctgtgaataagaaccaagtgagatcattttgaccatgtttacatttgctaaatttaaactggagagtaacattttagagatctttttcttccctttttttctttataaggatttagacattaaaaaaaaaaaaaagctattgagagtatattgtgttccaggctctgagaatacaaaagtgtatagtccctgtgacccagtgagggagacaatacatacagtcaggtaaccatgatgcagtgtattatatagttttatatcattaatagcaacagcaatagctaatttttatgaagtacttgctaggtaccaggcactgtgcactgtgctatgttttataattacactatttacttctcataccaacctgtgaaatagatactttcaccatcttaattttacaatttagcaaactaataaggctttagagaggttaaattatttgcccagtgccttccagtattaagtggaaaagtgaggattaaaataaagtagcctgactccattctcccttggataataaggattcaccttattgggtaaggaaaaaaagcatttgcctacatacatttgtatttagtctaaatccagtcagcttgttttttgttgttgttgttgtttgtttgtttgtttgtttgttttttgagatggagtcttcctctgttcacccaggctagagtgcaatggcaccatctcggctcactgcaacctctgcctcctggattcaagtgatctcttgcctcagcctcccaagtagctgggattacttagcctggctaagttttgtacttttagtagagatggggtttcacaatgttggccaggctggtctcggactcctaacctcaaatgatccatctgcctcagcctcccaaagtgctgggattataggtgtgagccactgcacctgaccagaaccaatcagcttgtgatttgaagtacagtacacctttaagaataaggccacaatctgctttgggattgagttcagggattaaggcaaataaaaataagtttatatcactgaagaagagacagttttataatgagccatgtatttgtaatttagccctaaagaattttgttggcctgtcatttactatttgtatggcacttaacatctttgaactctagttttctaatctgaaggacattggtttctggattgagggtctgcttagtgctgcaataaaaagatgagtggcaatagcagttttacagtgggtgaaaattgacctgtgtaagggatatcatcttgaaattttagatactggcaacataaagaactttttctagatttccagaaggaaaggtgttcaacataaatcacatcatttatacaaacagttgaggcacagtgagccattcttatcactgagggaatgtatttatatcagtgtagggatttgttttatcagccagcttgtcagataccagccaagggccaaccttgcaaacaagccttgctaaagatggcagtcttggacccaggttcacttatttctgcacactgcccttctttttaatttatcctgtgaggtcccacataaaagaaactaatttttgctttctctttttattattacaaaaggaaagcaatttgcaattagtgttgaggaagacaaaattgaggcaaaaaaaaaaaaaagatagcttttaaaatacccgaattagtagtagagagaacatgaggagcagcatacattttagttgatgagcagtttttgagcatgatgagaagtaataatcagaaaaagaagcacctaatagcaactccccttcttccagatggttctccatactgtagtagagacattacttgcttcgaaatgggctgtgttgccgtaaagtcaaattataacctttcttgtgatttcatgtaattcactggaaatgtttcttttccacttactgaagattgcttctaggtaccaggcagtgaagttagagctgaggctatttcaatacattgtaatggctgcttctgcattttattctcccaaattggttaagacattatcctctgacttttaaaggcaagtttcttttctgtgatgcaatgcaggcagtgaagtgtggctaggtgtctgagaatatgattttcctgtttttgaatgacccataatttttaaatgactttattctgactttatttcacaaataattcaaatgctatggtggatttggctctacaagttggttcttttgcatgtcttcaaagagggatttacttgacagtgtaaatgagctatctagctagaaaacctgctaatttctttttggttcagtttgtatctttaaaattagatgtcgtgtttgatttgtaggctggcagtctatggcagtcaatagtgcagtatgctgccatgagtaattttctcaaagaaaaatttttgcttttacagggcaccaagggggaaaaaaaacttgattgacttttaatcactttaagtatggctatttttagctcatgttatttcttctaacaaacttcacagaacaggttttctcttttgtgtaataatatatagaatcacagttaaaaaaaaaacaaggttgatgaattgtatttctgtagttgtttaaaatctttacaattatttttatcccatctcttattttattttttattgtttgtttgtttgtttgtttgtttatttatttatttatttattttcagagacaagctctcactatattgcccaggctggactcgagctcctgggctcaagctgttctgccacctcagcctcccaagtatctgggatggcaggtactcaccactgccatctctttatttcttataggcattatctttgtacttgtgctcaatccgaaagataaatatgacattctctgtctttcagtaaaataatccattctaaatccagatgaacgttggattgcttgctggtttgtaatttttatggaatacaatatttgttcacttgatctaaaaaattaagagttggccattaatggtctacaaaaaacaggtttgtcagattatttgtagcaccctgttcctcttaagctatatttacttaaatacttgcatttgagaaaattttttactatgtaatatattcacatggttaaaaaattttaaaggcacacatagagtaatcttactcctccccgtatttctctaccctgataagatatctggatgtaccgtagtttgtttaaccaatccccttgtaaatgagcactcgagttacctccagcttttcactattacagacaatgctgcagtgagtagccttgtatttcatttcacatgtattcagttatagaaacattcctggaagtgggaagttgaattcagggtgctaagttggcattcgtaggtgctgtaacattttgaacttctacatgagcagtgagagaattatttgcttctgaatagcagtgtttgggaaactttctaaacctctatagataagggaaatagaagtagagtttgtccactcaactcgtgttgggactgagtctgggacttggtttgtaatttaaaatgtagtgttgtttccaacaggctatcctggaattgctatcttaaagttaagacatgctggtaaaataataaaagttgttagctgacaaagtgatattaaaggagatcctccccattttgttagtatctgtaaattcatgtatctgtattttctgagttttgtggtcacagaaagaaagaatgaacaaatagagtaattttctgtactcacatttcggtaaaatgaaggtgggatatacaagtttacacttacagtctgtgcagcccatatacgttttctggttctggggttgtttttatattctctgcatggagactggcaacatcagcatcacatgagtaccacctgactctagtgacctagtctctttcaacctgatttttaattgtttggtcttttttgtttgtttttaactgcttcttgcagggctaccccataggagtgtgcccagaatagcctgttttgtcttttagttctgcaacatcagaagacaaagagtaaatattatatgtgcatgagggatgctcttaaaaaatggttcattttactttcagtaagaggccaggtttcttgatgcacaacttttttgtttgttttacagtggaagatagatgataagcctgtaaaaattgacaagtgggatggatcagctgtgaaaaactctttggatgattctgccaaaaaggtactttcttgaggaggggttggttagtatctatacagctgatggccatctctcctgggaaatcttttccttttgtaacttggagtgaccttagttttcagtgttagaaattaagtcagaaagcagtttctaaaatttctcacagaaaaagtcagaggaagtgtgttgaaatatcaccaacatggcacatgtatacatatgtaacaaacctgcacgttgtgcacatgtaccctaaaacttaaagtataataataataaaattaaaaaaaaaagaaatatagatgttggctatctcaagaaagctggtaattttttgtttttgagattaattagcctagagcacagaagggtgagagaagataggacattcattcatgataaatcatctctccatttgtaaaagtaaaacattttagctgtgggaaaagttgaggagtttaaagttttttatatgagggattgatgaactttttctcttggttctttatagaaggcttgagttttacttgtttggtgtggtaaaatcccaactggagggaactacttggtaattcatatgattcttttatcatggaaatcaagaataaaagcacatactggggaggaagtattcctattagcttgattccttgtttttctcaccaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcatatcctttatttatgctcaggttgttttctagtgactatttttttaaatctgctgatatttctccctacaaaaaacaaaacggactttcatattagggcttgctaatgttagaattcaacattttgagctgtgatgtttatatagtaaatatctatcagtttatatagtaactgtcactgatattttatgttttgtatggttattttatcgtaattcatttttgttattaatgtagaggttattgtcctaatatgagcacttaatagcaaaacacatagtaatagtgaacccagctcttctcatttctagcccagaacttttcccgttagacgtggctgcttcaagccactcattctaggatattaggaaaggatctgattttggagactcagatctgtattaagtttacttgaagctgaggagctgaactggaaagtactgagcatgagatacaagtgtggcttgtattacagtggaattaagaacttattctggagctagagaatatgggtttgaaatccaaggtatctgtgatcttgtgctaatgaaaatttacttatttttgagatgatttgaataccactcatttataaatatgggtagcattcagaattatcataaagattaaatgagagattttatattgtatttgatacataatcatttcctttcccctcttttttatgataaatgtaagatcatggtcgttgcctacccagcgtgattttttttctcaagaagttgaatataaagaacttaattatacttcactattaaaataggtaattttggttggtagtttacttttttaaacaatgttaccactacctaaattttgttttgttttcttttttttgagacagggtcttaccgtgtcacccaggctgaagtacagtggtgtgatcatgactcactgcagcgtcagcctcctggctcgagcaattctcccacctcaacctcctgagtagacgggcacatgccaccatgtctgcctaatttttaaattttttacagagacaaggtcctactacgttgcctaggctggtctcaaaactcctgggcccaagcaatcctcccaaagtgctgggattacaggcataagccactgtgcccagccaacctgaaatatgttttaaaacttcatgttggggatttatcttcagaggcagttagcaaacctctgataaagcagatcctagtcaaaaattgtattatccagattgccccacatttcccccagaagtggcaccaggtgatccttgactcctttcagtaatcagattaatcatcccagtatgaatttttcactattaaggcagttcagaagaataatattccataggttctagagacagttcccaggggaattccaaagagatttgaaaatgatagcaacattattacaaatatctggcctcccaagagaactaccttgatggtaattcatttgtttggttatatttgtttaataaaacaaggtcttatttttgtcatgtcagttttatttataatgtagggactaccattataaatgtcttctgttgctgggcatcgtggctcatgcctgtaatcccaacactttgagaggccaaggcgggcgaatcacttgagcccaagagttcaaggccagcctgagcaacttggagaaatctgtcactactaaaaatacaaaaattagctgggcatggtggcgcatgcctgtagtcccagatagttgggaggctgaggcacaagaatcacttgaatccagggggcggaagtcacagtgagccgagatctgctactgcactccagcctgggcgatagagcaagactctgtctcaaaataaataaattaattagataaaataaaaaataaattagctgggtgtagtggcacacacctataatcccagctactgaggaagctgagatgggaggattgcttgagcctgggatgttgaggctgcagtgagctgagatcatgccactgtactctagcctgggtgacagagtgagaccctgtctcaaaaaaaaaagtcttctgtatcctagactgcatatatccttcatctctaaatctcatgataattctaaaacatcagtattatcccaattttaaaggtaaggatactaagacttggggaaggaagttatttgttacaatcatactgattaaaggccaagatttaaatctaggattatctctactctaaagtccatatactttgtactatattttcctgcctttcctgttcatgaaatttatctattttttaactcttctttaatggaatgcttcatgaatttgcctgtcatccttgtgctagggccatgctaacctctgtatcgttctaattttagtatatgtgctgccgaagcgagcactgttcatgaaatttatttttattttatttattttatttttattttttgatacagggtctcactctgttgcccaggctggagtgcagtggcacgatcttgcctcactatagcctctgcctcccaggttcaagtgattctcctgcctcagccacacaagtagctgggattacgggcctgcaccactacatccagctaatttttttttggtttttgtgggttttttttgtttttttttttttttgagacagagtcttgctgtgtcacacaggctggagcacagtggcacgatctcggctcactgcaaccctgcaacctctgcttcctgggttcaagccattctcatgcctcagcctcctgagtagcaggactacaggcatgtaccaccatgcccagctaatttttgtatttttggtagagacatggggtttcaccatgttggccaggctcatctcgaactcctgacctcaagtgatctgcccacctcagcctcccaaagtgctgggattacaggtgtgagccaccacgcctagccttaatttttgtatttttagtagaaatggggtctcccattgttccttgttggccaggctggtttcaaactccaggtctcaagcaatccacctgcctcggcctcccagagtgctggtattaaaggtgtgagccatcgtgcccagccttgtttatgaaatttaaatggcacagtatacacaaagctcttatgccagtttttggcaaactataagtgcttattaactatggtacttaatactgtcaaaaacaatataataataagtctatatgcatataggaagtaatcgtagtactatttgacatactctcttatagtaaactatttgggtcacttttcttctcttaataacccttaaaatcagttgaacatggtcaagtccactgggactattcgttgttttttataaagaaataagcactattataacaaagtcttgacaaactaggtatcttattatacatgttgtctttgaacataaagatgagagctagtttatgctctgtatctttttcttttcttcctttctgaggtgtttgcagaattaaccagagagagccttgcttctcttggtatataaacataaggatgaaaatgaaatagctaaattttcagtgttttggcagcaagacaaagctgtcttctttaggactatcattatgaaagtttttatatctgttgcttgtcaatttgtgttacttctcttttatgtttgggtattttccccttaactttatttgaacctattttgtgatgatggggattctgaccatttatacctcatataaggagaagagcatctttctcgtggcccacaggaaagatcctacaggaatggatcctgatgatatttggcagctgtcctccagtcttaaaaggtatgactatcctcacagatttttaaatcctggtgttggatttgccctggcatgttgtcattatcaacagaagacttattatgtgcctactctatgtggatcatagggctagtcatataaaatgaagaaaggagtatggatgatctagaaggtttgtcctagccctatagttctgagattgcgttatcacagaaatgctctgaggataaactgtgggagaaggtactttttcctgtggccagttaacagagacgattaagcatacaaaagtataaaggccaaagatgtgagatcagttatctttgaagaattccattagcttctgtgtcttctatgatcctgtcttctctccacgaatacaatcaagaatatctggagcagtgcactgggcaactcaaaaaaagcacaatctagagtctgtttctgaccagtgtcaggtataactttgtgcagctgacacacatgtgttttgtaggtaccaagaactaggttcatgttccaattcagtttctttctagctgtataactttgggtaaatcatataaattatctgaggtttagtggggtcaaaaatgatgcctagagtttctgggaagatgaaataccaattataataatagcaaatgtttattgaacatttactgtatgttgggtattctgctaaatgcattatctcattaagttttagaacactcattttatagataagaatacaggcccaaagtttaaatcaactcttccagtatcatatagcccaaaagtggtagagcaggaattccagcccaagtttgaaaccagaattcatactcgtagtcactatcttaaaaacctattatacttaactggtgcataatagccgcacaaattataggtacaattatttatatatgaagttaagtgtagcatctgtgccatacagactgtctcattgccaacttgtagaagcgcctatgagaaagggaagcagaccttcattctgttgttgcagctgagttcttgcttatctcctgacagggcttctagctgccctttggcctcagccatcataatctgcatcctctaccaggccactgaagctgagttgcagaattctaaaacctagcggcattataatttcattatttttattctgacttttgtattttttaagaacttttatataattcacctaccatacatacagttcacccatttaaagtgtacagttcaaaagtacctagtagtatttacagatatttgcaaccattatcacagtcaattttagagcattttcatcacctcaaaaaaaaaacctctgtactctagctaatcacttccctatcctcccacttgcctgagccctgggcaaccaccagtctactttctctgttctcttttatggacatttcatatgaatggaatcatacaatatgtggtcttttataactgggttctttcacttagtgcaattacttcctatgtatactgcacacaaggttcgttcatgttgtagcatgtatcagtacttcattcctttctatggtcaagtaacattccattttgtttatccatttgttgacagacatttgggttgtttctactttttggctattatgaataatgttgctatacatatttgtgtacatgtttttaggtagacatgttttcatttctcttgggtaatacacctgggagaagacttgtatggtatgctaactctctttgtttgatgaactgccagactgttgtccaaagtggctgccctattttacaatctcactagcagtgtacaagggttctgatttttttcacgtttcctgctgatttttaccaactgccgtattgttggtggagtggaatgtgaatgttcttgctctcttcccggctttctgctgatgtcttctccctcccccacctcaccgactgatttagtagcttaacagtggctgattctgatgtcttattcccactgccaggtcatgtgatgtgaaaatggcaatgaaaggtttcacagactactagttgccacgtgcagacaacacaagctatgtgactctctcgcaaaaagtgattttgtcactccccagcaaattcattatacagtctaaactccttcagcatatgaagtattacagcattcatcccctagtgacatctccagctttcttttatgcccctctcaaaatacattctcttactctggcaatattatggaatttgcaatatgctaagttatccaagtttccagtgaccccgtacctttaaacatattcttctctctggcttagctatctttctgtaacctggctcactcctacttccaagaagccttccctgacataccttagtcttccttaacatgccttagtctaaattaggtggtcctagttattctttttttttttgagatggagtttcactcttgtcacccaggctggagcgcaatgacgcgatcttggctcactgcaacctcctcatccggcttcaagtgattctcctgcctcagcctcctgagtagctgggattacggacccacgaccacacccggctaatttttgtattttttgtagagatggggtttcaccatgttggccaggctggacttgaactcgtgacctcaagtgatcgcctagccttggcctcccaaagtggtgggattacaggtgtgagccaccacgcccagcccatcctagttattcttaaaagcatttatgcttacctctgttagttaccacatggagctataattatttaatatctgtgtctcctcctgggcccgccccctcctccaaagtgtgagctcctttaccattcactatacagtagaaacctaagcccaggtgggactttctcactcaccccttggtaaccagacccagcccagggcctggcgtggcatgttttgttatgtgaatgattgacattcatctgggctgggctgcagccttgacctcctaattagtctttgcctgcagcccagtcattgtcagccatccacaaagtcccctataacctagccatctctatgaacattcccttctcttttttttttttttaaacaacaaattggatccactgaaacttttatttaactttgtaatatgaacatttaccatataaggttataagacaatataaaatctatctcatttcatttatagcatagctataaatcaatctaatctctcttattaatgttttatatatatatatatatttttttttttcctgcatacttaggcaatattttccccaagggatatatcattctcagtaaactaccgcaagaacaaaaaaccaaacatcgcatattctcactcataggtgggaattgaacaatgagatcacatggacacaggaaggggaacatcccttctctttcttaccctaagtgaaacctgaccataacctctgaggacatatttccactgcagactgcaagtggtggctgatgtttctctcacagccttcattactccggtactacaggtagagatgggtctctcctttgcagcttccaatgcgtcctcttccctaaaatcccccctttgaatgcatgtcatcacattgtgccacttctatgcctcttctttgcggttaaacacacacctagtcttttgaagataattcctggctcattggcactctctctaacatttgtcctttcttaagtcttggtgattgccatattcacatagatggttattctagtaacttggcctctcagttttacttcctttcttcccattatcctgttttctatcatgccttaaacatttattttcatagacataccctagtagaccttgcaattaataagaacaaattacctgcaataatttcagttttaagtatcccaccctgaccattgcttcctgttactctcatttatttccttctagttctcttgtcacggcatttcttctgccccagtggcatctgtaacccacttcacttcctccttacctggcttagattccatgacacttctgtagtccagttactctctccctgtcctggaggatctttcatatcttccctgtcctcaaacctgctaggcctcctcccccatctttactctcggttttttgttgttgggaagatagaagccatcataagtctaccatcactactcacctacttccaagtacctatctaaggccttccctcccttgggtctatgggattctatctcttctctcttacttgatgttttcctctctgctggatcattccttctgacatacaaatatactgtaatttctcccaactgaaaaaaaaaaaggttttctttccccttctgcttctcacacagtctcctcatttctctgctctccttttcttcttgtgctatcacctggatctgctcttgtctcctttacttgacctgtcagcagcatttgacatagctaattacccttactttgtaatactttttttttttaactaggcttctcagataccacacacttctaattttcttcttaccttaatgtttgttcctcagtctcctttgtgattcttcatctcccatttttttacatttgaaatgccaccagggcttgttctggaacctcttctctatgatgaagatctctaaatttgtattttcatccttgacctcttctctgaactctaaatatattctggcattctttttgatgttggatcctaataggcatctcaaagtcaacaggtccaaaacctaactcatctctcactcatccaaacctgcccttccctcagtttttcccacttcaataaatggcagtgctgtccttacagagctctggagtcattttgactcctctttctcagtccttctttagtctgtcagcaaatcctgttagctccaccatctaaatgtattgtccaaccatttaccatctccacagctaccatcctctctcacatatgttactgtaatgatgttctttttttgttttgtttttttgagacagagtctcacactttcatctaggctggagtgcagtggcgcgatctcggctcgctgcaagctccgcctcctgggttcacaccattctcctgcctcagcctcccaaatagctgggactacaggcaccagccaccacgtctggctaattttttgtatttttagtagagacggggtttcaccatgttagccaggatggtctggatctcctgacctcgtgatctgcccgccttggcctcccaaagtgctgggattataggtatgagccacggcacccggcccactgtaatgatgttgtaatggacttctgcagccctctctccacccatagtctattcccaggacagcaagcaaagtgatccttttgaaacataagtcagatcaactcagtcttttgctcaaaactctctcagagaaattgccaaaatcctaaggatggcttagaagtccatacatgtctattctctgcactccacacaccgatgcaaacataccctcatctccttggctctcatcctctcccacttcattctgttcacattaggcccctttctgttcttaagacatttcagggatgttcttgcctcagggcctttgcacttgctgttcctttttcctggaacattctttttccagatagcttattctcttacctttcttgtctctgctcagacatctgcttagtgaaggcttttctgcccatctatttaagagaacatcttctttttttatactgtctgttccctcacacacactaaaatgaaagtcccaaaaggcagacatttatattatgttcactgccgtatatccttaccatctaaaactgcctgtcacatataggtaggctcagtaaatatctgaattaatgaacatttctaaaatgtatcaggtcacaactcatcagatcatggactgccaccaaagccatgtaactgccaataaaactgggcacagaagtctaaaaattactgtgatatcaattagcagttggtcagaacttgagaaaatattttgaggtgttgaaaatagttaaaggaacttcactactagctctccaagttgggagttactgcctagaccaacaattattgaggagctgtgaccttttgagcactagttaatgatagacactgttttagtcatgacagtaatcctgaaagcaggtggaagttctcccattttaaacatgcagaaatagagcctcaagaaactgcttcatttaaagataatactagcttgacaatccactgaatatgtcctaataaatggaaacagggtgggggatgtcagcctaccagtaattggtgtcattaaaccctcttgaatgaatggacatagtaatggccttcagggtaccttgaagtatagctaaaggaatctctggagttcatttagtaaagcagttggcatccctggcctgggatcagagtaaaacctggagctagattgattacagagtgcaaggactaggcaccccgggattggagagcatccttgaaagcaagggttcttcatttatttataaaaatttgattgcctactagaagcccagctaagagtatgaagcaattaagacaacaatctttgctcaagaatctcctagacaatcctgattcaagcaccagaaacaaagggaaaagaaacctcccagtctagtgaagaaagtagtacacatcatgtcaacagataggtaattttgttgataccataagagcctattattaggcctggcatatgacaggaggtcagtatttgagttgagtattgattgatggtactgtggaagacagaggaaacacatctgacccagattggtaggctttcccagaaaagtttatgcccaagtatagtgttaacaaataagaacttctcaggtgagataggggagaagagtctgcgaggaaaacctgtctagcatggcaaatacgaagtccagagatgagagaagatggtccacgtggtttaaaagtctacaacaaggtaaaggaggtacacagtaattaaagtaggaaagatatgtcaacacctaagaatcagaactagtatcttgaaaagttaggagccctggggttttgtttttgcttttgcttttaaaggatgtgtttgttccctgtatcaccgtgcccagcttactccttttcttcggaaacacttggtgccgtattgttactggttgaatctctgtgtttggtttttaatttgttatctttgcccccatgcttaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaatggagtcatagttttgatggagagaacagagaaacaagtgttaacatctttctactataggtttttttcatttttaggctattttacttgtcaaaggcccctgagaacctgtagctaaggaactcttagctttccagtgataataacaataataacaacattctgtacttactttgtgccagaaatgctccaagtactttacatgtgttaataatgctcacagcaatcctaagaggcaggtgctgttattatccccattttacacatgaggaaactgagatacaaaagttaaataattgtcacacagctagtgatagaactgggattcaaacctggggagtccggcttcagagtttgtggtcctgcagagacaaaacagccgcttttccagtattttcccagtatggtcagagaagacctgggtgcttgccaagatcctttgacctttaggaatatttccctacagccttacaaaacatcaattttggctgagcctagtacccaacactatattcagtttgtaagaaattaccattatcacatttcctgtttgtcttggagaggttgtcctatctcgcaccacatggtagggaattgtgaacaacactggacagaaagttaaagccttggattctgtactcttcattcctgtaaaccttgggtaagtttcggaattctctgtgagcttcttaaagtttttgaaagcatgtaaccggataagtgtatttttacaatggaggagttacagtcatcttggtatttgtgggagattggttccaggatccccaagcataccaaaatccaaggatgctcaagtcccttatataaaatggtatagcatttgcatataacctacacacatcctcccatatacttttaatcacctctggattacctataatacctaatataatgtaaatgctatgtaaatagttatactgcattggttttttaatttatattttttgttattttttaaaatatatttttaatccatggttggttaaatctgtagatatagagggccaactgtactgttagacacaagggtctcgaggcttgcagatagagactgaataaccctctccatgatgatcccttagagttcccccactgtgcctttttctttacatgtgcatgcaaacatgtgtctccacatacattttttttaacaaaaattgaattatgttgatatatgtcctgtaatttgtgttttaaacttaatatatcttaggcattttccctgtgtgtgtgtataatgcagctattaaaaatgagtctgaggccaggcatggtggctcacgcctttaatcctagcactttgggagaccaagacaggtaaatcacctgaggtcaggagttcgagaccaccttggccaacatggtgaaaccacatctctactaaaaatacaaaaaattggctgggcatggtggcagatgcctgtaatcccagctacttgggaggctgaggcaggagaatggcttgaactgggaggcggaggttgcagtgagccgagatcacaccctgcactccagcctgggcaacaagagcaaaactccgtctcaaaaaagaaaaaaaaaagagtctgacatacatatatataaaagaaactgttctaaaataccagaagtgcaaaggcaggggaccaattgcaacaagtagctggggtgataacccctatatatatatacacataggtcagtctcatttttaatagctacataatattccatagtataagtgattttactttaataccctattgatgataatttttccccagtttttttcactattccaggaaggagtatggattgaggagaggggaagaaaataggtcctcaaatgagagacaagaaacctgggttgttagcaacttttttctaatttgtgaccttgaatacatcctattccttttctagggtgaagtctcttgttaaaaaaaaaaagttttagagaatgtattttgagattatgaagactccttattccctgggaaataaaaaacatcccttatgattacaaagaatgttgggtgccatatccccaatatctgcctataaggctcactggagacttcttggactacatggatctattttaaggtttttccctgactccagaaaccagttgaagcagtttagatttgttgaagaagtgggttatcagcccagctacatgttgcagttggtcccctgtctttgcacttgtggcattttaggagtgtctcatcacatgaacaaaaagtaccctctgcaggctcaagcctcagcatgggcacactttgtagagctgcagagtgcctctggccagcttctgacacatgcatctactgagtggccatttcagcccagtccagaaggctgctgggctgctctgtaccctctagtaggtctgcaacacccttgccaccaggaaaccctgacacccatcacatcatcatgagtgaagttctcagttcctcacacttacctcagacggacttttttctagaaaatagagggccactgaggacagtggaaaaagatcctaatgttttttcattatttgcaaatttcaactgctaatatgtatttaatgtttgtcatgcttttatatacgtgtagaaacaatctttgcttcagaacaatttcggggaatggaagaagatgcaaagtccctttgcatacacacaagttgtgtttttctctggacccaagttcctcctcagcttggagcccgatctctcactaactctaccttatccactcctggctagccccacccacaccccaaaccttttctccatggtggaagtcatcagagaaaactgttaatagcacgttaatttagacttttagaatatatcctgtccccactgacagccttttttgttattaaatagagtattcctaacaacccaacccaccctatggtccccttctcagaataatgttttaaatacatacacatatcattgtctgttaataaggaactggggaggtggttccagagttactggaacagattcaaagacagttgctgaaactatgtcctggttgttgcttactctcctctagaaagaagtacttcctcactaatctggctttcagcctcagatctgccccattttaactgctgctactaacattcttcctctataggcagcaggttcttcctcctttcagacaacagtcacagagacacgtacttacatgagcttgaaagaagggaaattccttattcctgtgggcagaaaccaggtgaattgttagaactttggtttatcgacttgggcatagagggattcagggtacataatgcttgttaaggaagaatggcaactgttgggctgtcttacagccaaccccctcctacagtctgtcatgccaggcttagacccatgcagacacaacaggaaaagtctcagatttttcttggctgccataaaagatcattagccctttcagagggatttctctgtgacaaactgttctgggaagcaattgatgaggattgagtagttgtcaggctcttagtgccacagagttggttaatactgtcaaaggtgacccactggagaaagagaaacttgggagaggcaatctgccatgagccctgaatgttcctgcatgtatattcttgcctcatgtgaatgtaagactgaccattcttcttgggctgtacctcagtgttctgttagcagtaagctaccttgaaatgagcaaatttgcctgttgctcactgtaaaagttttgagcacccctcccctcacaagctgggggtctgcatatgtagtcatccatctaggcctaccctgtggcacttgggggtgtaggccatgggcagctggtgcaaacatcatgctcatgttgctggctataccataagtaataaagttatttgtctctgacccaggaatctcatgtcttctggcaacatccatgaaagcatcgcaggctaacttgttagcttacaagtaggataaaattcacagatgtgaaaattttagtaatgaaaattggatcctgaccaacatggttttctagaagagaaaggacaaaggcctttcatgggctggattaggggataaaagaaatttgctgggatctggtagcaagtcagatattcccaagtgagggaggaggaaagagtcctgagaaaagtcctacctgaagaaagagtcctacctgagaatattttgaggctaaggagcaagaggtaggattgaaacatgctgcccagattgtacttaggttgttgctcagtctctaggcaggaggcagaaaagatgttttgacaatgaggcagcaagctcatggctccagctgaaaggcagtatggccatggctgatgaatgatttcccaaagatgaaataaatgatggcagtgataaggatatagaactttgaactaaaaacattagctgtttgttgagtccaagtaggtagccacttgaattgaaagtaaatacatggccttgctgactgacacaaagccgttctccttatggcctacacccccaaaagtgccacaaggtagtcctagatgaatgcctacacatgcagaccccaagtttggtagtgggggtggagtgcttaaaacttacagtgagcaataggtaaacctgctcatttcaaggtagcttactgccaacagaacactgaggtacagcccaagaagaatggtcacggccttaaattcatatgaaggaagaaaatacatgcaggaacactcagcgttcctggcagattgcctctcccaacagtgtctccagtgggtcaccttcgacagttttatcaacctactctagaacttctgatccctctctctctacagctttaaggaaaaaaagctccccatctttggggaagggaggaatgccccttttacagctccgttcaatataggcatccaaatcactatcctccttggccccatggggacagggaaatctgcacatagaggtggtcaaaaatgccaaataccatggggcagatctacaatagcatgcaggagagcagcgaaaaaaaaggagccctgagccctgggggtgcttgtcagagccaacaggtatttgaaggaagaggcaacactgttctggggcaaggagtcaaagtgggattacttcctagtaacaactgtctcctgcaggctagcctcttccacctcctccttccaccacctctcacacttctggctgtggaaataacatcatttcttggctgtgatctccaacatacctatcttaaactgcttggtttgggtgcccataggggagaaaaagtacctgaattcaactggtagggtctgttagcttacaagtaggataaaattcacagatgtgaaagttgtggtaatgaaaattggatcctgaccaacatggttttctagaagagaaaggacaaaggcctttcacgggctggtttaggggataattgcatgggaaaggaaaattaaaatgacctgtggatggagcctctaaacatttaatgtactgctgttttatggctttagcatcaaagtgtgttgttaataccaatatacatttaattgaactaggaaagtttataagtctcccattcagggactactgcagtatagagagatgtagtctaaaagaaacaacatacaaccgcaagaggaaaagaaataaaagcacaggtttagttgaaaacttagttactcctgtagtactcaggccattttccattataaccagctatgtggactttgcagtcaccaaggtgaaatatcctgagtactccaagagtgacctttaaaaagataggcacctcttaggctgctactgagctcttgaggaaacaacagcggccagaggagcttcctgaaagcgtaactgattcatttatgcatactgcaggcagttatcactatcctgagagtcatcctattggaaatgttgataaggaatttgttcttgactttagctgcagtcatcagtgacaccacctcagctctggatggcacttaagtcagcctcaattcattggccagggtggttatgggtgatagaattgctcttcctctttgtgggccaaattggagtcagtgcaatcactaatacatcccactgtgactggattaatgtctcagaccgagtacagggtcaatacagaaacttgagaatgccacttggctttctaaggtagatcctgatggtttatgattgttggtttttttttcctaccttgttggatacaggcccttggatatggctgaagtcagtactgattggtcttatcctgttacatagagttctgttgatagtacctttaattaaatgtaataaaatactttgaatggacctggttccagtttctgtcagtttaattagagtgacaggtggagtggcatacttatgggagaattcatcaaaagccaagatggcatagaaatgaaaggtgcatatcgttgggagacaattcttcatgggtctctagcatttctgcatattttgcaaagagaggcactgactatctttgttccagactatttgtccaggaatgtttgtatagtaaacaaccttagaaggtatcagagcaaagggcgcacatgctcactgcccattattgaagattcaggttccctaacctcaaagttcctctcctttaaggcacttcattacatgtgcaggtatcatctggctctctgcgtcatcatatgggaattggggctcagaactggaacaaatgctggtactctggctactgctattgctgtaagtaacaaactatcctttttacaggtagtaacaggctatcttgttagcttgcaggtaagataaaaatctcagacccttcacaattcttgacagccccactcctacttctgcctgtcccatatcttggaagctccctaacttctgtaacaggaagttcccccgatattcctgtgccatcttacttgatcgcattacttaatacccttctgcatccctcttccttcaaacttttatataattctgctctgctaatacgggtgccaggcctgatcccctcgctttagttgctcacagtctgctgagagtgtcagacacttagacaatctgaacacagtagaaggaggtgcaaagtgctatgggggcttgaaaaggagtatttgttctagtatggaggtctgggaggtcctcatacaggaagtgaaaactgaaccatgagtgaggagttgggccattttacagatgaggaacctgaggcacagaagttaaataagttgccgagatcactcagctaggaagtgggaagagaggattggagccaggattctctacctctaaatatagaaattgctctttaacttcactttctcaggcataagatgagaccatctgagtttacctcaaagaattgagaaagatttggtattagctttgggtctataaaatttgagatccacagagttggtgattgtgaacttggagaagtctgataaagaaccccaggacatgacccggtttttataaaggaaatatttcagacaaataaggcttaaagaataataagatgaatatttgtgaacctactgccattaaaaatatatatattaccaatacagttgaagtcctcagggtatccttaatcatatcttacttcctgcactttcagaagttactactacctggaatgtggtgtttattattcgtaagcattttcttcatacatatgtgtccattatatatatggatatatacagatatatagagacatatatggttattttttaattttatttttacctccttgggagctcttatacaatatatatggttattgttttacctgtttttaaactttatatgtggtttttgattgagagtctcccaaacaacccctgtgttcaggtatttgctagaaggacccacgcgactcagcatatatgactaagatttattcttcgataaaataaggacacatctggatcataagggaaaaggacactggcagagtctggaggaatccatttgcaggcttccttatgctcttcctcccatgagggattgcaaagagcccactttgccccaacaacaaaaatgcagcaacacgtgtgtaatgtttctgtccagggagcccattagagagtacccacagtttattgaggtttggtcatgtgggcaccatctgcctagcacataataaagactcctagaaagcaagcaggtatccaccataaatcatactgcaatcaaacagtctacatagtcaactacccttttcagttaactggtgactgggaacactttgagagccaagtttccagacacctgtcaaaaaacaccaaccttgcaagcaggccttcctaaggataacctgttaggcctgctatggtaaatctgcacaagtaccattctctctgtattgtgcaacttgcttttttgttcaatattttgtttgtgaagataatttagattgatacctgtagctacaatttattctatttcactgctgtatactgttaaacatgacagtttatttaccctattaatggacatttaggtcttttataatttttcactattaaacatttgctgctatgagcattcttgtatggacacatctaatacaggtagtgggattccttggtgggagaggatatacatttttacttttctaggtattgctaaattttcctctaaagcgactgtaccaatttacattccttctattaatgaaggaaatacaagattggaataattgggatagttgtgttatctttgtgaatagattttaaaatactgatttagatttttaaatagttgtaagacttcacattttccatatcttagtttggtaactttttctaaaactgtattaactttatctagattttcaaacttaaggaataaagtttgtttaatatttatttctcatctctgttgtatccctgcatatagtctccttttcattaatatcatttataacttttaaaaatgagtcttgccagagggtttgtccggtttattagatatgtcaagactaatatttgcttttgtcagtcccctctattgtactttgcttcttgtttcatttattctgttcttattttcatcatttccttttctacctttttgggatttattctgttcttccttttctacattcttaagttagatccttaactcattactgttttgttgttcttatctcctggtatagggtctttatttgagttctcccagaggcaagttctgagaccaggacctgagggcaatagtatatgtgagagatgcagggagtgccataatgaggtgggaaagtaggaagggaagaaaaggtgagcaataagggtgtagcttttagtagctattgataattgctgtctagattcattaaattcattttgtcattaaaggacaaaatgatgaaattctatcattcatttggcattggtcagttaattattttatgaaggagaacttttccccatcaactatttagttacccagaaatagggtttgtacaggaaaggcagaataaaaagctgctttccttagcaaactctgaggtgaccaaagtgacatttttctccatatgtcgatatgaactttctttgcagtccttgttctttttgatgttctaatttttccatatttggccagtggaatcaccttcaaattgattcttaccttcttttgacatgacctgaaatagtcttttatggctttcttgctttctgttaagatgttctaggctaatcttataaattttcttccctgcacctaaaatcagccatttttttcatggaaccctggttcctttggggacaaaatagtattttaagacccattattgccaggcgcggtggctcacgcctgtaatcccagcactttggtaggccgaggcgggcggatcacgaggtcaggagatcgagatcatcctggctaacatggtgaaaccccgtctctataaaaaatacaaaaaattagccgggcgtggtggtgggcgcctgtagtcccagctactcgggaggctgaggcaggagaatggcgtgaacccgggaggcggagcttgcagtgagccaagatgacgccactgcactccagcctgggcggcagagacacactccatctcaaaaaataaaaataaaaataaaaaagacccattatttgggcttattacgatgagttggtctctggttctaggcctttttttttttcttttttttttttttttttttagaaaaatacagcaggttgtattgaggttggcacctatgttctttcaaagaaccctcatcattttgtgagttctttccttgtggcaccacgatgttccaggctcatcttgtatgttccctgcctcagcacaggattttttttaatgagaaaaatatcacgaattcaaatttacagaagctttacatttttatgtcctctaagttagcagtctgtctttccttttattggcgtttgtaaaatttcttctttttaaaattgttatattttagagacagggtctcgctctgtcacccaggctggagtgcagtggtgcaatcacagctcaccacagcctccaactcctgggctcaaggcatcctcccacgtaggccttccaaagcgctgagattgtaggcataagccaccaggcccagcctattacctttacgttgtacttagtcccagataaaaaatgaccttagatcagtcctttcctctttggctggggagaggggggcttaaattccggtactgtgaaacagaagaatggactcagtgctatgtgacaaatctatgtatgtaaatgtgtgtatatacacacacataaattatatatatgaatatattttcattttcatattttgcaaggagagtagccaatgctctggacctctggtcctttttgtagggtaccctctgaggccgggaacctttgctcaactctcaggctgtccagggaagctttaggcggtgataccgagctacagaccaatataagagctcggggctgtggcactgaagagaggaggcggccgttgggaactgaggtgggcccagggcttgagctgagttggcgagggtggaggtggtgccggtcccacgccgtggtggggaccgagctgcgggctggagggaggggcagcgccgagggggcgggacggggagggctcgcggagtaggccaacggttggccccaaccgccactgactacagcctgcgcccgcctcttttcgttgccgttacctgtttccggcagtcgacacgctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcaggtgagcggggttgggagacaggagagctccccgaggaggactcaactgtggggacaggttgagcaagaccatctgcgtttgggaaatccagccttggattattgagacagagccacctagtcggctaggatctgacctggccagagaattcttggctagtcctatttttattcgttctcacagaagccgaacttaaacctcagaattatcactccagagatgaaagggaactgagactggaaaagccctgcttaccaaaggtctctgggcggcagaaagagccctgagcttcagtttcaacttaggagacctgggtcttggtccagattttactgtggagtggcgttcagtaagctttgtccccatcccgggcccgagttttcccatctataccatgagagggtttagactacagatcttcaaaggtctggcacgtggtaggtgctccttaaatattacttgttaggagtgaataaatgagataggaaggcctcctgggattcactggaggctcattgggttagttggaggctgtggaattacattattatagtctgagaagtaggcggtattatctccattttataagtgaggaaactgaagctcagaagtaaagtgacttgctagtaagtgtcaaagataagtcagacttcagagtccatgctaggctatactctctcccagtaagaaagcgggaaggacttgatgggaaagtgattatatcgagcagcaagtaatcatttgaattctctgcttaaatgaaccccagagcaggcccatatctgattattttctatcccgtttccagcacctgatttgtgtgaaacgttttgggtggcaatgccagaatcaccatctatattacttctgtcatcaacacgatcagcataattacaaaaattaatggctctaattgttatagtgataataaagcataaatgaaattgtgaggacatcaaaatttataattaaagacacctattaaaacagcagtttaaaatttataaaacacttttgagtggttcttcatattgatctgcttaggtaggtattattatccatagtttacaagcaaggaatccaagacctagaggttgagtaaccatcaaaacgtcatgcagcaagaaatggagctgagacttgaatccagcccatgtgacaagttgtgcttctcctttggtgattatttccctatttcctctccatttccttttttttttgagatggagtcttgctgtgtcacccaagctggagtgcagtggtgcagtctcggctcactgcaacctccgtctcctggtttcaagtgattctcctgcctcagcctcccgaatagctgggattacaggtggatgccaccatgcctggccaattttttttgtatttttagtagagatggggtgtcaccatgttggccagggtggtctcgaactcctgacctcaagtgatctgcccacctcagcctcccagagtggtgggaatataggcatgagccaccgcacccagcctcttcctttcctgttctgagccctaacccgctccatgcctatcctgtgctccattcttcttatcacctggagaattcctgtttagatttaactaatagtcacatgttgactgatgatagtagtgttggtttaacttgtaattaaggtgttaagagtttaaagtatgttctctttcagcaataaagggggatttaaatgtttttaagaaagggagttgtaattgttattattgtcattgttatccacaggattcaaggaataaaactagaatatacagtaattggtagtttaaaaataataactgtcatatattgcactcatactatgtcataggccttgtaatagccactgtagttaagcattttatttctatcacctactctgctgaattgtataggggaggatcctgaagcatagagaagttgaataacatgcccaaggtcacatagtcctggcctggtccaaatcctatgttcttaaccattacaccagcctggctcagagacagattgtttgcttagaacaaagcctgaccctcccggggaggagagcctgaattgaggggagagaagtatgctctagtattgagtgagaagatggtctccccttgcttatcttttgattctgctgttgagagcctgggattgaaatgaagggaggcttttcttctggactcagcaaggccactctcccagttcccctcatgatactgagcaatagttcttttcccttcttcaagttaggaacaagtgactaaatattcatatgctattgataaaagtttgtcttggttgacactaggaggctgtagccaaaagcagtgcaactttgccgtatggttcactgtcctgaaagcttcctggaagattggtctaaaatcatcatgccattcctctgtcaaaaattcttgagtggtctcccatctgtggaataaacaccttaataagttatctaagcctcccaggatctggactgtgctgaccccttcagtcccacctctgcccccatcccttgcactccaccttactgtagtcacactaaactactgagaggccccaaaactcactgttttctgttgcctataggcttttcacatccttgtcctctgcgcttctccttttaaccctcagttggctaatccactgttcattctttaagatctggctcactgattcattcaatcattcaacaaaaatttgttgagtgcctattacttaataggcatagttctaggtgtcaaggcggagcaataagaaaacagacatacccttgctgtttctggagcttccattttgtggtatgtattaaacaaatgtaacataggaggcatcaaagtgtgataagtggtgtggagaatagaacaaggaaagaagataggctggggcaaaggagttgacagagaaaccttcctgattggatgatgtttgagcagagctgaagaaggtgagggagcgttatgtggctatctgaaacgagtgttccaggcagagcctgtgactatatgaggcaggagttcttttggctcaatcattctctccaaaaatccttctctggtgccttgatctggatagatgccacttttgtgtttttctacttgctgttgtgtttacctctaaagtagcacttattacatcatgttataattgtccatgtatatgtctgtttccctcacttggattgggtttcttgagagcaggaacctctgatccttctctgtcttctcagcatctattttagggcctgacacagaggaggaacctagaaatatttattgaatcaattgttcttacagcctgataatatttacaaatgatttgtaaaattgggtttggatgacagttggtttgaggaaaaagtaattctaaggctgctttttgtctgtctggcttgattccccttttggacctctgagaagtggaacacctggttttctttaagaagaatacttggagactccattgtgagcattatggcagggtagccaacctgtaaaatggtgggtaaaatataacaaagccggccgggcacggtggctcatgcctgtaataccagcactttgggaggccaaggtgggtggatcacctgaggtcaggagttggagaccagcctggccaacatggtgaaacccgtctctgctaaaaatacaaaaaattagctgggcgtgctggcgggcgcttgcaatcccagctacttgggaggctgaagcaggggagttgcttgaacccaggaggtggaggttgcagtgagccgagctcacaccattgcactcaagcctgggcaacaagagcaaaactccgtctcaaaagaaaaaaaataacaaagccctttatagctgaatttgcaagaaagtaagagaaatctccagggacctagaaaccaagagtgaactgaaaaccagagtggttagctccttaatctgccctcagctgcactggatgtctcacctagaaacttggactttaataggcctgttgttataccaaatgaagctataggtccgcatgggttagactctagtgggttttttgttgtcgttgttggtgtttttttgtttttgtttttgagatggagtcttgctccgtctcccaggctggagtgcagtggggcaatctcagctcactgcaagctctgcctcctgggttcacaccattctcctgcctcagcctcctgagtagctgggaccacaggtgcctgccagcacacccggctaatttttttgtatttttagtagagatggggtttcaccatgttagccaggatggtctcgatctcctgacctcgtgatccgcccaccttggcctcccaaagtgctgggattacaggtgtgagccaccacgcccggcctggttagactctagtttttgacagaggatggcatgtgaaatactcacatgaagctaggtcccttgaaaatctgcaccctgtgtagggtgtataccttctgatagggtggactagtatcttaattcactttctgttgcttataacagaatacgtgaaactgggtaacttataaagaaaagaaatttcttgcagttatggagtccgagaaatccaaggtccagaggccacatctggtgagggctttcttgctggtggggactctgcagagtctggaggtggcatagggcatcacatggcaagggggctgattatgctagctcagatctctagttttcctcttataaagcccctaatgcactcccatgataacccattcatccattcatccattcatgaggacagagcccttataaccctatcatctcttagaggccccacctctcaacactgccatatcagggattaagtttcaacatgagttttagaggggacaaatatcaaaccagatctactaggaaaaaaaaaaattctccctactgacacagatagaagacaaagagattgccttttatcctaggctttcgtacagaaaaaaagttttcccagaaaattcttaaccataggcattcactcatacagatacccaaatggcctagaaactccaagccaagaagttgataataaaaaccacctcaggctggtaatacccctggatgcttggcaaaaacaaatgcaaaaccgctctgctccaagatacatacttgatacaggccacatagaattcccacagggtctggagttaatgaaattctcatttgttaaacaagaatgtatattgcttgctttgtgctattgagagcatatgttattcttgtataaagaaacatttgaatatatctgtgcccccccacctttgctctccagaagtgaaatgatgaagcagaatttatatgcaggccagcatctgggtatggacacacattaagcttccttctatccttgcagaggtcatggaagaagtgacaacatgctccttcaacagccctctgttccggcaggaagatgacagagggattacctaccggatcccagccctgctctacataccccccacccacaccttcctggcctttgcagagaagcgttctacgaggagagatgaggatgctctccacctggtgctgaggcgagggttgaggattgggcagttggtacaggtgactcttcatcccagatctgagtctgggcctcagtttctcttcacaaagctcagagctcttcaggatctgtgccttttctcatcagtacaggaaagccctgtgtggggagcagaggcagaaaaaacagcaaaaacaatggctctcactgagtgcttattgtgtgccaggggcacattgggtcctcacagccattctgtgtcgtaggtactgttttcagtcatattttacagacaaggaaactgagactcagagaggttgccatttgctcaaggttatacagctataataaagcagtagaagctggtttcaaactcagtcgctgactccagagacctccacagttatttagattcagctaacgtatgatgtgcctttcatttatattccatttaatcctcataaatcacccagggaagtaagcattggtagtccagttttgctgatgagagatcctagtgctccaagaggtaagtaacttgctcaggaccacatttagcaggtgacagggggataccagtaataaccacgcttctactactaaatgctgtatgtgaggtatattttattatccccattttgcaggaggcaaccaggcctgagaattaaggtcatttgctttggtcacgcgtctaataagtgggagaactggagttagagcccttcctcttcagtagaacattttgactgtatttttagtgaggaaagaagggttactgctctttggcctggaagctacagggttatttcagatcccaaataggcatacgtcggagatattgtggatttggttccagaccaccacactaaagtgactatcacaataaaacaagacacataaattttttggtttcccagtgcatataaaagttatgtttacactatactgtagtctgttaagtgtgtagtagcattatgtctaacaaaaagtacacaccttaaaatactgctgaaaagtgctaatgattatttgaacctttggctagtcaatctttttgctggagtgggtcttgccctgatgttggtgactgctgacttatcagggtggtggttgctgaagatttagtgtattattattattattattattattattatttttctagaagcatttcttacttacatagataatttcttaaaataagacaatgggctgggcacagtggctcatgcctgtaatcccagaactttgcgaggccaaagtgggaggattgcttgagctcaggagttcaagactggcctgggcaacatagcaagaccttatctctaataaaaataaaaaacattgggtgggtttagtggcacacatctgtagtggcagctactcgggaggctgagggggaggattgcttgagcccagaagttcaaggctccagtgagctgcgattgtgccactgccctcccgcctgggggacagagcaataccctgtctacccccaacaagaaataagacaacaatgaagtttgctgaaacagttgacacttcctttcacaaaagatttctctgtagcatgcaatgctacagaatttgatagcatttttcccatagtagaacttataaatgaatcctctcaaaccctgctgctgctttatcaactaagttgatgtaatattttaaatcctttgttgccattttgacaatgtttacagcatcttcaccagaagtagatcccatctcaaaaaactactttatttgctcatctataagaagcaactcatttattcaagttttatcatgagattgcagcaatttagtcacatcttcaggctccacttctaattctcttgctatttccaccatatctgcagttacttcctctactgaagttttgaacccctcaaaatcatgagtatgggaatcaacttctcaatgtctcttaatgttaatattatgacctcccatgaatcatgaatgttctgaatggcatctagactagtggaatttttccagaaggttttcagtttactttgaccagattcatcagagtaatcactatctatggcaactatagtcttatgaaatatttcttaaataatgaaacttggaagttgaaatgactccttgatccgtgggctacagaatggatgttgtattagtggccgtgaaaacaacattaatctcctcatacatctccatcagagctcctggatgacaaggtacgttgtcaatgaccagtaatattttgaaaggaatcttttttcctgagcagtaggtctcaacagggggctgtaaacagaagtgcttcatccaggctttgtttttagagcactggcagagtagatttaggataattcttaagagccctaggattttctgagtgataaatgagcattgacctcaacttaaagtcaccagcccgtcctttgaaggtttgaagccagacattgacttctctctagccatgaaagtcctagatggcatctttcagtagaaggctgttttgtctacagggaaaatctgttgtttggtgtagccacctttgtcagttaccttaactagatcttctggataactggctatagcttctcccatcagcacttgctgcttcaccttgcccttttaagttacggagacagcttcttgccttaaacctcatgaaccatcctctgctactttccaacttttcttgtgcagcttccatacctctctcagcctttgtagaactgaagagagttagaactttgccctggtttaggctttgtcttaagggaatgctatggctggtctgatcttttatccagacctctaaagctttctccctatcagcaataaggctgttttgctttcttatcattcctgtattcactggagtagcacttttaatttccttcaagaacttttcagcctggtgtggtggctcacgcctgtaatcccagcactttgggaggccaaggtaggcggatcacgaggtcaggagttcgagaccagcctgaccaacatgctgaaatcccgtctctactaaaaataccaaaaaaaaaaaaaaaaaaaaaaattagccgggcatggtggtgcatgcctgtaatcccagctactcaggaggctgaggcaggagaatcgcttgaacacaggaggcgggggttgcagtgagcagagatcgagccactgcactccagcctgggtgacaaagggagactctgtttcaaaaaaaaaaaagaactttttctttgcatttacagcttggctgtttggcacaagaggcctagctatcggcctgtcttggctttcaacatgccttcctcgtaagtttaatcatttctagctttgatttaaagtgaaagatgggggactcttcctttcacttgaacacttagaggccattgtagggttactaattggcctaatttcaatgttgttgcatttcagggaataggctgaaggaaaggaagagagatgagggaacagttggttggtgaagcagtcaggacacatatagcatttatcaagttcaccatgtaatatgggcacagttgtcatactccaaaacaattacagtaataacatcaaagatcactgatgaaagatcaccataacagatttaataataatgacaatgtttgagatattgtgagaattaaccgaaacatgacaaagacatgaagtgagcacatgctcagttcagggttgccacaaaccttcagttttgtggcaatatctgacaaatgcagtagagcaaagtgcaataaaatcacataggcctatatttcttattgttgctttcctctctcccagggctagcttaagtgagacaaatgagacaatggttttgagagtcttttgtaaaaaaaatatatagttgtgtcatctctctatatctacatagtaggcactttaatactcctaacctaccctgcttttttacctacagatgtctcaaatctgaccattaaatcttcatatccacagcagataaccttcttctgctgttaaagtacacagtgcaaatgctattctgctgaacatgggccttgccatcaatccctgtctttgcttttgataacattggctcacatttctcttggtgaagttttttactttgtgggattttcagttcctgctctttcaccttatcttctcatgagtctttctcatggcctcccaggaccagacttctgcatgtataactagcctccacagaggcccagccctacagcccagtagtacttgggattctagctctttcctttcttctaggacaagcattgcctgtggtcatcgtcatgttgcactgtttttgatcacagacagtaggctgttaagcattttttttaatcctattttttagagacaacttctatgttgcctaggctggtcttgaactcctggctcaagcaattttcctatctcagcctcctgagtagctacgactacaggtgtacaccactgtgcccagccttttaaattttaactgtctgtttgtctgtctgtctgtctagagacgagccctctctgcattgcccaggcgggagtgcagtggctattcacaggcttgatcattgcatactatagcctcaaactcctggcctcaagcaatcttctcacctaagcctcctgagtagccgccactacaggcaggtgccactgagcccagcaagcattttttatcagaccacacctgttgcataacttcactactcagtagtcacacacatccacaaacttgtccactttaactcattctctctttatttcattctctgacttatttaattgtacaatcttgaagttagaagaatcatgagcccaattctttcccaatatagaaatctgtattctattggtagttactgaaatcttagtgattaagagcatggctttggagtcagtcaagacctatcatttattggctttttggccttggatacttgactcttctctgtttcatcagctgcaacatataattaataatagatactacatagtaagaactaaacatttgtcattttccattaagggtctccttgcacaactcttcaggtgagcacctgattgctgtggcagctggtttttatgtgtgaatgagatgatctctacttctctataattacccattggtttgttctgccttctggggcagtcagtctatacaaaatgtagataaaatctctttttcagagaactactctctgaagtacctgaaagctgtattcatgccctctgagtagtctgttttctgggctaaacagcttcagttctttctgtaacttcttagggcacagtcctgatttggtttctggccccttgaaaattgtgattactgtcgttgggatctggtctgagatagcagtgtccttttttaaagtaggatactcagaattgaacttgggactccaagggtagacaggccagctcagcaatgaggtgagctctcctatcttgtattccctttaatgcaattgaaagtaaaatagcactttcttggtagctacatagcacaattgactaatgttgagtagatggtcagccaaaacctccaagtctttttcacatttgttattcttttaaaaaaaaaattaattgtagtaaaatacatctaacataaattttaccatcctaaccatttttaagtgtatagttcagtagtgccaggtatattcaaattgtgcacccaatcttcagaacttttgatttttcaaaactgaaagtctacacccattaaacagctccccatttctccctcctcagtccctggcaaccactaatctactttctgtttctataattttgactactctagatatctcatataagtggaattgtatagtgtttgtctttttgtgatggcttatttcacttatataatgtcctcaagtttcatccatgttgtagcatgtatcagaatttccttcctatttaaggctgaataatatatcattgtatgtatataccatattttgtttatacattttttttttttttgaggcagggtctcactttgttgcccaggctggagtgcagtggcatgatcatggctctgcaacctcgaactcctgggctcaagcaatcctctgcctcctgagtagctgggactacaagtgtgtgccaccatacccagctaatttatttatttatttatttatttatttatttatttatttattgtagaaatggggtttcagtatgttgcccgggctccattcatctcttgatggatactttggttgcttttgcctgttgggtattgtgaataacattgctatgaataagggtgtgaaaatatctctttgggaccttgcttttaattcttttggacataaacacagaagtggaattgctggatcacttggtaattttatatgtaatgagaaactggcatgccattttccatagtggctacaccattttatattcctaccaacagtacacagtggttctagttttccacatccccaccgacatttgtcattttctggtgtgtgtgtgtggtagctgtccaaatagttgtcagggtgatacctcattgtgttttttagttgtatttccccattaattagtgatgctgaacatgttttcatatgcttgttggccattacgtttgttcttgtttttctttttcttttttttttcttttttttttttttgagatggagtcttactctgtcacccaggctggagtacagtggtcaactcggctcactgcaacctctccctcctgggttaaagcaattctcctgccacagcctcccaagtagctgggactacaggtgtgtgccaccatgcctggctaattttttttgcatttttagtagagacagggtttcaccatgttggccaggctggtctcaaactcctgacctcaagtaatccacccgccttgacctcccaaagtactaggattacaggcataagccacagcacctggcctacatttgttctttaatcagtttaccccatgcaaatttttaagccacaacctgttttatctctgtcaagcctcagcttgttttatatgtcccattgctccagctagttgagagcatcttagattccaagactttcatgctatgtttactcttttttccatcttcatgtcaactgtatgttagatatacctggctcaaataattttcttctctcagccactaaggatgactaaacttctgacttctcaaaaactagactgcttaataagtaagctgacttgatcacatatctctggcatgtttagtgtgctcagggcactcaggtatagaatgggctgtcccagagatcttgaattccctgttgaactagcttagttcaaggacggaatggtcttttatccagaagactgcgaggggactcttccgtgggatgggagttagcactagataacccttatggtccataatggcttagatttcttttttgtttttgaaacagggtcttgatctgtcacctagggtggagtgcagtgattgatcatagctcactgctgcctcaaactcctggacttaagtgattctcctgcctcagacttccaagtagataatgtaaaaattatctagacccagatcatgtaaaaaaaaatgttttgtagagataaggacccactatgttgcccaagttgatctcaaactcctggcctcaggcaaatggctctgagagtctatgatctgcgcctgcttaatctgttttgtccatttatacagaaattaattttttaaatttattttttgttttaggtagttaatacatttcatatagctgaaaaataaaaaaagtataaaaagatatatatctcatttccattcccctacctcttataggcaatcactattgtttcttgttatctcttcagtgctgcttcatgcagtagcaaagcaaagaagtatgtactcttaatagcccttttaaaaacttttaaaaatgtgaagtgataacatatacagaaaacataaaacataaatgtcaaatgcacaaaacataaatgtcagctcaatgagcccttatgacaaagccaacacttgtggactcatatatagaactcacaactaatattccaagaaatagaatgtcgtcagcatctgagaagcttctcttatggccccaccctccttcccaaaggagaagttgattatattaagttgatttatagccctagagtttagttttgcttatttttaatctatgtattcttttggtctggcttttgttcagtattcttgagatttatccaaattgttgtgtgtaaccctaatttgtttttcattgttacatagtattctatcgtatgaacataccacaattaagtgatccattttactgttgttggatacttgggttagttattataagtatagattatactgctgtgaatattcttatacatgtttttggtactgcgggcatacattttgttgggtatgtagctaggagtggaattactggctcatgtggtatgtgtatgttctacctcaatagataatgtcaaccagttttctagagtgatggttttaagggttgttctgcctcagttccatccttattccttggatttggccctttaaggttccatctcaaattacatgacagtttaccaggccttcaagttttgtccttctgctccataaggttgtcaaatgacttgctcagcttctcagcctttcagttacttctttgagaattagtaggataccctaagggaaaaagggaccagccaacctctctgaaagaacttagcctgtcattcttcattctcttgtttgctctctggtgctttcagatattttgtttttgtttaaatattttatctatcttttcaagttctcagtggaaggattggtctaattatttagtttgctgtaaccagaagtccctttcctccacatttctgatgcaaaaggtagcatactacatacactattctgtattttgctttctttatttaagaataaattatgaaaatcaggccaggctcggtggctcacgcctgtaatcccagcattttgagaggctgaggcaggcggatcacctgaggtgaggagtttcagaccagcctggccaacatggtgaaaccccatctctactaaaaataaaaaaattagctggacgtggtggtgcaagcctgtaatcccagctactgaggagattgaggcgtgagaaccacttgaactcgggaggcagagattgcagtgagctgagatgacaccactgcactgcagcctggttgacagagagactccatctcaaaaaaaaaaaaattatggaaatctttccatatcactatatatggaaaaaaggtcttcccccatgtattgcatgttcatttcacccattctgtattgacgaatatttgagttgtttgtagtattctgctacttcaagcaatgctacatttgaataatcttatacatacttaatttgatgagcagatatatcttaggatgaattcccagaattgggcatgatgggaaaggataaatgtatttgtaattttgatatatgtcctacatacaggttgaaccatttgcacttcaatccatatatgaaagtccagtttcttcacatttgccaacacagtattgtcaagctttatgattttgctaatttgatagatgtaaagtgttatgtcaatttagttattttgttttatttttatttttagagatggggttttgccatgttgcccagactggtctcaaactcctggactcaagctattctaaagtgctgggattacagcatgagccactgtgcctggccattgtcagtttcgttttaatttgcatttctctcttatgagtgaagctgaacttttttttctctttctgtgagttgtctgatcttgccctttgcccatttctgttggattcctggaaattttcttaccaatttctactattgttttgaaaatatgttagggagattagacctttctttatttgcaatatgtctgattaggcattatctcattgtatccttataataactcctctgtgaggatgttattaaattttccatttaactgataaagaaattgaggtaaagtaagattaagtaacttgcccatagtcacaaaataagtgatgaaagcatggtttgaactaggtgtctctgaatctatgcttgagctttcaacaaaagttatgaattgccttcccagtgtagtacaggagggaaaaaaatttgtcttaaatttccttttatttgcttaaaatttctgtatttgtttgccttgcttttcttttcttccttttcttttttctttctttcctttcctttcttttttttttctttctttctttctttgtaaaaatatttagcacctattatgtaccaggggctggagaatcaatattagtaaccaatagtataagccctgaaaaggctcatagtctagaaaaggaagacagtcataaaaagttacaatgttatacaataaatgtattaggggaggagagtgagtttcatggaaggctttataaaggaggtgacttttgagttgggtatggaggatgatttggaagtctagatgaaatgaggaatagcattccagacagaggagacagcttgtacaacatttagcattgtctctttccagctttgtaagttatcctgtaatatccgagaatttagtgagtagttaggccttcgtgattttatagatttcaatatcatttatttcttatttatgaaaaatactaatacttttaatgagcttcatgttttcctattagtatctcactcctactttctcccttctccttgtctagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagttctgtaggctctctatcctagaggaattgagcaaaacagaagaatcatgaagtctcctaccttctacagccttgtagttctgcttaccttctcttcctcatccagaaagcatcattttctagggagaacaatgagaatctcaatgccagtagtactggataatagtgcgtattgcttctggtggcattaccctgatgatgggctgaagttcatttattagggtggttcctgatgggaaaaggacatggattaggactttaaaacactggacagaatttcccacagtctttgccctcaaggagttcaccagtttatggggctagaagagcgagaaaattcaagaaaataaatgtagctggtgggagactttgtagatgttgggctatatgttggggtgatggtagctcctgatgtaattttcttagttgcatcttcaatatgcctggagtcgtctgtccaaggcttgtccaggcttctgggtttctctcaagtttgtttttctcaggatattgtcctggcccagctactcctttacctgtgagaagatcttcaccattaggaagatctctagacccccagatctcagaatcaggcctatttgtgtaggcccatggaaatcactacttgtgaagtagagatgcctttttgtctaatggttttcgtgctgaacttagttcatgctgagtctctcagatgataccacgttggttgttcctatcttagattgtttctcccatagcctgttattgcaacagaaattctatcatgagagatttatttttttgtccctattttaggagtctaatgcttaaactggtatcaactaaatatatttggtgttgtacaatgaccacagagaacaagtcttagtcatgaaatatagcctaggagactaggggttacagttgcactagttgggtagagagagtcctacaggataaaagtggagattaactttacctactttagcagattgcttaagccatggcttagagtggcttttaaaaatccccttagcctctcctacatttgccaaggtaatcttcccaatacacaattattcactcatgtatacatttatctaaatatttcttgagtgcctaatacaaggtactttctactgccattccttggctctaaatcatttgtggttctccattgcctattataatgtaaagatgtttacatttagcctggcatgtaggaccttccagctgttgggtgaaataatgcacactttcctctacttccttatatgaggcccactgtcagggaaaacctctgtcaagttggcaggtggagggtggtggaggtctagggatgggcaggattggtgcagggaggaattggggaaggggagaggattaaaagggcagccccctcctgagtggtagaaactccttgtttagcaaagctttcctgaacactgtactgcaagtggataggaatagggaggatggccaagtcgtacaaccagggctaaaggatgaaaagaatgagaatatcaacttctttttttttttttttgagacagaatctcactctgtcgcccaggctggagtacagtggcacaatctcagctcactgcagtctccgcctcctgggttcaagcaattctcctgcctcagcctcccaagtagctgggattacaggtgcctgccactacgcccagctaattttttgtatttttagtagagacggggtttcaccatgttggccaggcttgtctcgaactcctagccttgtgattcgcctgcctcggcctcccaaagtgctgggaatacaggcatgagctactgcgcccagccgagaatatcaacttctttaggactactcaagaagggagtcaaggcagggaccttggtctgtgccactgtgacgcagagatgtataataccagtactcataagaggtccatctctaaattgccctcctcttacttcttccccctgcctcatgttttttctctttaatgactagcatcgaaactctttaaatggggcaggcctgtgttcttatctcaggaatagtaagaaaagggggttgggaacaggggaaatccagaataaagacttgagaaaggaacagagtgggtgatggcagctatgaagaaaaaacagatcagaagaagagtcctggcaccttaggaagagaaagtgtcacagacacgaggcctaggctagagagatggtgtaggtggtagctgctgtgaagaagaaatgacaacaggctggagctgttccctgaaacctgtgggaaggaagagagacctgcacaggccggcacttagcttgtggagaaggtcctaactcaacactgcaactttaagctggcttaacttgtccaagttccagatgaccaacaaagacagctatagacactctaactctgtgccaattacccaaggccttcagggccctgggacctattccatgatagtggtaccctaactgaacccatttcagccactcagattgataggatggaaaagacagggcaggtggtagcagctgtgaagaaaagaggaaagcagaagggtggcctataatctacaggcatgtagagaggactacataggcctctgttctttgccctcaggagcccccttcctgtcccttggactcagaatggatccttccagcacacatggcccaacactgagagtgcaggaagcatgggtaggggcctcctgctgctggtatgtacccaggccagcctcctgccgacacagcctactggctgggttcatgttcttactattcacctcaggccattgtctgggtgcttaatttgacttgtttcccctggtcaccagtctcccctccgatattcacaggacatcaagcagcttcagccacgggtaagaggcttttcaccctgcctgttgggtagcccagaggacccacaaaggtcaacctgagtctccacagcctcctccccagggcagtaggaattgatatctcacttttgccagattaggcttctcactcttcttgagtaggccataatccacctcttcagtaggccatgcatcttgtctctgcagtgccagaattcacagtctgggcctccctttggtccttaccataggctgccatgtattattgtctatgttgtgccctgtaggcctctgctaggctgtgaactccttgactgactcctcactgtgtcctttttaccttgaatcacagtggcttatctaaaaatataagcttttttctgtcatattctgaattccctgaaggtaaggactatgtctgattcctctctttgtcctctgcacccagcgtagggcctgaaacagagtagctagcagtaaagatacactgaatgaatgaatgagtcaaccatccttggcctctggagctaattgagaaggctagggggagttccgctgtagggagaaggatgttgcatccctttgtagattgtgtagcattcaaaacctgctgaacactcaccctcaatgtatattctctgttctggcctgcttcaaggtcagttacactacttcctgggatgggcctttctctggcttaagcttggttgtccctggctttcccaaggatcacagcccaaaaggcacagtggggaaaatttatggcctattccagaagagtgagcagcctaatcaagccaagccttgatttggggttctcacttcactggtattttccctctgtccctaattgggttttctatagttactagttttccaggcctccaagggagattctgaggcttgatgtgttctgactgtgtcttggctttgtgatgctgagtgccagaaatactctgtactataaaaactaccatcgttctttgaaacaacaaagaggaataaagaacttaattctggtgactattgttttttttttcttaaactataagatgactattatactaatatctagtttgtacccaacttgttttaaaaaatgaatttgaggcaatttcttggtttttcataagaacttttactctcagaaactttactaatgataatcctttgcacttttacacattgttatttgaacttaattacctattaagggaagcagagcagggattacaatgcctgcttacggaatacaatgtcatacactagcttttaagaggaggagccagaggtacagagtcaccactgacagcagtgctggtgcttgccactgcatatcttacccttttttcaaaacaccttgagattattctcaacttgtagctgaaggggccacaaatatttattaacagccaaatcaagtggaatgatagctttaacttaactgctaatttttacttgactttgtttgttccattgagacgtttaaggcactactgaatttggccaaatttttcagcataactccttaagctctgtcagtaggtcagtctgctctcttaatttcactattggaaagctttcaggctgggcatggtggttcatacctgcaatcccagcacttttggaaagctgaatcacagaaaaacatccttggctggtggagaatgcctgtgtcagtagaaaactgaaagaagggagccaggcagaaactgataagggttgagaggcggcaagagtcctgatgatagccagtagggtccttcactgttgtgggaaccagtgacccaccagcctttatttcttaagctagcttgaattagacatatctatatatgtagcttgcaaccaaaagaatttaagtacccatcctcacagaaacttgattaattggtacctaaacttgttagtcactacctggaactgaaatgtaagccatgaggagttaactttttttttttcctaagtttgcatgcactctcttgcctctattgcctcaagaagccttgatagaatccccacttgctcattgcctggcttgggtgttacagctaccttgatctcctctttggttacgttgtatgcagtttgtaatccatcttcgtcctctttgcttataagtgccttcttgaggggtggctttgagactgcttcatcaacatcatgatctggcagttttgacaaagattccttggttgattgatagtccctgagtgacgtgtccagtttccgtctgcatgcatttacagccatgcagaggtttggggacttagcgggtggtaattcctcacatcctcgtagcctaaatactttgaggaaaggaaatagttcctcaccattttcctcaatcaggcatcttctgaccatcaggaacctcatgatgtcatgacctactccagtcaacaaagctgcatggttgaaaccttcctcaatgaacctatgcattgtcacatatggtgtcatttcagaaaatgtggcaatgagtttaaattggcttataaaggtacacggggtcatccgtaggcttgggtgagcatcaagtttaaaacgaaagtatgtgattttgatgtcaaggcctttgcatgctaaccatgatgcagcctctttaaagtcacacacaggatctagatcgactgacagagacacctccaggcctgacggtagatagtagagtattaaaccttttggcgatttgtcgcattggattgccactcagcttgcacacaatgtaatatatcagaagacagctttagcgactttgcacttgtgttgaagttgctcattttgttccagtcagccatgaaccatggagcattttgaccctcttttcccaagactgatctgtctggagtaatgaattctttaagctctggaacgagggtataaagttgatcaaaagtagcaacgagcactgtgatagtaactgacacagtacctcccaaagtgagagagtttgcttttggaattgaaggaagagctgtgcaacaggcagcgtacacatcttaagtgaggcaacacaatcacaggttgatcaccttcgctatgttctagtggcatgtttgcaggttccaatcactaggagctttaatggctttgttaacctgttggtgatgtcgcatgaagattgtctgacaaattactttaaatactaaagtttgataaacagtattacctaacagtacattaccaggagagacattgggctagaacagagagagaactggactaggaggagccaggagttcaaggtccttgtcctagagcttgtcagtgacctgatggatgactttgtgcaagtcactggccctcctgggaaccagttgattcagctctatcatgagcacaacccttgcccagccccctcaccagagagtggtgtagatctgatgagtcagtgaatcctcaaaagggtttagaaaacagtgaagtgttgtgtcaataggaagaagataaattgccatcctccctttgatctccattatccttcagcactggcaagatttgactgttggatgctaagaatgagagtgatgcagaaagaggggaggaaggcagggcccactgaggagggaactccaaggtggacgaccgtcatgccttgcctcagtccatccttagcaactgcaggcctgatgattttcaccaaccttctgactgtgccccagactttttgctcccctgctatgaggaacaacccagcctgggtatggaagagggaaatctcagccccaagtagttgggaagggacttggtctgagtggtctctgtcctctgcccaccacaaggccaggtatattacagtataggaagaagagtacaagggaaataacatttgtaaagtgcctactatgtactttgggttatacatacattctctcgcttaattcagcaagcctgtttagagttaggaaagctgagattcagcaaggttacacaatacattccaatgtcacacaaccagtaagtgtgacaaaaacctctgtttttgtcgtatagcaaagaagaggcagaactgaggggcaatgtttaccttgcaggttgatatgaggcaaagatagtgcctcttaagtccttggaacatggtggacattcagcagctggtaagaggcagctgatgaggcaactgtaataatgtatcttacagtgcactagagtcacctctcaaaccaaaggtttcccccttccattttatccaagagaaatgcattcatttctctccttggaagcccagacctagctggagattattttccagtgcccccaagcttcagatcagatggcttccaagactcagagtcatcctaaacatagtttctgttgtcaccaactaggaatagaatcagaaatgagaacctggattctcttaaggtgtaaacagaacttgatagcagatgaagctgacttagtgccagaggcctcagacacgaggcagatctctgagtcacaagttggagatagattctgtttgggactacagccagtaaccctgtctctgcctttccccactatggggcagtctctgaagctgtacccagtgactaggtctcagcccaccattgcaatgtggatgttccttcacacatcatccctaatcctcacaacagccaaagaagcaaggcattgtccccaacctgcaaatcaggaaactgagccctggaaagattgagtcacttgggaaaatataggtttttcatctgtaaaaactagaataggctgggcatggtagctcatgcctgtaatcccagcactttgggaggcaaaggtaggtgaggagttcaagaccagcctgggcaacatggtgaaaccctgtctcaacaaaaaaatacaaaaattagccaggtgtaggggcacgcacctgtagtcccagctactcgagaggctgaggtgggaggaccacgtgaggcccaggaggttgaggctgctgtgagctgtgattgcgccattgcactccaacctgggcaacagagtgagaccctgcctcaaaaaaagaaaaaaagaataataaaaataccttttatctctgagtcacaagttgcagatagataaaacttttttagataaaagtttaaacctttggcacatagaagatgttcaaaacatgggagctgccttgattattattttttcctacagtaatcatactagcccataatgtgtgcgcaatgtgtatgtgatggtctggatatatgtgtcctccgcaaattcatatgttgaaacctaacacccaagatgatggtcttaagaggtggggtctttgggaggtgatgaggtcatgagggcagagtcctcatcaatgggattggtgaccttataaaagacccgaagaggcttgttagcccctttgcccttcagtcatgtgaggatgcagcaacagggtgccatctgtgaggcagaaagcaaaccgtcaccagacaccaaatctgctggtagcttgatcttatacttttcagcctccagaacactgagcaataagtgtctgtttaaaaattgcctagtctaaggtgtttttgttatagtagcctgaactaagacgtgttagcaataccttcaaatttatgtgtgcatatgaatcacctgaagaggtttttaaaaaaacaaaaaaagtttcctggccccacccactgcccctcaagcttccccctccacaagaatttaattcggtaaatctgggatgggacctgaacatttgcatttgtaacaagttcccaagtaatgccgatgctgcaggtgcacagaccactcttggagtagaattatgttatggtacttacttcttcatatattaccttacctgcctcctactcacacttttgccagcctcatgaggtaggaggaatacagactgttactactactgttcctatggaatcaagcttcacttcccaaacaggtgtccaacttgtgtccctagtctgtcagtcagctgtatccttcctgggtcagaaatttagctttctcatgacataataattacctggaattcctactgatattctttccaataaaggtaacatcatagcatgagcacagatctggacaagtgggcacaggatgtttcaccacccatacagctggtctgtaagactctgggctcagccgaggactggatagtctgtggacaaagagacctcgagttacttgggctgccaaggactcagctgtgtggaaggggctttttatccttgcaaaggggagaacaagggtcagagcacagagcataagctatgtctggacagttgccaagctagagattgctgaactccatgggtttatgggtcaaatatgagattcaagggtgaaaactgtggggcttcattgtacccatcatccagacaataacctgaccctatgtctgatctggactctcatgttctgcctttggtggccacactatggccaaagacagaggtcctcctgtgtttcttgatacctctctccttagctccctcccctaagcgaccccagattcagatttctttggggtcaaggcattggaaaattgtcaagaagctgcagtgcccttcttgctactctatgtgcctggtttcaaagctcaggtttctgttttgaagttgaattatggttataggccatgcattttgggttaacaccaagtcctatgggcaggtatgaattttgaggggtgggtgccaagtttgtttgtttaccatattattccatcccctagcatagtgggacttaagtatttgttgaatgaattaatggccattctatttttaatcacttggagaagcagagatccttcaaaattggaaactcaaaggtaggtcctgggtaggataggacactcttgcctttcttgatgcactcctttcatttggctttatggcattgaagtgaccctaaggatgatccccagcagcccgagttaaagtgagccatggattcaggaagatgccattgagagaatcccagactggagctgaggaagatctactttgccagtccaatcatccaggttcataatgtgttctttgttgctactcagaaaccttttctaaagcctggtctgaacactctagcctggcatctgctgtgtcaatggctgtaaggaatagttgggtgaacacatccgacctagagccctgaaagtggagagtgaggctcccaaaggccagaatggtggtggcagtagaaatcagtgagggaagacctaacaggaaagataaatcttgaggccagagtcaagaatctccaccccttatatgaagatgctgacttggaggaaagctataatgtccttacaactcttgggagagtaggcttccatgtctgcttccaaggccagtgagtatcccagtgcttcaggcattccaaatgggagggcataggtcttatactaggcccagagttggggcagatccttgtgagacttccctgagcttgatggggtggcagacacacttatacttgctaaggtgctgaggctgatcccaccagctagggacggatgggttccagattcagcggctcagataggtggatgtgtttgagcagggctgctactgttggtgccccatacagaagtatctggccaaggggaaaatgaggcctgaaatccagccaagagtggagctcccagcccttgcaattataaggctgcaactgtcagaaggggcaccttttctaattagcacagggtagaccttgggaaatcctgatttggggtgtccgaggtaggctaatcatggctgcctgagtatgctgggctgaggagtccatgcctggcttctttggggatattggggccaaaggctggctctccttgcactgtctgaaagaggttgacctgggcctgtgagccaggctgagttctcctctctcagggctatggggggatgcctctagtatatgcctgccctgcctagagcactctagaccactctcgaaaaagacctctgtactgaacaatgggggcctctggtctttggggtaggaattagtaaaatctattttcagtgacaagactgggaggtagggaggaaaacacttaaatgacatttaggagaatgtcatttctctcttagtgaagagagaaaaattaaattaaggttatgcttgcaatgaagaggagctttgagcagaagtgacaagtcttcattctaactcaagttttagcactttttttaagccttcccttccctctctccttcctttctctccccacccacccactgccttttttaactaactgagtgagaccttgggcaattcactaaattctgagcctacttttcttcctcagtaaagtgggcacaacaactctcacctcttagcttattgagaggatctagaatgcatttgtgtaatgggcttcagatggagataaggtgagcttgttctccccctccctgccttcttcccacttgtgatggttaaaactgactcaacttgattggattgagagatgcaaagtattgatcctgggtgtgtctgtgagggtgttgccgaaggagactaacatttgagtcagtgggctgggaaaggcagacccactcttaatctgggtgggcaccatcaaatcagctgccagtgcagctagactataaagcaggcagaaaaacgggaaaagacttgactggcctagcctcccagcctacatctttctcccttgctgaatgcttcctaccctcaaacatcagactccaagttcttcagttttgggactcagactggctttccttgctccccagcttgcagatggcctactgtggaccttgtgatcatgtgagttaataaaatcccctttgtatatctatctattttattatttctgtccctctagagaaccctgactaatacagtaaattggtaccagtagagtggggcattgccgaaaagatacccaaaaatgtggaaactactttggaacttggtaacaggcagaagttggaacagtttggagggctcagaagaagagagaaaaatgtggaaaagtttggaactccctagagacttgttgaatggctttgacaaaaatgctgataatgatatggacaatgaaacccaggctgaggtggtctcagatggagatgaggaacttgttggtaaatagagcaaaggtgactcttgttatgttgtaacaaagagactggtggtattttgcccctgccctagagatttgcagaactttgaacttgagagagatgatttaaggtatctggcagaagaaatttctaagtggcgaagcattcaagaggtgacttgggtgctgttaaaggcattcaattttataagggaagtggagcataaaagttcagaaaatttgcagcctgacaatttgataaaaaagaaaatcccattttctgaggagaaattcaagctggctctagaaatttgcataagtaaagaggagccggatgttgatccccaagacaatggggaaaatgtctccagggcatgtcagaggtttgcataacagcccctcccatcacaggcctggaggcctagaagggaaaaatggtttcatgggctgggcccagggtccccgtgctgtgtgcagcctagggacttggtgtcttgcgtcccagctgctctagctgtggctgaaaggggccaatgtagagcttgggccatggcttcagagggtgcaaacatcaagccttggcagcttccacagtgttcaaaacatgggagctgtcctgattattattttttcctatagtaatcatattagcccataatgtgtgcacaatgcatatgtgatggttcctgccccacgtggtgttgagcctcccagtgcacagaagtcaagaattgggatttgggaacctctgcccagatttcagaggatgtatgaaaacacctggatgtccaggcagaagtttgctgcaggggcagggctgtcatggagaacttctgctagggcagggcagaagggaaatgtggggttggagcccccacacagaatccctactagggcactgcctagtggagctgtgagaagagggccactgtcctccagactccagaattgtaaatccactgacaacttgcaccgtgcacctggaaaagctgcagacactcaacgtcagcttgtgaaagcagccaggagggaggctgtaccctgcaaagccacaggggaagaactgcccaagaacatgggaacccacctcttgcatcagtatgacctggatgtgagacagggagtcaaaggagattattttggagcattaagatttgactgccctgctggatttcggacttgcatgggccctgtaacccctctgttttggccagtttctcccatttggaatgactgtactcccactgtatctaggaagtaaccaacctgcttttaattttacaggctcataggtggaaaggacttgccttgtcttgaatgagactttggactgtggacttttgagtaaatgctggaatgagttaagactttgagggactgttgggaaggcatgattggttttgaaatgtgaggacctgaggtttgggaggggccaggagcagaatgatatgatttggctgttccaccacccaaatctcatcttaaattcctacatgttgtgggagggacccagtgggaggtaattgaatcataggggcaggtctttcccatgctgctctcatgatcgtgaacaagtctcatgaggtctgatggctttataaggcagagttccccttcacaagccctctctttgcctgctgctatccatgtaagacgtgacttgctcctccttgtcttccaccattattgtgaggcttccttagccacgtggaactgtaagtcaattaaacctctttcttttgtaaattgcccagtctcgggtatgtctttatcagtagcatgaaaacggactaatacaactaatacaccactctcatgtctgggcagggccagtgggcctgggaggcagagtctgtcagtgggactggggcaataaggggtctctcttgtgtctgaaggaaccacagtgacccactcagggggcctagaggcagtgaaggctgtgggcctgccacatcttgtcaagactgctcaagcaagtcctcactgctcctccagctccctgccaccctccaatccattctcccacataatggctccttcgccagaaggatgaagactttatgtgggtgttcagggcctgatctctctaccccatctccacaacagtcctccatacacagcccaatgttcctgaacaggtcacagtatttatgcctctgtgtacaccttgctttgtctgaaatgctctttctccttctttgatagaattcctccttttcctctcaggatctagcttaaatgtgccattcacgggggagcctgccctaaccccagatcaggtaggccccacttctggccttccactgtgccccttctaacgttgcactgcccattctgtgtggaatgttctgttgctatatatggctccttttctagactgtgagctcctcaaggacaaggaccacatctgatcctttctgtgttcccagtgcccagcctagggtctggcagagagtatgggccccacagagcttgttgaattagtgtgtatgtaagtgaaaatgatagggtgggcagttgtgggtaagtggcgagtggcaagtaggtttgtccccaagcctgagagggtcacctgaattgggtacagagttgagaactcatcattttggtctcttttaccaaatgagattgggtctgaatttgattaggacatgttatctgtaagactgcctggggctagcaagacaaaagtctaaaatctgaggtatctgtaaggagtagtcagaggagaccatgggccctgcacagctctgtccaaggcttggaaacaacttcaggtggataggtatggataataataccgtagtcagtccttcccatgtgggagtgaggctcccagcgaacagtcccacaaatcccagaacagtccctctagtgagtcagagatctgggtaatatggaagtcctcagattgtctgctcctccacccttctggaatcacactttccctcagtttcttaagatgttgcaagtcatcggccgggtgcggtggctcacgcctgtaatcccagcactttgggaagctgaggcgggtggatcatgacgtcaggagttcaagaccagcctggctaagatggtgaaacccctctctactaaaaatacaaaaaattagccaggcgtggtggcgggtgcctataatcccagctacttgggaggctgaggcaggagaattgcttgaactcggagggcagaggctgcaggcagctgagatcacgccactgcactccagcctgggcaacacagtgagattccatctcaagaaaaaaaaaaaaaaagattttgcaggtcatcatcctatattctgggcgaagcatagagtctttcccaagagcctgagagttcctgggagcttatattctgatcacctctcactcttaattcctgctgctattgcattcttgtgactgtgactgagttgttttgctccaggctctgatgctgcccttgctgcctctttccccaaagcaccaggtgcaagcatgtgcacgtaacagactttccttcaagagttgagggtaaggaagtgagttatagcacaatgcagagccgaaaggcagagcaggaatcattacctgctttgtacaaaagaggaaaccaaagcttagatattaaccaggtgacttgactaaagctatacagcaagttagtgacagaactaggcctggaatgagctctcctgatccagactctagagtcagcatttcacggttctgaacatctggaatccaaagagctgtccaggtttaggttaagaacagttccacacacacagaaagacggtcctgggtggcaggcagtgaaagaaacctggggagctggggatctctatgagcgtggctcacctccccctctgtctcctggagctgacccttgctcatatcctgcgggaacaagacccaggtggatcaaaactttattgaggccctgctcaagacaggcacagtagtgcagtaggtttaatcttcactatggttctgcaaggctggcaacattattccccattttagttgagaaaacagtctccaagagtggaagtgacttgctcaaggtcatacagatagtcaggcctggctctgagcctgaggactcccagtccccgactctgctgcaagctccatggcattgccaacattgaccaccaggtggcaatctcccccaactccctgcaggccacaagcaccctggaattttaagcagtaatgcctatggttggtggcagaacagcagtctctgcctggattttcaaaactgccctgaggcagttttataactcttttgtcccaaggggaaattgatgtccaagagggatggtggctttacagaggaggaagttctatgtgtgtgtgcgtgtgagcatgagatctgcttctggttccaaggctggtgaattctgctgacctattgttagctgggagttggtgggcatgactttcctggcacgatgttcagtttctcctctgtgcctgctgttgccaagcctcactcagagatgggcagccgagttttccttggactcccatcagaggcccagggcccaacctcttgtttaggtggggtcagacttacctggtctgaggccatctgaacagccctgtggatccttcccctattttaatctgtgtgcttctttgtatggagccatggaaactcctatgatcttccatgcctgcctacagccaggaaacactgggagagagtcctgtgcattcttcctgcagtactcaccatgttcccttcaggctctgctggatggaccagaccctctcagcaggcttcccgccactggatacccctttacctctgtgctgctcagtggcagtcccagggtgggcctgtgagttctcggcacagcaaactttctgcccagatgccagggtgaggctccctttctggcaggcacgcccagcttctatgcagggcttgggcacattctccattccccatcatggcagtgactctcagcacaaacaccgcagtgttcacaaggccaccccaacttctccccccttccctcctatgtcctctctttgtgtgtgtgtgcacgtgtacgctccttcatgtctctctttacagagtgtggtcttagagcctcttgtcctcagctttgggccttcactgcaattccacaaatccagaactcaaggaaagtcctgctatacgtcctgtcaggtaaaggtagtgacagctcccttgccagattcagaggagagttcctgggagtttcctgaacgcagggctgtcgtttgagctctgtgttccgagcacccagcacagggcctgcatgggacaggccccaaggggagggaggtggttctcacatgaatgaagggccctgaactagagcaagttagcctctcagaacacaatgagtccccttcttctgtagggcaccacacatccctctgcagaaactgagggaaagtggagaacagagcaaatagtgataaaggcaagcagcacgcagtcattatgtcaacgtttctcaagtttctctcatgcatgtgcctcctccatgatttttgctaaatccatggattcttaataattttctttagcatattttatgaaaatacctaattcatggtctcctaaggaataatattcatgaaatcactggtttgatttatctttcctaatatacattaaattatatacatacctattaaaaaatagcaaagaccactgaagtaggtcatacctaccaccagtgagatgtatactgcacttgggttatttagttttcacaaaaccctataaggtcaatcatgctttttctgtcttataggtgaagaaattgaaggtcagagaattgacttggctgaggtcacacagtcttctgatctttggcctacagcctttataaagatgggagaggggaagggaggagcaggtgcttgggagatgatgggggagggaggcagctgccactgaaaaatgaaagaagatggtgaagatagggagtggggggcaggactccatgtcagaaaggcaaatgacctgagtcccaatgtcctatgcacagtaatggccatgaaaatagctgcagatttgcctgcatttgtatgaccaagatttattgtgccagcaactccggtaattggatgatgaaagcactgcagctgggactgttggctggagattaattattagagagaggaggtaggatggggagtagcctggatggtgcccagctgtggagagactggaacccactagaagagcaggcaggcagacctcagacatctagtggaccctcctccccactcagctaagacccagggagggaggcaactggactgggccaaggccacagccattccacagcaaggcaggatgagagctcttctctgagtgaagttgattttccagaaaagatgggcagctacagcagcaggaagggcctgcacttggagtctgagaccagaggggaagcctcagctttgtctcttacttgctatgtggccttaggaaggtgacttagcctcttcgaacctcagttttcccagctgtacgatggagatgatggcattgactttactaggaagtcatgaggctccaagattattgggtcctgtttagatctaggacccactcagggacaactttcattctcaccccctctgctcaggtctggccctcatccttcctgcctgggtcctgtgaaccccttccctgctctctcatcaagccctaaaacttgatccttagccactgtggggactttctgcgtgaatgtcaagtctcccaagtaggaacctaaaagggactgggagatggggggcaggggtggatcccaagaagaagtcattttccctcacagccttagttttctcatctgcaaaatgggaataggctttatttggatttattctgttgcaaagaacagcaaaccacttgagcccaaccaagtgggttggggaaggagccaactatggggactggaactggaacctgcacattggaaggaacacaggccacttggggctagcttctcctccatctctttgtcaatgggtctctgttgctatctgcccatcttccaactactcataggtggattctttccctctctcctctctgtcttaagcttctgtttcctcagaatctctgttctagcacaactttttcttacatgtgactgctcatggctccatttcaactccatagttcgttcctctgggctcctttgtagaaactagtagtttctccccatcctgctcaattcacgtgcataacggagggaatctgattggccctctgattcttcctgcccaaacttgccagagatttgtagactggtttatggtctgcaaggccctcatagatttgtgggagtgacaggccctggatgggcagcagggaggggttgaagttggattacctcatgtatataaagtgctgcaatagtgcctggcatactataggactcagaaaactttgaatgaaactcagaaatcttcctctcccaccatagacccttctcctggcccctcccctttccctcacctttgcataggcctccagccttggatccctcttattcctgcagattttcttggcctcccttccttccctggctagcctggtcttagggtagggtgatcttcctgccccgatcttctatagcaccctgcacttcaaaaaactttgcacttaagtctcccaaccgcagctgtgctctccccatcagcagacaccctgccaaggtccatgtcactgggaagggagtaggagagctttatacgtagctatcattcactgagcacctctaagtacctggccccatgttcagtgctttacccatttatgttaagaactctttgcattcttcccttgagatggagctttttccagatgagaaaactgagattgagcatggtgaagtgacgtgaacccagctctaactccaaatccttggctcaagagcaaagctgttggtgtgaactctatcatcatttctcccttccaaatacagttgccacaggccacaccaatattttcccctttctttctggttttacaaaatgaattagctaacagctgatttttattaccactaacagataatttttgttaagaacttaacatgtgctaggtgctgttctgagcactttacctgtatcaactcattcaatcttcataacaactctataggataagcactatcaggatccctgttttgcaaaactctgccttaacttaaggcaggaccaaagtcgcatgatgctggtggagccaggatttaaagcctcactccagttcaagccccgggagcccattttctgcctacttcctctagaaactccttccatcaatccctccctcacctctttaagctacctctctcccctggctccttagcatttaatgtgtttacaactttcccatctcaaaagagtcctcaaacccatgttactctgcagtcactactctttccttcctccctgtcttagcccaatttcttgagtttctctacttgctagctattcttccttacccctcttcaaaccagcctccacccccccgcccctctgcctaaactgccctaagcataggaagattgtgccgccacattcccaaaggaaaaaaatactcccttcaatagcctaaaaatactgtcaatcaaacttgaaatcagctttctaaattgtaagacatgtcacagctctagtagttctgaaacaaattttttatcaagagtaaaaaacgagcaaagataaatactgaatactttggtataacttaattagtgatgacacctcagttgagccttctctatgcagctggagttttgcttttctgctcaaatgccctctaatattatatccagccaaggtatcattcaagtataaagacaacagctaaagtgtccttaaaggcaacagaccaatacctgcgctgttctgttttgcttcgtccacacagtttttattcttcttcactcatttaacatttcagccatggtgggctatgaattctttcttggtaactaaaattgtttgtaaacggtattaaaataagtctcctttttaccttcttggtggtttctcagttgtcatacccccatctctcctctgtttccctttctaatactggtacttcccttacttggctaaggatttctgggagaggttggataggagttactagtgtcccagtaatgctggtcaaaactttccccatgcccagagcccagagataattcaggaccacaggtagagtgtgtataggtcccactgtttgttaacactgtgtccatgaagactaccttgccaaggtttccaatgactgctgcatggagctcttctgccccactgctgcttgctgatctctaaacccaggtgaagtttttcgctttcaccttacggactactgggcagcatcagggaccatttactccttgaccttcctgaagcaatttcatattgcaccactctactttctcatctgccctcttaagctcatcctctaaggtctggagttctccaagatcccagccttgattttccattcaccatacacactctctttaatgacctaaaccactcacacaactgtgagtactcatttgtcagcaatttccaaatctctatttccaggcaggtcctggctccacacccaaatattcaattgccctccagttcaactggccaaaaccaaatgcatctgtttctcccaagcctgctcctccttttgtgctctctctctctctgtccacccagtctccctgcccagaagcttgcacatcatttttaaacactcttttgctttccatttccaaagattcacaaaaatcagatggagtctgcctttgtccaatttgtgttgttataaaggaacatatgaggctggataatttgtaaagaaaaaaggtttatttggttcatgattctggatggctggaaagctcagcattcatcatctgcatctggtgagggcctcaggctgtttacacgcatgggtgaaggtgaaggggagctggtgtgtacagagatcatatggagagaggggaagctctcaagagggagtggggaggtgccaagctcttcttaaccagctctcatgagaaccaatagactgagaactcacccctaagggagggcattcatctattcatgaggggtccaccctcatgacccaaacgccccctattaggctccaccttcaacactggggatcaaatttcaacataagttttggagatgacaaatatccaaaccatggtagaatctatgcccctttaggctctctagaaactgtgccttcctttctaggaaggagaacacagtagaaagacctgggttggacaggtataggctttagggttggacagacctggtttgaaatcctgcctctatcacttaccggctgtatgactgtgtattaagggcaactctcttaatacattcaaatcttaatttccttatctacaaaatggggataataatctactttgaagagttattgtgagaattagaaacaatgatgttcatacttaggactgtgcctgtccctactaacacttaatgatagtattcattataataatgatgatgatgatttctggctccactgttattgctttatctaggatatggtcttttctctcctgaaccatcacatgagtttcctcactggactctctgtcttcactctctgttgactgccaaatctgcttttcacatagtagtcagaaaaatttttctaaagtacaaatctgatcatgacattcacctgcttaaaactcttttctccccccattccatctaccctatgccccagccatacttgcaggtctctgagcacacattggtcacacactcccttctgccatgctttattcaaggagttccctttgcctaaacctgaatgtattctctccctcccctccctcacgtcctacctgacgaatcctcatccatcacacccagtgccaatgaatgccacccctccttgggatgtctgtttactttgagtcaactgctagctccttgagggcagggatcaggtttgattcttctttgtggccccctgccttcctgcacagggcttgacataaagaagccctcatcaaatattttcagacacttgctcaaggttgcacatggggtcagaggcagggttgaggcttgaacccaggtctctcatcttcctgcttaggattctcctctacacatgccattttgccccagtggagaacaggagtgcagggttagtgggttgggggtgggggacctccccatgtgagggcagcaggcaacctgaggacatcccacactgcatttcagtgctgcatctgctacactggggaaggataaaattatccactgcccacgtcatgtatctccccatccgacggggactagagataaaaaatgaatgacacaaaatccaatcttgcctggtgcagaagctggtgggggtgggggtggagctggtggcccaagcagccactcattgcacagcacatctcatatttattgactcataattgaaggcagcctggagatgtcccagcattggcccctgacaagacagatgagggcaaaatgactgtggaggcagagagtcaggatacagacttcctcacaggactgcagccacagaagggaggcaatggtggggagtggggacagctaactggctgttgcactggccccggggtctgactcgggttctaggtcctgctctgctacccacttgtgattaccttgaaccagaccctcccctctctaggccagtaattttagccttcttgatttcattaccagggtttaggaaaatcattctgggagttgggaaaatctgggctgctaacttgctctgtggctttaggtgagtttctttactctaagggctttgtgctttctctttgtaaagaggaaaggatgcctccctcttctatataaagattgagggggttgggttggcctaggagcagccagtttgtgcattttagcaactggaaagcttctggttgggggaagacaaagaaacaagaaatgctgccaaatattaagaacctgcaatgactcctaattgctcacagaaatggtccaaattcctaggcttggcattcaaggctgtgaaacctgcatagtcctacctctagtatttgtgtcattatggggaaagtgtctggggctggcagccaggaagcctgggttctggaccagtcttaccactatctagctctgtgatctctggcaagttcttgatcatctccaggtctcagtttccccatctgtaaaatttacataggtgatctatgaagtaattagggtccccaagcccagagcaagtcagttgccaagttctatcctctctccctctcagtattccctaaatccattcctccctcacccccattccattctaattatgaccactgtctcacctcagtactcctttctctcttcctgaccagtgcagtagcctcttgtctcccagcctccatctaccccctccatactccagtcagagtgactcagaaagcatgtgactgaccatgaccctcgcctgcgtcaagcccttcctgtgctctccacacagctctcagccgagctcctgagtgtcacatggaagatcctgcatgatctggccctatcttatctcttttcccactcctcctgtgccccgactatctgtaccattcaggctggcctcttcactgccctctctccagctcagactccaggatgaggcttccccaagctggccaggaggaggccctgtggccctgaacacagtagtaggtggggtcagtgtcatgcctagactcctgttctgcctttccagaagcttctggagttccaagccccataggggtcctgctccatggagtccccagagcatcaggtgtgaatgatgctgcctgttctccctcctgctgctgacaaccagagaatgtctgagccaaaagggccccagaggtgaccttgacctcctaaaaccccacattgtatagatggagaaactgaggcccagggaggagcagtggtcacacagcaagtcagtgttcatcagggctggagctctgccttgtgcctgctccatggggttggggacacagggctggactagggtagccataaagagaacactccacgcactggggcaggaggggccatcagccctcccttcagtggtggaggtgagatactcagcaggagactcagggcagggaaagaggcttctgccagtctcattcccatcctcaccgcgccccctgctggttctgtcctattagggcttccaggtctctgtactttacctcctcgccacatgtccagccttcctgaggtgggatggggaaagggaggaatcaaggtagccagggcaagcatttgtgagcatttacagtcagagctgtgaggacctctacaacatcctgccaagtgcctatctagtatgtttcatgcacgccagtgacagggactcgctttctcctagaacggcaccaccctttgggagacatttggcccaggcaaaagagacttctcaggagaagctggggttatctgcagggtgtgcttctgggcccagcatcaggagatgcagaaaatgatagagagacggcccacctctaggatggcttttctccaggcctaataaattatcagacgttgtggtttctggccccttcccagggcacaaggtcccttatcagagcttttagtccactgaatccagtcctcagagagtgcagaaggggagactgaggcccagggtaggggtaggatttgcctagttcccccagcatattagggctgggcctgagaccagaatccaaggccccagctcctagctgggagccctcccagcataatatgttcccactctacggcacggagtgtggggtgtgggggacttgcacagagacagagaggagtaactgctgagaagggcttgtgatagatgaatagaagccttccctgcaggagctcagagtccagggagagggccacaggcaaaggaaggcttccttgtccctccctataggatagtgcatgctccatctgggaggcagcaacaattgtgcacaaaggccaccatttagcccttgctcacccaggaatccctctctgtgtgcatgtgtgtgtgtctgtctgtctatggactgcctctgccctcaatggacaccatttctaattcattcaccaggaaagtgggcttttttgctatccatctgccatgaggggatttcataaatcctctcttttttattttgagatggagtctcactctgtcgcccaggctggagtgcagtggcgcgatctcggctcactgcaagctctgcctcccgggttcacaccattctcctgcctcagcctctctagtagctgggactacaggcgcccaccaccacactcagctaatttttgtatttttagtagagacggggtttcaccatgttagccaggatggtctcgatttcctgacctcgtgatccgcccacctcggccttccaaagtgctgggattacaggcatgagccgctgcacccggcctaaatcctctcttcggctgtggtataggatagtggtggcttgggccatgtgaacacctgcagattagtagtttgaagccaggagagccagggcgttgaatgccagaccaaggagcttagactttgtcccacaaaaaatgaggatgcaatgaaggttttcaagtacagaatgtcatggtcacatgtgttctaggaagatctctggtgtgtaaaaaagaaggtgggttggagggagccacaaaagacaggtggtcaggaaggatgctggggccatgatgccagagaaggataatgaggttcagtgtgggaagaggtcaggaggatggacttgagagatattctgacagttgagtccagcccaaggtgaatagcagatggggtgagagaagaggagttaaggtatggcctacgtttgacctgagggattagggtggtggctaggagagtgctagaaagcaggctttcctataggggagtgctctgggcccaaccttgaggccaccccattcacctctttacctattcatcactcatccaccttcccacctacccacctacctaccatccatccatatcccaccaaagccttcccctttgccaggcttccatgtgccaaggactcagaaaataaccagtgccgatctctgctcctgtgggcccagagagacagattggctctccttcaccctagtagtacgtctggttgctggcctctgcccgtggagaaggtgatgtagataacttgctggcatttcttcccagaaagttattgctcattcaggcttggggctggggagagagtctccatcctgatgagatcagtattagacttgcaagtgttagccattaacagcttcatggcattgtataggcaccagttcactaggaagaggctcaactcccttccccatcttgggcctgcccttgctgaagttcccaacctgatttccatctctgatgaggacttgccctgccaggttcagccacccacccattcagaaacatgaggtcctctgctgggtatcaggaacacttggtctttgacctctcatatctcacagaccaggagatgggagatagagacccttaagcagggagcagacgaggctaagtcactgcagtggtgtgggtagagaggaaggcaaggatgctgtagaggtagaactggcaggaattcgtggccaactgcaaataaaggacatgaggtattcaggctcctgggtacccacaggtgagggtggccagttaggagctttggatacatctgacctcatgggttgtttctaaggcccaggcccacaggaccttttaagaggatgacttcttggtcagaaagactggcttctgcatggggaagggtctatgtgagtctccataggtccctctccacctcccagccaaccatcagaaccatggactcaggtatgaaatcactgcttcaagtgaaaggctatttcatgcctcagtagtaaagagcaggcacaattgaatggccacattaagtcgcaccattagggagcttttccaagtatgaggttattagtttcttagatgcaatttcataggaggaatttggccaaaacgggaacttgttcatctaagctaaagcagcctatttaaaaagcaaaattggctgggcgcggtggctcacgcctgtaatcccagcactttgggaggccaagacgggcagatcacctgaggtcaggagtttgagatcagcctgaccaacatggagaaaccccgtctttactaaaaatagaaaaaatttagccacgtgtggtggcacacgcctgtaatcccagctacttgggaggctgagggaagggaatcactcgaacccaggaggcggagcttgcagtgagccgagattgtgccattgcactccagcctgggcaacaagagtgaaactccatctcaaaaaaaaaaaaagcaaaaatgagtgttacccacatagcgtgtccatcagtgacatcataaaccctgtgcttattccatgaataattatcaagcactgtggcaagtctcagtgccaggcttgggaatccaaaggccctgcttacattttcctttcatttttttgctcgtttagttttcatagtttcattttcacatttaattatttaactcatgttgggtttgttctggtgtatggtatgaggtgaagctctaaattttcccccaattggtctgggtatatatgagttgtaatctaggtcagaatttcccagaatgattccatagaaaactgatcctataagatgctcaggaataaaaaagattttatagtcaaaaaaagtctaggaactgttgcatacccatcaccttcttagagattcacaatatatattaacaagcagtaaggaaactttcatgtcttggttcataattttatttgagtacagaccccatttaaaaataacagctatgagcacagcacagaactctccaccttggagtaaagatggccctacagcagaactgacattgaggcctctgcctcagatctggcttccgcactcttatgggtctgcgatctggccaggaagtgtaatacacacactgccagttctgctccagagcctgcagtgctaagaactttgccaggagccacaaaccatggatgccctcagggagggtgaggcagcttgtctggcatttggccaagacttcaaagaggaacagttgccctgggccttgaaagatgagcagggtaggtgaggtggcccctgtgagggcagaaccctctccagcagggacactctgtcacggcagtgacccagaccatgcccccagaactgcaggacataaagagctgcatgaacagagatgcctgtgaggagctaggtgagagcagaaatgcctgtaacatggggcaaaggtggctgtgggtatgctgctggaactctcctgcaggtgtaagggaagggcactcagcattcactttcaagtgctgggcccctggtaaggcagggcctcctggggcctcattacaacacccagcacagaccatacatgtggccctctcctgaggcctctctttccttggggagtctacaaagtttttttcttgtctgaaacaaataactggggagttggggtggggtgagaggagaatgtgtggacccagattcctagggattaattagggcccttcaatgaaatgtttctcttttggaggccaattaagacaactggaagcttgggaggtgggaaggggggaggtaaatatgtgtgttgtgcttgagacaggcccattttcctctgctgggctgggcccctcggggatgggcagaccttgggggcaccctgtccatttgcagcaaaaatactagtgcaaagataatcacagattgtttttatcatctaagaggaggattttagtggtgcaggactttagtggtgcattatgaagtgtgttatctcagaaattaccctcgcctctgtagtaactgcattatactgagcactcactaggggccaggccttaggctgggcctttacagtcatgatttcatttttaaaaacagctttactggccgggcgcagtggctcacgcctgtaatcccagcattttgggaggccgaggtgggcggatcatgaggtcaagagactgagaccatcctggctaacacggtgaaaccccatctctaccagaaatacaaaaaattagccgggtgtggtggcgggtgcctgtagtcccagctcctcaaggctgaggcaggagaatggcgtgaacccgggaggcggagcttgcagtgagctgagatcacactactgcactccagcctgggcgacagagcattactccatctcaaaaaaaaaaaaaaagctttaatgaaatataattcgcatatcatacaattcattcattgaaagtgtacagttctatggtttttagtatattcacaaaattgcacaactattgccaaaatcacttttagaatgttttcatcacctgttagcagtgactttccttaccccctccccaattcctccaagccccaggaaactgtgggtgacaagccacccaggtgccaaggcaagagactgaggacacaagctgttccagtataataaaatataaaataagaatagttataccagatatagatcctaggttatgattatagagtgaggattattataatattggaataaagagtaattgctaccaactaatgattaatgatattcatatataatcatatctaagatctatatctggtataactattcttattttatattttattatactggaacagctcgtgtcctcagtctcttgcctcggcacctgggtggcttgccgcccacaggaaaccattaatatatgttctgtctctatagatttgcctattctggatatttcatataaatgaaataatataatatgtgctcttttgtgatttgcttattttacttagcataatgttttcaaggttcatccatgttgtagtaaattcatcaatatgtcattcctttttaaaaaacggctttattgagatatagttcacacacacaattcacccattttaagtgtaaaattcaatgggttttgatatattaaattataactttttaaaactatagtaaaatcaatataatattagccattgtaaccattttaaaatgtagaattccatggcattaattacattcacaatgttttgcaatcatcaccactatctatttccaaaaactttttcatcattttaaacaaaagctctataaacatcaagcagtaactctctatcctgtctccccttagcccctggtaatttctaatctagatgctgtcttatgaattttcctcttctagatacctcacataagtggtatcacacaatatttgttcttttatgtctggattattgcagtaatcatcatgccttcaaggttcatccatgttgtagcatacatcaaaatttcatttctttttatggctgaatagtattccattgtatatatactccacattttgtttatcctttcatcaatggatgtacatttgggttgtttccaccttttggctattgtgaatagtgctgctgtgaacattcttgtacacattttgtattttggatatatacccagcagtggatttgctgagttatatggtaatcccatgtttaatttatttgaggaaatgccaaactgtttttctaaaatggccacatctttgacattcccctcagcaatgtataagggtttcaatttttccacatcctcgctaacacttgttattttcccttttcgattatagacattctagtgagtgtgaggtggtatctcattgtggttttggcttgcattttcctaatggctaatgatgtagagcatcttttcatgtgctaattgtacatttgtatatcttctttggataagtgtctattcaagtcctttgcccatttaaaaattgaaagctgggcatggtggctcacgcctgtaatcccagcactttgggaggctgaggcgggtggatcacctgaggtcaggagtttgagatcagcatggccaacatgatgaaatcttatctctactaaaaaatacaaaaattagctgggcatggtggcacacgcctataatcccagctacttgggaggctgaaacaggcgaatcgcttgaacctgggaggcgcaggttgcagtgagctgagattgcgccattgtactccagcctgggcaacaagagtgaaactccgtctcaaaaaatatatataaaataaaaataaataaataaaaataaaaattgagttgtttgttttttgttgttgagtttagaaattcttcatgtattccggatactagtaacttattagatatacaaattgcaaatattttctcccattttatgggttgtctttttactttcttaatagtgtcttttggagtataacattttaaaattttgatgacgtccaatttatttattcttcttttgttgcctgtgctttttgtgtcatgtctaagaaaccattgccaaatccaaggttatgaaaatgtaccgctatgtttccttctaaggattttatggttttagcccttacactaggcctttgatccatttggagttaatttttgtatacagtgtaaggtaaggagccaaattcattcttttgcatgtgattattcagttgtcccaacaccatattttgaagagactattctttcttcattgaatggtcttggcattcttgccaaaaaccaattgaccatagatgcatgggtttattttttggagtcttaattctattccattgacctatacatttatatttatgccagtacctctctgtctctctatctctctctctttctgagatgggatcttgttctgtcacccaggtgggaatgcagtggcaaaatcatagctcactgcagcctcgagctcctgcgctcaagcagtcctcctgcctcagcctcccaagtagctgggactacaggcatgcaccaccacatgggtttggattgttcttgtttctctaagggaggagaccacccctcatattgtcttatgcccaatttctgcctccaaagaaagaagaagtaaaaactaaaagtcagaaatgaaatccacaggcagagagtccggtgtgcaccctgggcctggtagttaaaaatcaacccctgacctaactgcttgtgttatctacagattccagacaatgtatggaaaagcattgtgaaaatccctgtcctgttccgttctaattactggtgcatgcagcccccagtcacatactccctgcttgttcaattgatcacgaccctctcaagcagacccccttagagttgtaagcccttaaacgggacaggaattgctcactcggggagcttggtttttgagacgcaagtctgctgacactcccagctgaataaacctccttcattctttaacccagtgtctcaggaattttgtctgtggctcatcctgttacatttcttggtttcctgaccgggaagcgaggtgattggcagatgattgaggcagccccttaggcgacttaggcctgtcctgtagagcatccctgtgggggactcagaccagcctgggcaacgcagatccaaagagtgctcccaggtaggcaattgccccagtgggatgccttgccagagcagcatggggcaggcccctgctgaggatcaactcagtggctgaacactgagaaggaactgacatttggagtccagacatctgaagtttggtaagactggtctttggaacttgctcactccatttgagtggaagcgtggcccgatcacccatggtgtgcctgtaccggcactttggttttggttttgacttggtttgaattgcttgacaggattggtcttgggaacttgccgactctatttgagtggaagcgtggcctgatcacccatggtgtgcctgtaccggcactttggtttttgtttttgacttgacttggattgcttgatactttggttttggttttgacctggcttggatttatcgatactttgattttggttttgattctggtttggtgtaaactgtaaaagtgtgtgtgtgccctttttacccattctttgttttgtggtgtgcatgtggtgtaagtatggtgttttgtcttgaggaagcatgggtcaggcacaaagtaagcccaccccactaggaactatgttgaaaattttcaagaaaggatttaagggagattacagtgttactctgacaccaggaaaacttagaactttgtgtgaaatagactggccagcattagaggtgggttggccatcagaaggaagcctggacaggtcccttgtttcaaaggtatggcacaaggtaacctgtaagccagggcacccagaccagttcccatacatagatacttggttacagcttgttttagacccccctcaacctcccatagtggttgagagaacagcagcgtaacctgctggcagaggcaaggaaagaccagcagagagagagagagaggaaagagacagagaggaaaagaggcaaagagagagaggaagatgcagagagataaagagggagtcaaggggagagagagagagagagaaagaaagagagaggcagagagagaggaagagacagaggcgaaaggaaagtcagagagagagagagacagaaagtcaaagagagaaagagagatatacaagtagttaagttagttaaaaacagttaccctattcctttaaaagccaaggtaaatttaaaacctataattgataattaaaggtattctccataatccttaacccagtaaccaatggattgcccaaatgcattcaatctgtagcctcaactgttttgctaactgaagaaagtagaaaaataacttttagaggaaacctcattgtgagcacacctcaccagttcagaagtatcctaaggaaaaaaaaaaaaaaaggcaaaaaggtagcttactaacttaaaaatcttaaagtatagggccattctgttaaaaaaaaaaaaaaaaagaagatgatttaacattaaccactgctgaaaattcccttaacccagcaggtttcctaacaggggatctaaatcttaattaccatacaaaggtccgaacagatgtaggaggaactcccttgagtacaggatgatagacggttcctccccggtaattgaagggggaaaaaaaaagctatctataccaattcttagttaatttggactaaacaaggtcttattaatagcaaaggataatggaaatctcaaacttacaaggttttcaacaaaagtaaagtttgctaaaagttaacagtgtaacatgtattatagtaacttgtaatcttgtggccttagacagtctagtccacagacataaaggaagttcgctttggaaaagaatggttatcatctttgaaaaaaagggggagcagaatttatgtaaaaagaatgttatctggtaaattcttgtcctgaaataaattaactgattgtttaaagaaagaaatgtttgtaataaatcagaaagttgagacatgttgaagaattgtctgtgaaagtcgcaaaaaaaaagttataaaaaaagtatgaaagaaatgttggataatttaaaagtaattaggcctcctgaatgtaaaagtattgaaaaaacagtttatgtgcaaggtgtgtaaggaaagtaaaatatacctctggtaaaaggattataaggaggcataagaatgtggatttttacctacactgaaaggttaaaaaaaattgttttgaaggtttaagtaagttttaaaatattaattataaaggaaattatgtgtgtaaacatattagctaaagttaaaggggtatcatccagtttttctgtgaactggacattaaagtaaaaacacaataggtttttcttaaagcactaacctgctctttaacaaaaattataaaaggttagaaagagtttataaaaatcttaccttagggtcagacattaaaaattgaataaacatgtctacaaagttttattgaaactgagtttaacattaatagcacactaatataaaggtgaaatttagcttagctggtataaaaatcatacaggatgcattgtcaaatataaaatggtgtttggctttctttggtctaaaaactaataaaaataggtgctaaaggaaatttctcagtaagaaggcaccaaggactataaagtccactgctgatgtccccacatttaaaacaaaaggtcaatttcttaaaaattatatacttggtttatcttccactttcctttccctcaaaactaaaagtctgttagcacatgtaccacccctagaatttccagtaaaccagcaccagcctgaagatcacgttctcatcaaagggtggaaagaaagaaaacttgaaccagcctgggaaggacactaccttgtgctgctaaccaccaagactgctgttcgtacagcaaaaaagggatggactcatcacactgaagtcaagaaagcgccacaccctccagagtcgtgggccatagtcacaggggaaaaccctaccaaactaaagctaagaaaaatttaactctttcgtctattctattactctttcttctttccttgctctattgctgactatctagttattaacataactaagtcaatttcgcctcaaactattgcatttaatgcttgccttgttataccctgtggggacttgccaagtcaaagactgctcacttcagagaagtacctctgtccctcctgactctgctcagactaggcattagtaaattaggaccatttaatctgaggagattttgataaaggccccagtgtcaaccaggagtcttttccccaatgtagagcttttatgctgtagttggtccaatgttctgtggaccactaaagagcaaggatggactgccccaaccagtttttgtaatttcctaaaaccatacattcattttactagaggatcatagaagttatagacttaaaacaaacctcgacaattaagacaggataccaagatgcaaatgcctggttggaataaatcaaatgttccatctgcacgttaaacaaaagcaattgttatgcttgtgcacatggcaggccagaagcccagattatcccctttccactaaggtggtcctccagtcaaccaggcatggactgcatggtggctcctttccaggattctacagcctggaataataagttgtgccaagctctctctctgctatatcctgaagttcaataccctgcgggtcagcccccgaggaccatccagcttccatctcccaacactaagttcacttcgtgtctctcatgacagggaggaaacttagcactccttggagacctgaagggatgccgtgagcttaagaattttcaagagcttaccaataagtcagcccttgttcatccccgagcggatgtgtggtggtattgtggtggacctttactggacactctgcctaataattacagtggcacttgtgctttagtccaattggctatccctttcaccctggcatttcatcaaccagagggagggcaggtaatagaagaaggatggatccagtgatcagatggaagaatagccgtgccacaactgctaggagccacagtcatactggctgtgcatgagaccacccaccgaggccaagagtcacttgaaaagttgttaggccggtacttctacatctcccatctgtcagcccttgccaaaacagtggcacagcagtgtgtcacctcccggcagcacaatgctaggcaaggtccaactgtcctgcctggcatacaggcttatagagcagccccctttgaagatctccaagtagacttcactgagatgcccaaatgtggagatctcatccctaggtttggactgcccttacgaattggctcagacaatgggccggcatttgtggctgacttggtacagaagacagcaaaggtgatcaggtgcagatcaaggattagaacatagccccctcgtggccacggtgaaaaggaccccagaccatcatcttgaccactcccacagctgtaaaagtaaaaggaatcccagcctggatccaccacagccgcgtgaaacccgcagcacctgagacctgggaggagagactaagcctggataatccctacaaagtgactctgaacaagatgacaagcgctgctccagtcacacccagaagctgactgatccacgcacggccaaggcatgaggaaacccaccgtgggacttattttccttaaattttggacttgtacagtagggacttcaactgaccttcctcaaactaaggactgttcccagtgtatacatcaggtcactaaggtagggcaaaaagttaaaactgtctttttattctatagttattataaatgtgctggaactctaagaaggacttgtttgtataatgccacccagtacaaggtatgtagcccaggaagtgaccagcctgatgtgtgttataacccatctgagccatttgtgttttgttttttgttttttggtttttgttgttgttgttgttgtttgagacaaagcctcactctcactctgtcgcccaggctggaatgcagtggcgcgatctcggctcactgcaagctccgcctccccagttcacgccattctcctgactcagcctctcgagtagctgggactacaggcacccgccaacacgcctagctaattgtttttgtatttttagtagagacggggtttcaccatgttagccaggatggtttcgatctcctgacttcgtgatccgctgccttggcctcccaaagtgctgggattgcaggcgtgagccactgtgcctggccagtcacagtttttaaaataaaattaaaaagagtcacctggtgaggtctaaaccatactaaaaataatccatttagtacattcccaaagttgcaaaccttgtgggcccacccagagtcccaccaggactggacagcccccactggaatatactggatatgcagatatagagcttacgccaaattacccatccagtgggcaggtagttgttgtgttattggcactattaaaccatccttcttcctactgcccataaaaacaggtgaactcctgggcttccctgtttatgcttcccccaaaaagagaaacatagctataggtaattggaaagatgataaatggccccctaagaaagtcatacaatactatgggcctgctacttaggcataagatggctcgtggggatactggaaccccatttacatgctcaaccaaatcatatggttacaagctgtcttagaaataatcactaataaaactggcaaagtcttgactattctggcccggcaagaaactcagatgagaaatgctatctatcaaaatagtttggctctcgactgcttgctagcagctgagggagaggtctgtgggaaatttaaccttaccaattgctgtctacacatagacgatcaagggtaagcagttgaagacatagttaaagatatgacaaaactggcatatgtgcccgtgcaagtgtggcatggatttaatcctagggccatgtttagaaaatggttcccagcactaggaggatttaaaactcttataatagaaattataatagtaataggaacctgcttactattcccttgtttgctacctgtactccttcaaatgataaaaagcttcatcgctaccttagttcaccaaaatgcttcagcacacgtatactatataaatcactattgatctgtcctacgagaaggcatgggtagtgaggatgaaagtgagaactcccactaatgagtgaagttctcaaaagtgggagaataagggaggagaacacccctcatattgtcttatgcccaatttctgcctccaaagaaagaagtaaaaactaaaagtcagaaatgaaatccgcaggcagatagcccgatgcaagccctgggcctggtagttaaaaatcaacccctgacctaactgcttgtgttatctatagattccagacattgcatggaaaagcattgtgaaaatctctgtcctgttctgttccattctaattactggtgcatgcagcccccagtcacgtaccccgtgctggctcaatcgatcacaaccctctcacatggacccccttagagttgtaagcccttaaatgggacaggaattgctcacttggggagctcagcttttgagatgcaagtctgctgaagctcccagccgaataaagctccttcgttctttaaccctgtgtctaaggaattttgtctgcagcttgtcctgctacatctccagttccatgagatgtgaccttagattatctatttgtgctctctcagactttttgatgtgggcatttaatggtatgaactttcctcttaacactgcttttgctgtactccagaggttttgataggttatgtcactgaggcaggaaaatagggtctggaggtagggaacataaggctgattcacacttcagctatgacaggaaatatcctctccatagggcgtatgccataaatgactttgtaactttacttcatcctctccatttacatagggtgtacccaaagtaaccaatggaatcctctagcgggtatttaaactccccaaaattctgtaacggggcctttgagctcctatgctttggcccactcccacgctgtggagtgtactttcattttttcaataaacctgttcatcccttccctgctttgtttgtgtgttttgtccagttctttgttcaagatgccaagagcctggacactctccactggtgaaatcactattatcattcagttcaaagaatttttaaatttccctcttgatttcattgttgacccagtgatcattcaagagcaggttatttaatttctatgtatttgcctggttttgagggttccttttggagttgatttccagttctaatctactgtggtatgagagagtacttgatacaatttcagttttcttaaatttactgagacttgttttgtggcctatcatatggtctgtcttggagaatgtgccatgtgctgatgaatagaatgtatattctgcagttgttgagtagaatgttctgtaaatatctgttaagtccttttgttgtagaatatagtttaagtccattgattctttgtagactttctgtcttgatgacctgtctagtgctgtcagtggagtattaaagtccgccactattattgtgttgctgcctatctccttaggtcaagtagtaattgttttataaatttgagagctccagtgttaggtgcatctatatttagaattgtgatattttcctgctcgactagtccttttatcattatatgatgtccctctttgtcttttataactgttgttgctttaaagtttattttgtctgatataagaatagctcctcctgctcatttttagtgtccatttgcatggaatatctttttccacccctttaccttaagtttatgtgaatccgtatgtgttaggtgagtctcctgaagacagtagaaacttgattggtgaattcttattcattctgccattccgtatcttttaagtggggcatttaggtcatacacattcaatgttagtgttgagatatgaagagctattctattcataatgctatttttttgcctgaataccttgggttttttttttcattgtgttattattatataggtcccatgagatttatgctttaaggaggttctgttttggtgtatttcatggatttgtttcaagatttagagctccttttagcagttcttgtagtgctggcttggtagtggcgaattctctcagcatttgtttgtctggaaaagaatgtatctttccttcatgtatgaagcttagtttcacaaaattattggctgatacttgttttgtttaaggaggctaaaaataggacctcaatcccttctagcttgtagggtttctgctgttaatctgataagttttcctttatgggttacttgatgcttttgcctcacagctcttaagattctttcctttgtcttgactttagataacctgatgactatgtgcctaggcgatgatctttttgtgatgaatttcccagatgttttttgagcttcttgtatttgaatgtctagatctctagcaaggctggagaagttttcctctattatttcctcaaatatgttttccatacttttagatttatcttcttccttgagaacaccaattattcttaggtttggacatttaacatagtttcaaactccttggaggctttgttcatttttaaaaattcttttttgtctctgatggattgggcagattcaaaagccttgtctttgagctctgaatttctttcttctgcttgttcaattttattgctgagactttccagtgcattttgcatttctctaagtgtgtccttgatttccagaagttgtgattgttttttatttatgctatctatttcactgaagaatgttcctttcatatcctgtatcatgtttttgatttctttaagttggacttcactttactctggtacctctgtagcaggatgatccacagacaaaacctctcagacaccaagttgtagaaggaagggctttattcagctgggatcatcagccagctactgtctcaaaatccgagctccccgagtgcacaatttctgtcccttttaagggctcacaacactaaagatttcacatgaaagggtcgtgattgatttgagcaagcaaggggtacgtgacaggggctgcatgcaccggtagtcagggaggaacagaacagggcagggagtttcacaatgttcttctatacaatgtaaggaatctatgaataacatctgcttctaaatcataagttgatttttaactactgggtttaggccaggtgggcccaggcctggtttcgggcctggcgccaggctgcctgtctttggttttacttccttgttgtttttactgaatatgaaacaatataaaacaatgtgagagggtctttctctcctctcacctccttgattaacttaataatcgaccttctgaattctttttctggcaattcagagatttcatcttgatttggatccattgctgatgtgaaaggaaaataaatcttggggcccctaaatcactaagctaaagagaaaagtcaagctgggaaatgcttggggcaaacctgccttccattctattcaaagtcacccctctgctcactgacatggatgcatatctgattgcttccttcgaagaggctgattagaaactcgtaagaatgcaactgttcctctcacctgtctgtgacctggaagtcccctccccactttgagtcttcctacctttgcttcaagttgtcctgcctttccagactgaaccaatgtacttcttatgtatattgattaatgtctcatgtctccctaaaatgtataaaactaagctgtgccctgaccaccttgggctcatgtcgtcagaacttgctaaggctgtgtcacgggtgcatcgtcaaccttggcaaaataaactttctaaattgagacctatttcagattttctgggttcacactggtaagctggtatgatcttttgggggtgttaaagaaccttgctttgtcatattatcagaattgtttttctgattccttctcatttgggtagactgtcagagggaagatttgggattcaagggctgctgttcaaattcttttgtcccaccgggtgctcccttgatgtggtgttctcccccttcccctaggaatggggcttcctgagagctgaactgtagtgtctgtttttgctcttctgagtctagccaccctgtggaactactgggctctgggctggtactaggagtgtctgcaaagagtcctgtgatgtgatctatcttgaggtcttagagccatggctaccagcacctgctctggtggaggtagcgggagagtgaagtggactctgtgaggatccttggttgtgtttttgtttggtgcaccggttttgtgttggttggcctccagtcgggaggtggcacttgcaagatcacattggctgtggttttataggaaggatgcaaacctggttaagtattctggtttctcaggcggtgggcagggccatagagatcccaagagattataacttttgtcttcagctagcagggcaggtagagaaagaccaccaggtgggagcagggataggtgtgtctgagctcagcctctcatttggcggggcttgctgtggctcctgtgtcagggggtgtggttcccagtccaatggagttatattcccaaggggattatggctgcctcttctgagtcaccaaggaagtggggaaagttggcagtctaaggcctcaccttgctcccatgcagcccgcagtgctaaaggccagcgtcactcccactgtgcccccacaacagtaccacgtctatttccaggcagccagtgacctgggctgagaacttgctccagaccacgagccttcctgttgagaaaccaagcagactcacagttttttggcatctcagggagcctggattggtgatccagttccttcaaaggctctgtagattctcttggctttcctggtatgttcttgtggtagttcttggagcaaaagtctccacatgctattctatccatccgagtgggagctgcatgctagtcctgcctcctatctgccatctttccccacatgagatatattttgatatactttcacattcaaggtatttgtctttggatctaaaatgagtcttttatagatagtatatagctggataatactttttaaaaaatacattcttctaatctctgctttttaactggagaatataatccattttcttttaaagaaattactggtaaagaagggcttgtttctgccattttgctacttgttttttatgtcgtatctttttttgttccttaattcctttactactgccttcttttgtgtttagttgattttcttgtagtgtgccattttgattccctcctcatttttttttctggatatcttaaagatactttcttaatggttaccctaagaattacaactaacattctaaattcataataatctagtttgaattgatacctgcttagcttcaatagcatacagaaactctgtgcctgtacagctgtcttctcctcctttatgttattgtcacaaattacatctttagaaattgtgttcctgttaacatagattaataatttttcttgtatttatttgtcttttaaatcatataggaaaaagaagtgatttatataccaaacatacaataatactagatttttatatttatctgtgtagttatctttaccagagatcttatcttttttctttatatggcatcaatttattgttactatcctttcattttaactgaaagaactttccttagtatttcttatagggaaggtctgctggtgatgagcttcctcaacctttgttatctgaaaatgtcttaatttctatttcattttgaagaatcattgtgccatatatagaattattggttgacagacttgtttttcttttatcactttaaatatatcaattcactgccctctggtctttgtggtttctgatgagaaatcatctgtaagtcttccttaggatcccttgcatgtgactattcaggtctctcttgctgctttcaagactctctctttgtcttttgacaatttgattataatgtatattggtgtgaatgtctttgagtttctcctacttgaggtttgtttagcttcttggatgtgtagattgatgtctttcagcaaatttgggaactgtttggccattatttcttcaaatattcattttatacctttctctcctctccttctggtactctcataatgcatatgttgttatgcttgatgttgtatcgcaggtcttttaggctctgcttatttttcttcacccatttttctctctgctcctccaattgggtaatctcaattgacctatcttcaaattcactgattctttgtactgcctgctcaaatatgctgttgaacccacctagtaaacattttcatttcagttataatttttaactctaaatttctacttagttcctttttataatttttctttctttattgatatcctttatttattgagacatcttttggttttatttgtttctttgttcatagtttcctttaactctttgaacatacttaagacaagtgttttaaactctttgtctaggaagctcaatgtctgagctacctcaaggatagtttttgttaattaattaatgttctctgtaaatgggcgatattttcctgttttttgcatgccttataaatttttggttaaaaactggacattttgaatattctaatgtggtaactctggaaatcagattctcctcaccctccccagagtttgctgctattgtttgttatatgctgccatcgtctttttcttttgtgactttttcaaactgtttttggcaaagactgtattctttgttgtatatggtcactgaattctacatctgttagctcagtggtcagccagtgtcttgaaagagattttcttaaatgctaaaatgtagcacctctttcttcataaaatactccatagttgttttaagtttttttcttaattggatccagggttctaaaaaagtttgattctgttagtttttgccaactctatggttgcttcagtagagaaacaaattcttggcactctctatttcatcattctcagtgatgttacttggttgattttttttaagcaaattacttgattggactcaaactataagtttggtgttgcttgcagtcagttgtaaccaaaatatcaattaagttttttttgtttttgtttttttgtttttgttttttttgagatggagtcttgctccgtcacccaggctggagtgcagtggcgtgacctcggctcactgcaagctctgcctcccgggttcacgccattctcctgcctcagcctcccgaatagctgggaccacaggcacccaccaccgcacccggctaatttttttggtatttttagtagagacggggtttcaccatgttagccaggatggtcttggtctcctgacctcatgatccacccacctcagcctcaagttttttaagacttagctacatgctgctttgagttttccccagacacttgtggttcagggtcatcccaggaatgtaggaagagtttatagatagaactcaatcttctctctggttctttcctttctggatgccctctggtctctgtgatttctaatgagaaatcagttgtaagtcttccttaggatcccctgcatgtgactattcaggtctctcttgctgctttcaagattctgtctttgtcttttgacaatttgattataatgtatcttggtctaccctgacttccctaccccatcctactcctgacttttcagacatgatggttgttctcgtctgtcttctggttcttctggcttgagggatgcagattttctattaaagtgttagtcattgtgcttggcattataactgtagcctgtaaaatcaggaaaatcatcctgcgcttatcctttctttcaagtttttgacatctctttaggctttgtctgctttttgttgctctccagaatcttcaagtagttaaaaaaaaaaatccccccagagttaataattgttatctgtggggaagggtggagaggagaggaagtctgttaggagctctctctaccatacctatagcagaattgattagaacaggtttgaaatccagttctggtgcctacttgtttatatggccaaccacaattagtgctttcctaagagaacaggaattttttaaaattttaatcattttcaagtgtacaatatagtgacattaagtacattcacattgttgtataatcattaccactatccatctccagaacttttacattttcccaaactgaaactctgtacctattaaataacttttattttacttaagagaagaaaaaagaactgaggtgaaactgaagaaaccaatgaacttcaaataaatgtatcttcagctcaagagatgttatctcattaaagaagcataagattaagaaattaaaagaattatgaaaaacgctgaggttggagtcattattttttaatttctcatttcaattttagaagaaacagtcatgcatgtataatgtgtctgtcagtgatggaccacatatacaatgatgatcccataagagtataatggaactgaaaaagaaatttttttggagacagggtctcactatgttgctcagactagagtgcggtggagagatcacagctcactacagcttcaacctcccaggctcaagcaatccccccacctcacactcccaagtagctaggaccacaggcacatgccaccatacctggctgatttttaaaaattttgtagagactgcatgtcactatgttgttcaagctggcttcaagcgatcattctgcctcagcctccaaaaatgctgggattacaggcataaactactgcacccagcctgtaaaattcttattacctaatcccagcactttgggaggctgaggcaggtggatcacctgaggtcaggagttcaagaccagcctgggcaacatggtgaaaacccatctctactaaaaatacaaaaattagctgggtgtggtggcaagtgcctataatcccagctactcgagaggatgaggcaggagaatcacttgagcccaggaggcggaggttgcagtgagccgggattgtgacattgcactccagcctgggcgacagagcaagactccatttcaaaaaaaaaaaaaaaaaaaaaaaattcttattacctagtgacatcatagccctcatggtgcaacgcattactcatgtgtttgtggtgacgctggtataaacaaagctactgtgctgccagtcatatgagtatagcacatacaattatctatattatacaatacttgataataataaagggctatgttactggtttatatatttactatcctatgctttttatcattattttacaatgtacttctacttataaaagaaagttaactataaaacagtctcaggcaggtcctttgggaggtattccagaagaaggacagctcaatgcatgttattgccccctgaagatcttccagtgggacaagatgtggaggtggaaaacagtgatattgatgatcctgatcccacataggcccaggctaatgtgtgtgtttctgtcttagtttcttttttttttttctgtcttagtttcgagcaaaaaaatttaaaggtaaaatatatatatatgtatatatatttcttgagacagagtccactttgtcgcccaggctggagtgcagtggtgcgatctcacctcactgcaagctctgcctcccggggacacgtcattctcctgcctcagcctcctgagtagctgggactacaggtgcccgcaaccacgcctggctaattttttgttttagtagagacgaggtttcactgtgttagctgggatggtcttgatctcctgacctcatgatccgcccacctcggcctcccaaagtgctgggattacaggcatgaaccaccgcacccagccagtaaaaaaatattttttaatagaaaaaaattatacaacaaggatataaggatatttttgtacatctgtacagtatgtttatgttttaagccaagtgttattatgaaagagtcaaaaagcttttaaacatgtaaaagtttataaagttaaaaagttatagtaagctaaggttaatttattattgaaaaggaaaatatttttaacaaatttaatgtagcctaagtatatagtatttttaaagtctacagtagtgtactgtaatgtcctagaccttcacattcactcaccacttactcactgactcacccagagcaacttccagtatggcaagctccattcatggtaagtggcctatgcagatgtagctttttcatcttttatatcatatttttactgtaccttttttgtttagatacatttagacagacgaatagttaccattgtgttataattgcctacagtattcaatatagtaacatgctgtacaggtttgtagcctggaagcaacaggctatgccgtagagcctagctgtgtagtaggctatgccatccaggtttgtgtaagcacattatgacattgcctaatgatgttgcctaatgcatgtctcagaaaatatctctgactttaagtgatgcatgactctgttgacttggtacacttattctcactttccgttgatcctcagaaatgttagttatatcattaattttatttggtcaaggtttaaaacattgatttctactgtgtagttataattcccaaagttctttagtcttagttctacatttaaacagattttgtagtgctcataatcattcatttgtcactgcttctctattccataatgctttattttgacttaaccattggttttctgaatttcttttatgtagcaggttttttaatgaaaagctcatgggtgctgtactttctgagttcctgagaatatttgcctgttgcctttgggcttgaatgacttcagagacattgttccacaatgttgtgacattgaataatgctaaggagaagacttttccttcttaagtgcttgaaatattttatctttatccttgaagtttgataacttaatcatggtatgtgtaggtattgatcttcctgcaccaattattcttgaaataagaataggttacctagagtgctgcagaattagttctttatttcatggaactttcctgctgtttatctttgaatatgctttccattgcattcactgggatttctacttcaaggacaccaaataatcttctggtaaacaattttcttttatactttttatcttccctccatttaggtattgggaagagggagagcctctctcttttttgtaacctggaagtcatcagtaaattaatccaagaaacatctctattaaatgagtacatttgtaaaaccaatcaaccaacatccactgatgacctgctattcaccatacaattcattcagtcacaagatttagcccctgttctgtgccagactctgtgctgagtcccagggactgagatgacttacacctggtttattaggctgttcttgcattgctataaagaaatatgtgagactgggtaatttgtaagagaagaggtttaattggcttagggttctgcagtctgtacaggaagcatggcactggcagctgcttctggggaggccttaggaagcttacaatcatagtggaaggtgaagagggagcaggcattgcacatggcaggagcaggagcaagggaggtaggaggtgccacacacttttaaacaaccagatgtcatgagaactcatttactatggtaaggacagcaccaccataagggatccacccccatgacccaaacaccaccccccttgactccccacctccaatattggggattacatttcaacatgagatttggacagggagaaatatccaaaccatttcacctggtctccacctccagccttgcggggtaatgaggacacaggtataatcagaaggtgaagcagaattgagatgagcaagaggcccaagagcaaagtaggggccatactcaaataaggcagttgatacagatctgaagcatcagatctgtaggggaaacacaagaccatctgtgggaaagaaaatgaggagtcagtacttcagaatactggaatcatgttgggagtacaagatgggttgggacgaaggcctcaggatggtggtggtgaatgaggtgatggtgctggctgtgtggccatggggcagagaagccactttacaggtacttagactaaattgtaggtctgagtctcctgagcccttcccttgtcctccctccacatcgctcttgggtgcatttcttcctcctgagcttttctccatcagctgcttttcctagcagccttgtcctcgcagctggttctgattttgtccccaggtccaccagtctaggcagccttggaggcacctttcttagactttcctgtgggagaaagtctatggtgcttgtgggtgggagaaggaaacaaacaaaataatttttctttgcaccccaccttctaaagatgatgtcagaaggaaagtcctgagtaaagaagaggctggagtctgggagaaaaaggacaaaagcattaaggaatcttgaaatcacactgacttttcaagctgtgctctatagctattctggtccctgtgatcctttcctgggtaggactcaccctgacctatcctttctccagggacaaagcagctgggctgttgggaagatacaataattgattggctctgctgtgtattagtcaaaacatttttggttgcacagggtagaagttcagctcaaactagctgtactagtctggcaaatagcagaaaacaactctggctggtttaatcaacagataattttaccaaaggatattaggtatctcacaaaatctctatagggccagagatctgggtcatatgtctgagctctacttgcaagggagactggaaagcaagtaaaggctttttcttcttcagtgggaggagaaggtgggaaactcttcaaacataggaagcttctgggcagccaagataatgacaatgtccaacacaccagcttgagtaaacacaaaattcatttgttcacttaactgggatgtccatggggatagtttggcttctaatgtggctgacccaagatatcaactgatcattctgttcttgctccatctctcaaagatattttccccatattggtttcattctcagataagtcctttccagagtcacattataactttcatgggcccttggtacttttgctttttgggttcctccctccatacaacaatattaaaaattatatttttataattgcatgggtataaagttgaatacaatccaggctagactgtattccttttcttctgattttaaaagagttaaaacattttcatgggctcctgaaagtatagtgggccctaggcactttcctactgttcctaatgaataactcagtcctggctctttttcctgaatggaggagttggccagtagcaaatcctgactcacagagcttactccatccttgcagctcctgatcccaagtgatgaaagtgcacaatactctctctcgcattgtatgtagtattggctcatttgtagaagaattgttgtgttcaggacatggggattttctagttagaccgggtcatgtgcccatccttgaggtggagagtgtggtgctgtgtggtcaccagccccactagaatcgcacggagttgggggagttgcagttcctaaaaacaagagctactgggcacacaggaaagtaataggtatccactccagcaccacagtgaagatgttgcaggtggagaagaggttcacatcataaatgatctggccttaccaggaagtgactgaaccatttggcagctttgaccttcatgtaagtttgcccctgagtatcatcttgggaggtgccaagcacttcctggcaggtgggctggaaagtttatttatttgttcaggtaccatcagtgaataggtataaaatcatagagccaaagttcccagattgttagactcttagacttaaaattttaagaatttggaatcattgaaacttagattctaaagattttagcacattagtctccaaaaatctaaaatatctaaaatcatggaattttagatttttacattcttccccttagaatctttgtgaactcaaatttacaagaaaaaaacaaacaaccccatcaacaagtgggcgaaggacatgaacagacacttctcaaaagaagacatttatgcagccaaaaaacacatgaaaaaatgctcaccatcactggctatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccatcgtggaagacagcgtggcgattcctcagggatctagaactagaaatagcctttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcataggtgggaactgaacaatgagaacacatggacacaggaaggggaacatcacatgtggggacagttgtggggtggggggaggggggagtgatagctttaggagatatacctaatgctaaatgacgagttaatgggtgcagcacaccagcatggcacatgtatacatatgtaactaacctgcacattgtgcacatgtaccctaaaacttaaagtataataataataaaataaaaaataaaaaataaaaaaagaatctttgtttctaaattttaaaactttacaatctcaaaccatagacctcaaatctgagaactttagaatcttatactctaagaatggtttcaacatgatagaatattaggatatttgagggaaaatcttgaatctcagaatcttgccttgggagtcatgagtcttccaaatcagagaagcttgggctcagacccctggtctcctgaccctaggatctctgagctgtcagggacttaaagtcaggaaagaaccatatttggcaactcagacctttataaagaggcactggggtggatggtgaatttagagtcccaggggtcagtttctgttctgactgccccatcttgaacctgacctgatccttgcccaggtacctcccagtctccttcagagcctagaacccgaatcttccacacccccaacccatgccaccccaacccatgccaccccatcttcttggggctgtttcttttcttcttgtgcctagggtgcccaagccttccctggtaaccactcacatgaataggatcccaaactgggcagatgagcccattggagagggcaataggttccttccccagaccttttcctagggctctctgagccttctggaggctaggactccttctctgaatattatgtctctggaacctagaggagtcatccagtaagatacagatatgccagtggaatctcacaaggctcttacaaggtgccatagagcaactgttggctttgtctaggttctgatattcagtagcaccctaatgtttccttcatactactcgggtctgatagccacctctccatgaggagccttaattaagcagctgagggacaggaaaatttcctgaaactagagattattcaagacaatctactgagaataaaaggtaacacaaaataatatttactccttgatgtggtttggatctgtgtccctgcccaaatctcgtgtcaaattataatccccaatgttgaacgtggggcttggtgggaggtgatcggatcatggtggtggatttctcaggaatggttgagcaccatccccttggtgctgttctcatcacagttggtgagttcctgtgagatctggttgtttaaaagtgtgtggcacctcctgccttgctctctctcttgctcctgctctggccatgtaaagtgcctgctccctcttggccttctgcagtgattgtaattttcctgcagcctcccgagaagccaagcagatgccagcatcatgcttcctatgcagcctgtagaaccatgagacaaaccccttttctttataaagtacccaacctcaagtatttctttatagcattacgagaatggacttaatacactcctgaagtttttttctggtggtcattaatttgttttaagcagaagtcttcataattatatctatgcatttatatataatatatatttatattctgtgtatcagaaggttttgagatagctttagaaactatagacaaagtttttaaaaaaggaaaaaacataacaaaaaataagttagcaggagagagaataacaattgatatttttaggcacttgaataagagaggtgcaaaagatgaggaagcggctgagttcctgtcagctaaggcaaaaaagaatctggctgggtacaaagcatttcattacccagcaaaaaaaggaaaatagtttgcttttatgtaaaacatttttcttccactatctttaaggagaaagttattgggcaaaactgagtaatattatggggatgacattaaattaatcaattctgcacaataatattaaaagctaatgcttactgagtgcttactatgtgctttcttgtgttagaaatgcaaatccagctgagtgcagtggctcacgcctgtaatcccagcattttgggaggccaaggtggatggatcacctgaggtcaggagttcgagaccagcctagccaaatggtgaaaccctgtctctactaaaaatacaaaaattattcaggtgtagtggcgtgtgcctgtaatcccagctacttgggaggctgaggcaggagaatcgcttgaacccaggaggcggaggttgcagtgagccgagatcgcaccactgcactccagcctgggtgacacagcaagactctgtctcaaaaaaaaaaaaaaaaaaagaaatgcaaatccttcagcatcacccaagatctatgtgattaaaaaaatcaggttacagcccaggcacctgtgttttcatgagctgtcactatgatttctatgcacactaaagtttgagaacccctggtgtagaggatcaggcactgagagaaggggcaccctggaattctgtgtcgccatgaatcaccctccagatcctcaagcctcttgaggagaatggacctttgactttgtttttactcattcttcttataaggctaaggggaggggcacttaatgagcaaagacagcttaatggaaatgaaatggacctcagccaggaaaccggggccatagctccagtttttctttaatttctctgatcctctctgtctggacgtgagtctatccatccatgcaatgtaggagctgatgaaatgattgttcagagagagggagggaactaattgtgagtgacaccatgggccaagggctgaactaattaagccactctgtgtcccaggccctctgagaggtgctgtggatacagagatgaaaaagaggcccagtttccatcctcacatggcttcattcttctcataaaaaacacatacaagtaacaacaaggtaattataattcagtgtgataagggcagttgttggtaaccaacatactagctagaaactggttttctttctctagcataacaattagaaaaaagtttaaattttttcacaatagtaacataaataataaagtttatcctaccaaaaatgactaccaagtttgttgaaaaaaattaaaaactaaaagaagattcaaataaatggggagctatatccccatttatagtgggaggggtagcataatgcaaccccctgaaaattattgctgaatttttgagagagcttgcaaacttactgcaaaatttatttatttatttagagacagagttttgctcttgtcacccaggctggagggcaatggcatgatcttggctcattgcaaactctgcctcctgggttcaagcaattctcctgcttcagcctcccaagcagatgggattacaggcacccgccaccacacctagctaatttttgtatttttagtagagacagggtttcaccatgttggccaggctagtctcaaactcctgacctcaggtgatccatctgccttggcctcccaaagtgctgggattacaggcatgagccactgcacctggcccaaaatttaaatgaaagaataaagacaaacaaatagctaagtcaattttaaaaaacatgaaggggcttccattatcagctaggataaaagctaggataaaagacatacttcaaagctataataataaaatagtattgttctggcataacaatagacaaaataataatggaatataatagatagctcagaggtagatgaggtgtgtaggaatttgatattgataaagatggtactacaaaacaatgaggaaggacagattttttttaaaagatagatttaagaaaaaaatggcttctgatatgaagaaaaagaaagaggaatttcttccttataccctaaacagagaggaactccacatgattttaagatataagtttgaaaaataaaactaggaagctaatgaaaaaactgctgggaaatacctttatgatataaaaagaagaaaagactaaaactccacaggccataaggtttaaatgtgatggatttgactacatcaaattagatatttctgctcaatggagaatagattataaactgggaaaacatatttgcaagttaaagttgacacggcatgaacatgtggaagtcctgcaaagcaatacaataagatagaagatccaaagaaatgagcaaaatttctcaataagatttgcaaagggggcatgctaagtgctaacaagtatttaaagagtgtttctatttattagtaatcagaaaggtgcatattaggcagaacgaagtagctctttagcctgataagaatggcaaaaattagaaagctggataatagcaagtcttgatgaagatgtggaaagatgggaactgtttagtccattattgctgggagtgtaaatggcacagccattctaggaaacaatctcaaagtacagtcaactgtcattatttacagtagttatgttttataaagttgccgcaaacactgaattagtgaatactgaatcatttctctaggggaaatacaggattaggtttctgcaagcctctggttacaacatttttatcaatcaaacaatgcataacctggttttacatatgcttctatttaaatacattgtatttaacatgtattattgatttgttgacattgaagtcatggccaacagcactagaactcatgcctgaacacagcttatctaacacatattttttttccacaagccttcttgcagtagaaacactagacagcacttcagcaccatgcttggaaatattttaaacagtgaaatcaccaacaaaaagagcataaaaatgtgaaaaacatggctctaaatagcccgccaaaagggcacttatttacagagctgaaccacaaaggcagaacgtcatcttgttcgatctcagctaggaacgtgctcatagggtgactcagatttttggccactgtgtgcatgttcgagaacgaccctgcaagttctgtgagtgctggggttagcaagcaggcaaatttgcaatcttcaaacgatggggatggactgtatttagctaaaggttatgcataccctatgactaatgtatttcactccttgatatatatttcaggaaaatcctccatgggtctgtaaagggatataacacaaggacattcatgaagacataaaggtagcaaagagttagaggcaatttaggtgccctccactaggagaaaagtaaaaagtgatccaatcatactatggaatattatgtatcagttgaaaccaatgaaactagatgtataaataacaacataaatatatctttaaaaagtagaatgagtaaaaaacgtaagaaatacattgagccatgaaacaatgcttttattgtaaattaaaattacacatacatacacaaagcagcactatgccttgtgcttatgtgagaaagagattgaaggggaaaataagtaaaacaagcaaggggcctgcagaaactaatgagtataccatgctctgagctcttttctgctaaggtccaaaaaaaaaaaaaaaaagtgccataatggtggaattataaagtgctacagggcaccagcagggtgtggtggctcacacctgcaatcctatcactttgcagggctgaggtgggaggattgcttgaggccaggagctggagaccagcctgggcaacatagcgagactctctctctcgctcatagggtgactgggatttttggccactctgtgcatatatatatgtatgtattcatacacacacacacacacacacacacacacacacacacacacacaccctaaagaatgacatctacctcacatttcagaattaggagccagggaggcttctaattctctaatttcctggataattccctggaggagcctgagtaaaatgtaagcaagtgagatggacaaggaggaaaagtgcttcaggaagagagaagagtttgctagagtttgaagagagaatgagaacttgatgtgtttgagaaactgaaaagaaattcagaattgccatgcaagagacaatggtgagacttgaggccaaacagatcgttcagggctggatcagagagagtctttaagtcgcatggatagtggtaatgtgaccagatctgtgtgtcagaaaacctgctctggccactttctgtatgggaacacgggcacacaagcagagagatccgtgaagagaatgctgtgctcatccagaagagatcagatggtgacacctgcacccgggtcaaggttgtggggatggagaggagccaaggtgtctagggacaccttcacaaccagcaactcaggttcacaggggtgaaaagactccaccaagtgtatagggcttcaaattccctccctctcacccttctttttaagacaaactgctccactgattctttttgtaggttatttatttattttaatcaataaacaaaaactgtatatattggctgggcgtggtggttcatgcctggaatcctagtgctttggggggctgaggcgggcagatcacttgagcccaggagttagagaccagcctgggcaacatggcaaaaccccatctgtttttattaacaaaaataaaatatgaaaaatattttaaaactctgtatatttatggtgtacaacatgatgtcttgaaatatcaacacgttgcagaatggctaaatcaaactaattaacatgtatatgactttaaatacttatctttttgtagtgagaacacaaaatctattctttttcaattttcaagtatataatacattgttattaattatagtcatcatgttgtacaatagatctcttgaacttattcctcctgcttagctgaaattttgtactctttgattgatatcttcccaatccacccaccctctctccctgagctgcttccactgattaggtgcccctgttaaatcatatgattgaactcatacactgccctctggccacagctaatttggtccagagctggcatctgacaaaaagcagccaactcccaggctatccgtgacctgtgatctatggcctggcttgaaactatttaactttaaaaaattgtggtaaatatacataacacaatacttaccatgtaaccattcttaagtgtagagtttgatggcattaagtacatttacaatactgtccaaccatcactactaaccatttccagaaccttgtaatcatcccaaacagaaactctgtatttataaaacaataacttcccattctcctctcccctcagctcctagtaaccattgctctactgtctgtccctgtgaatttgactattctaagcacctcatgtaagtggaataatataataattacccttttgtgtctggcttatttcttttagcataatgtctttaaggttcatccatgttggagcatgtatcagaatttcattccttttcaaggctgaataatattccatttaatgtatataccacattttgtttttccattcatctgtcattggacattcaggttgtttctacctcttgattattgtgaataatgctgctgtgaacataaggataaaaatatctcttcaggactctgctttcaattcttttggatatataaccagaagtggaattaatgggtcatgtggtatttatatgtttaatttcttgaggaactgccatattgttttccatagcagctgcaccatttacattcctactaataatgcacaagggttccaatttctccacatccttatcaacacatcattttctggtttgcttattttattaataataattttattattaaatattttattatcattataaatttttattagctataatataatattaatattatataatataccatataataatatatgctaatataataaagttatcatataatttatcaatataatataataattaattattgattattttaataataattattaatttattatcagataagtgattggcaaatactttcccccattctgtgggttgtcttttcactctcttgatagtgtcctttgatgtacaaaagttgaagcaattttttcttagttgggaaatactgagagactaccaattagcaggtatagctacaagtgaaaaacattgttgttgctatgatttcatgtctactcatgacaaatgtttaggagaaaccacaggaaaatattgagtgagggtagaactagcctgagattccatatccctaccattcacttaacatgtgtttcattctttgttcatctagaaggggagctaaagatgaaaagatgtcatgatctggggacacagcaaaccaaagccctgacctgaaactgaaatcgataccagaagggaagttctgaacagataaaccccaaacagaactttggtagtaacacaggagtactctgggaattgtttattgggtggtagtggagtcgacagtaaaaaaaaatttcccctctacgcccttaggttaattctgatagtgcatgcaactcaggggcaaggcgacttattaggctatctcctttagactttgaggatgtgttcccactgacatttagacataagtttcaaggaatgagaaataaatgtcttgcagaattagtaatgtttagataaaagtacataaatcccaatcccagctgcccagggtcagtaaacaaggaaactcagagccttcatatcaccctgttttgggaagccatttctgaccatagcaggatctctgagatcactgaaagctgagttcaggaacaaatcatatcctttgttgaattgcacccattgagttcccatttacattgggtcttatgcaatgggaaaatggttaacagtattgccttgattgacaaaaactgggactcttatctgtaaagagccaaagatgaggatatttttttcacctgggttcccccttaacacttttcactgttttacatgtccctcagtggacaaacctgacaggtcttcaagaggaaatttgccataggagaagggaaaaaggagcctgggcttgccacttggggcagaaagaggaatatctaggaccatattttgagaaagggtggtggccccaggaacagcatacttctgataaggagaaacttctccactcagccacccagtgtctctacttagccaccatggggaaactatggtgtgctgataattaaaataactaatgttttttacccaaacaggtgtgctaagggacactgcttgcctgagcataagctgggtgaggggcatgctctgcttctagggcatcatgcgggtctagatagcagaggcaaatttcctgtgtgtctggcattgaaaatcagtggtggcagtgaattttcaagcaacaaggattgagatgggagcagtttcagagtttttccattgaggaatatttctatctaagttgctatttcaacaaaaagggcaagaataattcatatctaatagctggcaatgcaagggattttcagaaacattgaaagaaaagatccaagggaaaagacagagtttcttcctaatcaaatacttggaaactgcaagaatcaaaactgtttgaattaatggtaatgtgacctcaattatattcacagtcttgtgaaatttggggttcacaccttaaaattgaatttaaaaatcctactcttttttctatgaattaagaaaaaaattatcattttattataatggaggactacctaggacaatattttgagaatgagtgttctaactactgggctttctaaattttccacttttccctctatgttattgatgtttatgagagaagatgaagttatttctttgaatcagggtttcctagcattctttggctcctggggacatgcaatcttggtgatggctgctttgacatccttgttcctcagtttgtagatgacagggttgagaacaggtgtgagaatggcatataccacattgcccatgacgtggaagtctaggggcaggtcagccctgtaggccacataggctatggcaatggatgaatagtaggtgcccaccaccaggaggtgggagctgcaggtggagaaggctttggagcgtccttcttggcagttgatgcaaagcactgaggtcaagatgtgggcataggagagaagcaccagcagaagggggaggaaggacaccaccatggcgatgcagaagcccatgaaggtctgggggtggtgtcagagcaggaggcctggaccacagccaggtggtcacagaagcagtggtagatgtggacaatgatgtcaaatgccatctgggaggtctgtaccactgctggaatgggcaggaggagggcagtgagccaggcactggttgtcaagacagtgttggtctgaggggtcatgaggacagggtagtgcagtgggcggcagatagccacatagcggtcataggccatgaccaccaggatgaaggcttctgagcaggagaagctgtggaacaggtacatctgcaggaagcaggcagggaagctgaggaagctgtccccaaacaagaacagggacagcatcttggggacagtggttgtggtaacaagaatgtccaaggtggagaggtttatcaggaagaagtacatgggcttgtggaggctgggcttggccaccacagccaccaggataaaggtattacccatcaggatgagcacgtagaggaggagaaagacaaagaaaataggaaggaaaagggattttggcagagaggggatgcccataaggtagaaggtggttgaggagtcccctgatccattacaggtgattgtttccatagtgggttaaagctggaggctccgaagttgagtactgggaacacctgggaaccaggcccatctggaagccaaaacaaccagagattctgtaaggagaattacttaatgatcactgtataataaatagataatgggctctatcttatctaaaaattcttcatcctatcccagaattctctctttcctttttaaatcaagtatggaaaaagtacctacaatatataaatcgtgttatttgctggatatatagtagacaagttggtggggctgaagaaagacattaagcaatgaatcacataattatttaattgcaattgtgttaagtgctttggaagaacttctagtccacttttccatgttccatatgattattttggggatatcagatctcttaaaccagaacaccgagttcctttttctgttggcatttgctttaagttttttaaaaatggcatctttgttaccacattgaatagggagggctgatttctcccaggttcactgcaacatgctgtctttccatcataattattaactagggaatggctcctttctgtcttgtttgcttggtgcagtggttctgctatttccatctaagctgagttctctgtatcctgtctctgactatggggctctttgttatgttatagggaagggagtgacactgaaatgctcttgaaaggacgagtcattcctgaccgggttcctgataatggcttcttccacagctgggcaacaacagagaatccaagacagtctctgtaactcctttgagcttccctccctgctggctgctgcagctcagctgtgctcctgtttgaccactgcattcccactacccagtaggcttctctgcttctttgctagtcagaaagtgtcatggtaacctgggaaaacttgggaggcatgattgatagaaaagaactaactggagatctgttcgtagtagctgctccgagtcaaaagaacccctttcagaaccaggaatgagtgcttcaacccacagacgcagggattttgagctgaaggaaagtactgattcaccctctactttaggcttgtctcttgcgctaaaggacccccggcacaggtctttgttgacatttgtatcactgcctcgttaatcccaatgattccaggagcagtttccactaatttttcccgagtcacttctaatttcccattcttctaacgaaacatctctcatggataaaaccactaatgtgaaaaatggaaaagatgtttattttcaagtccaactaatttaccccccatagtccagagaccgatcacggaaagaccaggggctttcccgggtgccacggccagctggctgcggagccagaaacactgtgccaggacagggttctttcttttatacgtgtttcctaaagaatacagaagtccaagtttccaagagaaaataatttaagacaaagctttctatttcccttttttgttttctagttgctaacatcaaacaaaactaaatttcaaattttcctctaggtttctacatggtaggtactaaatcactgtctagcaatgcaaatgcttctttaaaataatgtcgcaagacctggcaagagtgaacttgctttgtcccaagttgagaaggttatccctcagttaaccagaaccccatcccaacagattcagtagctaggttttcctcatacccaaagggggcaaactgcacttccctggacattgctgcactcagagagtgagtcatgggctgactgtccccatgttagacagagttgggggtctgagggacagaaactcagaaggtcaaagccagaggggcccttggaggccatccagtccagctgcccctcttcctctctcctctatccactgctttgcagaaggagacatggatgctgagaccccctggtggagagacagcctgaggcttttcacagccaggtggtgccggactacccaacaggcagaccaggcttgggtcaccagcaaagcagaggcaccaaaactacttcctgagagaatttaatatgtattatttcaaagcaccattcaactagcccatcataggaaatatcagaatttggctggactttctgtacaatttagagttattttattttgaattacatgctatctctaagtaatgcagccctgtgcttagggctaaaaggacactgtttcccagggcacagaacttgcccagcagatctttccagttaggtttgtctatgagccagttacagtgctggttggggaaagagaaggacagaaaaactgatcatccaaatgtcatcctgcactttctgtacatcatctctccccatcagacagctctgccaggaagtgcttatgccccttccactaatgaagaaactgagggtcagagaaggccaggccctccttcagggtcacagctggtgaggtgtgagagcagaggctgctcctggagcctggcaacccacagtcctgcctcctgggccagctctgacactctcttgctgtgactatgggtctttgctcatccgtacagtgaagggtttgaggaaatcatctctgagaggtttccaaatcaatgagctattttctgagtgtccctctgcattttgcagagtgggggttcagatacagatgtcacatgacccacacctctaagggtgagggctctcgcactgagggagcactgcagcagagccaggttcttgaccttcattatgtcatgtgcaccttagcggttacgtgtgcagactcgggagtcaacccttgctcctaactccaactgtgtgacattgagcaagtcactttcccctctctgagccttttggccctgatctgtgacctcatgggattttctttaggtagagaacacttaggtatgcttacaaagagcccggaacatggaagagcgcaaaggttgctaatgtttccattggttcctgctgtcatcagccttttctccctgtgggaaggccttggccaagaagatttgaatctcatttgtgagtgcatccattgcccaggcctgccaggatatctggccaaaggcctcacagtccacacatgcacctggatcccgggcaccttccaacctggatcctgggtgcctgctctgtgcataccaaatgtgtcttcctgacctctggcccaggtttgtagtccctggacaccctggccctgtcttcccatcccagatttctctgcctatctctgggcactccgtctccagcaatgttcacctgttgagcctgatccacactggtgtctcctgtgttcctccatgtgaggccttggaggaggtggcaggctggggctgagccatggcccattaaagcctcaggcccctcttttctggcaggcctcctggggtactttctctcaatggtgcttccatggggtgccacacttaccaaccctcagggatcaactctctggcatctccttcagcttgtatgtgatagaagtggtatttgtctctaggctttgcaaataataacaagatcattactaacagccctcaagggtccaaaactttacacgaatggtgtagcctttatcctcattatcctctctggtcctcacaacagcagagaagacaggaattaacaatagggtatacaggaagtccaagagaaagaaaatgaggtctaggatgtgaaacagcttgtccatattaacactggtggctagaggaagaactagaatttagacctagggctttattccctgcctagtgccttgacagcttcaacagaagtatataatgatcaagaagatggggcctggagctattacatattaaagatcctcctttattggtttgctgggtttccacttacttttctaattgtacacagaagtactaatatgcacttcagagaagtgctttattccagaaatacctcctcttcctcccattatgtagtcacaaccctcctttctctttctaatcagatgtattcattgtacccttctttgccagttaattcagtggcatggggagccccaaaagttcaggtggcaatctccgcttccagttcaatgaaatgattatttcactcctggtagacttattccatgcttaggaactaaaatgcataaactggcagaatccaaagttagggaggaggaagcatgtactttgattctccttttttcccccccccaattccctttcaggttctatgtattttagaactgggttcttaggggtaataagaggaagcactcccacctcctaccttggttctcagacctgtgtattctggctagacaggaaactgctctatatattggatactggttacaagtatgtatttcagcttataagacagcacccaagccctttgagatattatcacccagccaacacccaaaactaagtctcaataagttattcctctagtctagcaggccacctgcttctgagtgatggggtgcattgtaagatcagtgattccatgggcatgagacttactgcttcacttattttgccataaaattgattttttttgtcaaaagcatggtcatatgggatagtatcatgatgataaggcatttattaaatctatagaaagtgataatagaagaaacattgtaagtaagaaaggcaaattcatatccagaataggtttctattccaataaagataaaccactgccctgtcaataatggaagggatccagtgtgttcatcctgtcacccatagctggccagtttccttggccaatggttcatatcataggctcagtgttggtcttttgttgctgacacattggatacttagcagaagctaagccagaccagcctttatgaatccatgcacaacttccttccttgtcactgtgccttttattcatgaatctattgagcaaacactgaagcatctaggaaagagagtctaactgattttcatgaatggatcatcttatctacctgattttgcctactcttgttgattttggagatctttttctgccatgatatcctctggtaaatagtcacatggcatacaaatatcttcacaatttgtacccattcttagaggtctaccaccttaaaccttctccatacctcctctccaccaatcttcttctttccaagtacttgaatatcccagcaaaaccattagcttttgcccatactctggtatggatccatacctctttccatttcacttttcaggtgagatgaacttaccagggtgaaaaaacagatgcactgccaaaggttctgcctactggcaggatttaccttgttggcgatccttcagggccctcctaaatggggctgcaatgcagcagcagtccactcaggtggcccagcatattttgaagaaacatttgtaaaccaggcttgaatgtttttattcgtcagggaattggttatagggaacttcccatgagatcatatgttagagttgatggaaagttgccaacacagcaagactgggtgtcatgggagcgtgagctgcctactcactcaatttaatcgctccttcgagatctgcttgagcgtaataaaataacatttattacttacatttgaagaagggatgtttctgtacatgttcaattttatatttggtttgttcaaattaatatccaactcataaggaacagcgtgggactcatatttattcagtgttccctggtcagccattcagtctgctccaggaccaggcactatttttcagaaggagaatagttaactacagaaaaaagcatgaatttgctctaaaatccaagtgggctgtgctgtgattcaatagtgcatgttacctcaaaaattcaaagggggccaggtgcagtggttcatgcctgtaatcccagcactttgggaggctgaggcagatggatcacttgaggtcaggagttcgagaccagcctgaccaacatggtgaaacccccatctctgctaaaaaaaatacaaaattagccaggtgtggtggcacacacctgtaatcccagctacttgggaggctgaggcaggagaatcacttgaatccgggaggtggaggttgcagtgagccaagattgtgccattgtactccagcctgagcaacaagagtgaaactctgtctaaaaaaaaaaaatttaaaggggacttttaagttttgtctatgacagtgtggcttctctgggactaaactttctgccaaaaacaactgtaaaagctggacatatgtaaaacaatggtctgaagacctcagagagcaaccaatggcaggtcttgaaggactgcagtccttgagagaggagtcacatgaggctagttccacctgactccagctttttatcctaaggtatttcccagcttgcaggatgggaaagtagaacccaattaggaaacacaagccccactgtttggagtttaggttaccaaagtgactggaacttaagaggcaaattctaggagaggatgacactgcagagaaggaatgccaaaacctgtgtgtcaggaattttataaaatcattatttagtaaagaaaacagaaatatggctgggcacgatgactcatgcctgtaatcccagtacttttggaggccgaggtgggtggatcatctgaagttgggagttcaagaccagcccggctaacatggcaaaacctcatctctactaaaaatacaaaaattagccaggtgtggtggcatggcctgtagtcccagctacccggaaggctgagacatgagaactgcttaaacccaggaggcagagattgcagcgagcagagatctcgccactgcactccagtctgggcaaccatgtgagactctgtctcgaaagaaaaaaaaagaaaagaagagaagagaaatataattcagctgttcctatcagcatggttgcttgataagtattattttttaattaaaatactcagtttcattccacatgtatagttttgtctccccatcatttccatgtctgatcactgctactactatgtcctatcataacattccagatatacttaaaaccaagcaaagggtggagttccatctttaaaaactaaacaggcattttggacaacacattgttggcaatggaacctggacaacatttatcaaacacagcagggaaaattctcattctgcatcataaaaaggacagccagatatcaactgttacagaaatgaaataagacaaaaaatttttaacaaattgcttaaactattttcttaaagagacttcctccactgccagagatcttgaatagcctcctggtcagtcatctggaagcaattcttcacataactgatgaacttggcttccactttgggaagagaaccaccttttcctatacttgcttgcatttttgctttaatgtcgtctacaaaactaggtccttttggtgttttaggagttttttcctgtttttttttttttgaaggattcttgtccttttgatcttggtgttgatggttttgagtcttttccattctgatttgacttttgtgcatttttggctggagtatctcgtatagatttcttcactggtgctttttcttcagtttcctcatcatcgaaatcatcctcctcctcctcttcatcatcatcatcctcttcattgttgtcatcatcttcatctgcagcaagtttttcttttttctgtggaaccttgctaccaccttcaggagcagactgctttctagatatactcaagagtttcacatcctcctcttcatcttctgactctacatcttcctccacaactactaagtgctgcccactaatatgcactggccctgaagcacacttcaaccgtaaggtggtgttatttcaaagccccacagggtaactgttggctgtacagacattttcaaagttgccagtgttaccttaattgactgccttcgcaattcatggcctctgcttcaacaacgtgcaatcctttgcaccagcctctaaactgaccgttcttaaagataactggtctcattttcatcactatccaccttaaagtgatcatctttgtcggcctttagttcacaactgaaaagatagttctggggcctcagggggctcatgtccaggtccatcgaatctttgaatgggtggtggcacacccttaggtgggagagaaggcggacagagataaacaaccactgctcaagagaacagctgtgcaggatggactcacaccagggcaataattattattgatagttgggatgagaaacacatgggatttctgtgtttttttttttttaatttccaacttttaagttcaggggtacttgtgcagacgtggaggtttgttacataggtaaacaggtgccatggtggtttgctgcacaaatcatcccatcacctaggtattaagtccagcatctgttagttattcttcccaatgctctccctcctcctactgcccccacctcttacaggcctcagtgtgtgttgttccccaccatgggtccatgagttctcatcattcagctcccacttataagtgagaacatgcggtatttggttttctgttcctgcattagtttcctgaggataagggcttccagttccatccatatccctgcaaatgacatgatctcattcctttttatggctgcatagtattccatggtgtatatgtaccacactttctttatccagtctatcattgatgggcatttaggttgattcactgtatttgctattgtgaataatgctgcaatgaacatacacatgcatatacctttataagagaatgatttatattcctttgggtatattccaagtaatgggattgctgggtcaaatggtgctattatgcctctaggtctttgaggaatcaccacactgtcttccacactggttgaactaatctacactctgatcaacagtggaaaagtgtttctttttctctaccaccttgccagcatctgttgttttttgactttttaataatagccattctgattggtgtgagataatatctcattgtggttttgatttgcattcctttaaggatcagtgatgttgaactttttttcatatgtttgttggccacatgtatgtattcttttgagaagtatctgttcatgtcctttgcccacttttttctttttttttttttttttgagacagagtctcacattgtcgcccaggctagagtgcagtggcatgatcttggctcactgcagcctccgcctcccaggttcaagtgattctcctgcctcagcctcccgagtagctgggactacaggtgcccaccaccacacccagctaattttttgtatttttagtagagacgggtttcaccatgttggtcaggctggcctcgaactcctgctttgtccactttttaatggggttatgattttcttcaatgtatgctataataaaataaataattttaatattctttcatttccatggttacctgacctagattagacaaatagtagggctttaactttctttttgttgtcaaaatctggtgttggcataccttttctctaatttgaactggtattgcttatgtttgatacagcattaaggaatttgatgatttttgttttcaaaaaaatgaaattaaattcacaaaaatgaaattaattagtcatttttcagagaaatgacattaagtgcaataattttatttatcataaagattttgtacatcattacaacatcatgttgtaatgttataacatgtataaacattgaaaatcaactttaaatacacaatcccatttataatagccacacacaagcacaagaaacctaggaatacacctaaccaaagaggtgaaagatctctacaagaagaactcaaaacattgctgaaaaaactatagatgaaacaaagaaatggacaaacattccatgctcatgaattggaagaatcaacaacactaaaatgaccatactgcccacagcaatatacagattgaatgctattcctctcaaactaccaacatcatttttttcacagaattagaaaaaaagctattcttaaattcacatggaaccaaaaaagagcccaaatagccaaagcaatcctaagcaaaaagaacaaagctggaggcatcacattacctgacttgaaactctaaggctacagtaatcaaaacagcatgatattggcataagaacagacacatagaccaatggaacagaatacagaacccagaaataaagctgcatacctacagccatatgatcttcaaaaaagtcagcaaaaataagtatgggaaaaggactccctcttcaataaatagtgctggggtgggggagtggggagggatagcattaggagatatatctaatgtaaatgatgagttagtgggtgcagcacaccaacatggcacacgtatacatatgtaacaaacctgcacgttttgcacatgtaccctaaaacttaaagtataataaaataaataaataaataaataaatagtgctaggatagctggctagccatatgcagaagaatgaaactgcacccctacctttcaccataaacaaaaattaactcaagatagattaaagatttaaatgtaaagatctcaaagtataagaatcctagaagaaaacctaggaaacaccattctaaatattggccttgggaaagaatttatgactaagtcctgaaaaacaactgcaacaaaaacgaaaattgacaagtggaacctaattaaactaaacagtttctgcacagcgaaagaaactatcaaaagagtaaacagacaacctacagaatgggagaaaatatttgtaaactgccgggtgcagtgactcacgcctgtaatcccagaactttgggaggcggaggtggaaggatcccttgagctcaggagtttgagacacttgggcaacatagagagaacctgtctctacagaaatttaaaaattagccaggtgtggtggcacatgcctgtagctccagctactcgggaggctggggtgggaagattgcttaggcccaggaggtcaaggttgcagtgaactgagatcacgccactgccttccagcctgggcgacagaataagactgtctcaaaaaaggagggtgggggaggggtggggagagagaaggaaaagaaagaaaagaaagagaatatttgcaaactatgtatctgacaaaggtctagtattcagaatctataaggaacttaattcaataagcaaaaaccaaataataccattaaaaagtgggcaaaacacataaacagacacttctaaaaagaagacatataagcagccaacagacatgaaaaaatgctcaacatcactaatcatcagagaagtgcaaatcaaaaccatgagatattatctcataccagtcagaatggctatcattaaagtcaaagaagaacaggtgctgaccaggctgtagagaaaatggaatgcttatacactgttggtgagaatgtaaattagttcagccactgtggaaagtggtttggcaatttctcaaagaacataaaatagagctatcatttgacccagcaatctcattactgggtatatatccaaaagaaaatacgttattctatcaaaagacacatgcactcatatgttcattgcattagtattcacaatagtaaaaacatggattcaacctaggtgcccatcagcggtgggctgggtaaagaaaattggtccaaatatggccaggcgcagtgtctcacgcctgtaatcccagcactttgggaggccgaggctggtggatcacctgagttcaggagttcgagaccagcctgaccaacacagagaaaccccgtctttactaaaactacaaaattagctgggcatggtggcacatgcctgtaatcccagctacttgggaggctgaggcaggagaatcacttgaacctgggaggcggaggctgtggtgagctgagatcgtgccattgcactccagcctgggcaacaaggcgaaactccgtctcaaaaaaaaaaaaagaaaaaaaaaggagaaaattggtccatatacagcatgaaatgctacatagccataaaaaagaatgaaatcatggatgcagctggagcccattatcctaagcgaattaacacaggatcagaaaaccatgtactgcatgttctcacttataagtgggagctaaacattgggtacttatgctcataaagatggcaacaatagacactggggactaatagagggtggagggagggtagcgaggtttgtaaaactacctgctgcgtactatgctcactatctgggtgacgggatcattcatatcccaaacctcagcatcatgaaatgtacccatgtcacaaacctgcatgtgtaccccctgaatctaaaaagtggaaattttcttacaaactggtgaaattgaagggagaaatggacaaatccataattattgttagaaactttaatatttccctttcaggaattgatcaagcagatagaaaatcagttaagatatagaaggtctaaacagcactatcaaacaactagacctaattgacatttatagaacactccacataatagcagaatacacttccaagggtgcacagaacattcaccaaggtaggtcatattttaggccactaaaaaatttaaaagaataggccattaaaaaaatttaaaagaatagaaaagctttttaaacaatagtaatcatacaaagcatattcttgaaccataagggaattaaactagacaggagtaacagaaagtgattgggaaaatcttccaaatattctgaaattaaataaaaacactttgaaataagcatgggtcaattaggatgttttaggggaaatttaaaatacatttggaataaaatgaaaataaaaatgcaacatattaaaattcgtgtgaagttgctaatgcaggagctattgggaaatgtacagacttcaatgcttacattgaaaaataaaagtctcgtatcaatgatctaatctcccatgtcaggaaattagaaaaatgatcaaattaaacccaaagtatgtagaaggaaaaaaaatataaagattagaggaagaatcaataaaattgaaaacaggaaaatgagaagaaacaaactaaatgctgattctttgaaaaatcagtaaattggtaaacctatagctaaactgaccaagaaaaaatcacagaaaacacaaattgccaatattaggaatgaaagaggagacatcacagacattaaaaggataataagggaacagtacaaacaactctatgtttataaattctaaaatttggacaaaatggacaaatttcttaaaaggcagaaattataaagttcattcaaaaagaaatagataatggaaaaatttctatatctattaaatagttaattttgtagttaaaaacttcctgaaagaaaattccaggccctggaaattttacaggcaaattctaccaaatatttaaggaagaaatagcaccaattctatacaatgtttttgagaatgtagaagagacgggaaagcttcctaattcattttatgaggccagcatttatctaataccaaaccagacaaagaaattacaagaaaactacactctggtatctctcataaatattgatgcaaaaatcctgaacaaaatattcacaagtcaaatctagtaatatataaagggcaaaacatgtcacaaccaaatggggttcatcccaggaatgcagtttgtaatgaataaaattaaagagctaagtaaatggagagatatattatattcatggaatggaagactcgacattgttaaaatgacaactgtcccaaatttaatctatagatttaacatagtccctcccctccccaaatcccagtaacttggttctaaaatttatatcaaaaagcaaaggaactagaataaccaaacaactgcaaaaaaattaataaagtcagaggagtcacattatggaatttcaacattgactataaagctacagtattcaagaccgtgtggtatcggtaaaggatagacatatatatcagtggaacagaatagagagcccacaaatagatacacacaaatataatcaactgatatttgacaaaagtgtaaaggcaatttgatagataaagaatggtttataacaaatggtgctggaatgattgtatgttcatatgcacacaaaaaaagaatctcaacctaaacctcacaccttacccaagaattaactcaaaattgttcatagaatgaaatcaaaaatagaaaacttctagaaacttcgttttctatagggcaaaatctgcatgacctttggtttggtgatgagtatttagatatgttatcaaacagcataatccataagggaaaaatgataagttaggctttatcaaaattgaaaacctctgctctgcaaaagacactgtaagcgaattcaaaggctagtcattgactggggaaactacttgtatatcaaatatctaataatgaatttgtacctagaatatacaaagaacacttgaaattcaatggtatgaaaacaaacaacctggattaaaaagcaggcaaaagatctggacagacttcaccaaaaaagatatatggatagaaaatgagcacatgaaagatggtcaacacaattagtcatagggaaatgtaattaaattaaattacaaccacaataagataccactacatacctgttagaatgacatcccccaccagagtggttacatttgttacattcaagcctacattgacacatcattatgacccaaagcccatagtatacacttggtgtagtacattctatgagtcttgacaaatatataacatgtatccaccattatagtatcatacagaatagtttcactgtcctaaaagccctccgtgttctgcctattaatccctcccttctcctagtctccctggcagcccctgagctctttactgtcttcatagttttgccttttccagaatgtcatacagttaaaatcatacattatgtaacctttttagattggcttctttcacttagccatatgcatttaaatttactattgactcttcaaaagtgtcaaggtcatgaaagataaggaaagaccaataaaatgtcaggcaactaagaagatataataaaatgcaatgtggcattctgattggatcctggaatggaaagaagacattactggaaaaactggagaaatttgaataaagtctctagtataattaatagtacgtattttacaaatgttaacttcttacttttgataaatgtatcatggttatgtaagatgttgacacagaggaagttaggtgaaggatatatgggaactctcatactatctttgaaactctctgtaaatataaaaccatgcatggtaaaataaaatgataaaaatggttttggttatacgaacatataatttatctaatatatattaaagaagtaaaactataatattcatgtttttaaaactactctagctgggggtagtggtgcatgtgcctgtggtcccagctactcagggagctgaggtgggaggatcacttgagccctagcggtcaaggctgcaatgagccgagatagcgccactgcactccagcctgggtgacagagcaaggcctcttctcagaacagacaaacaacaacaacaacaaaaactcctcaatgtagtttaagatgtgatttttcttgtccttttaatacatcccttttaggatgtatagtcaaaacattgtgtaaaagtcacttacagtaattttctttgtggtcatgccactaacttgagagacagccagggtcaagtgcttctgtttattttaaattgagggaattgtggggtttttctttctgatttctttgaactatgtaaaaataattacatatgtctagacttgcttccattctggtcctctccttcctgttccttgcctctccttatagataaccatctttatgagttcacattttccctctagttttttcctgaaattttaagcaaactatctcctttcttacaaaaacacttttctgcagcttgctttttttcacttaacacatatcctagagatgatatcatatcagtagagagcttccttatttcctttttattactgcatcatgcatttttatggtttattcaatcagttccctgtatagtgatgaatacgtaacctaatgaatgattgatggtgactcctcgggatagatccctagaagtgatactgctgagtcaaagggtaaatgcatatgtaattttggtaggtattgcggtagtgttataccagtttgcatcctcacaagcaagttataaaagttctgtttttctacatgcatattgtcaaaatattggatttttgctaatctgctaatctgattaagtgaaaaataacatttcagcacaatttaaattcgtattctttttatatagtaaatactcattatttaaaggccactgcatttttttttatttgtctacacatatattttgcccatgtttttattgaaatgtttatttcaatcttctacattctttgtataatatgaatatttgcctttccctgtgatacgttttttatttgttttttgactttgcttttaagaattttttgccatgaagattttttttttattttagtaaaggtttcttgaattactaagtagtaaaattttatacaacaacttaagattccaataaaaattaacattatttcattatcatgtattgagtcctttctctgtgctaagcactgttatttggtgtcctggaagcagagttagctgcatttaaaggtcaaatgctcctgtcacagcctgggtcttgagacatgattttggtgatggctgcctttacatccctgtttctcagcgtgtaaatgagggggttgagaattggtgtgagaatggcatataccacattgcccatgatatggaagtcaaggggcaggtcagccctgtaggccacgtaggctatggcaatagatgagtagtaggtgcccacgaccagaaggtgggagctgcaggtggagaaggcttttgcccgtccttctagggaactgatgcgaagcactgaggccaggatgtggacataggagagaagcaccaggagaagggggaggaaggacaccaccatggcgatgcagaagcccatgagggtctggggggtggtgtcagagcaggaggcctggaccacagccagatgatcacagaagcagtggtagatgtaggcaatgctgttatatgccatctgggaggtccttactactgctgggatgggcaggaggagggcagttagccaggcactggctgccaaggtagcattggtctgtgggttcatgaggacagggtagtgcagtgggtggcagatagccacatagcggtcataggccatgaccaccaggatgaaggcttctgaacatgtaaaactttggaagaggtacatctgcagtaagcaggaagaaaagctgaggaagcggtccccaagcaagaataaggacagcatcttggggacagtggttgtggtgaaaaggatgtccaaggtggagagattgatcagaaagaagtacatgggcttgtggaggctgggctctgccaccacggccaccaggatcagggcattacccatcaggatgagaaggtagaagaggaggaaaataaaaaacacagggaggaagaaggtctctggcagagaggggatgcccaatagatagaagacgggtgagccatccactgattcattacaggctgtggcatccattgtgagacacagctggatttctcagagatgggcagctggaacatctagacattggaaacatctggaaaccatagaaacaaaggattctggagtgataatgctataatgtttactctgtaggtaatataagcagaattatttacaaccaactgtagaggactgatgaggggctatggtattgacttttgccatgtgaacgcaaaatttgtcaaatattgattattaattaattaataaccaaccaaatagaagtctgtatgctttgtttaggtgatgaagtgatcaaattgaagaaggcaggcaaagttcctgtcttcccagagtttatattttactgggaaaatcagatctaaacagttgattgttgaattataattgtgaaagtgctttggaaaggcttcttctggtcttcatcttagtttccatgctgtgtggtttaagttgatgtcagatctcataaatcaagtccttaagctcatgtctctacttttgtactcactcaaagttccatcatgttccattgaggggcttctttctccaaggctgtgtgtactatgcagctgctcacactcttattaagtttctttcttgtatgccttgactagtggttctttctgactccatttaagctaggtgtctggacttctgctcctgtattggatataatagaccatgatagcccaacactttcactgcaatgattagggaaacctggataaattacacaaatcacatttttaaacaaattgaggaatatgggtgccataaggatgagatgaaggcaaactccaatgggtggggaccctccaaagttaactaataatcaccagctcttttgttctctgggaatatttgatttggggaccatgatgtggcttagacttggaccaggcagagagtcatagatgagagaaagagaaaccagtaagacttgtgatagtcaaaaaaggcttacaaaacatactggaaatttgaggcactctaaatgcataacaagttttccctgtgggacatcttctgaattctggctatgcaagggaggctagaaagctgtgctgagggcctctaaaagacaaaacaaaatctcccatgatcccatgatgcttaagagaatagaggaagagggatttcctcacacacacactggtatttcctctcaaaacattttacaaagatttgaagctatgtgtgtatgtagtgggcggggggaaaggagggatggggaatgcggctaacgaattaagctccaaaccaccaaagggtagatgcaaatctcccacactccttccggggtgaggagataaggatcaaccagactatcagcccacaactcaggagggtcataccttaagaacaagaacaaaccaaagttggactaaattttactagaactgaaactcagccctaacctaactcaagccttaactggctttaggtagccagcctaccttactctacctgcctaacaaagagaagggaggaatctgtctgatgagagacatcatctggggcctctgtgaatctaatataaataatattcggtgcacaacacgaattattgcaaaaggcaggaaaatgtgaccaacaatcaagagggaaaatacacaataaaagttgacatacagatgatcccattacctgagttagcaaacaaggactctagtataactatgtttatatattaaagaaaatagaggaaatgttgacaaaatggattttaaaatgggcaatttcaatagaaaattggaatctattttaaaaagaaccaagcaaatattctagaacagaaatatccaatatttgaaattaagaactcactggataggtataatagcaaactggacacaatagaagacaggattagagacctgcaaaatagatcagtagaaaatgtctaaaattaagcccagagatagaagagtatatcttctgtatacttatttgatatttgatacggtatgacttaattgatattaagtgacaggcaaaactaatctatgatattataaatcagtacagtgattgtctatgggtgtgaggactgacaagaagcaggcaagagcatactttctggggtgatagaaatgttctatgtattgagttgagttttggttacatgtatgtttacgaaagtttattgaattgtatacataagatctgctcattatcttctgagtaaattttacttcgctcaaaaaagacaataataaatacaatacaaagagaataagaaaaggcaggaaccagactaggagaagatattttcctattttcaatacatttatcaaaggccatgtatccagtatatataaaaaccttgacaagtaagaaaaagacagatgacctaatggacaaatgggtgaaagacttgaataggtgggcactttacaaaagagaacatccaaatggccaataagcatatgaaaaaattagccatctagagatgtaaattaaaatacaggatgttaataatacatactcactaaaatggctaaacttaaaaggaccgcaagtgttggtaagatatgtagtaactggtaccttcatacattgatggtaactagtacaaccacttcggataacagtgtggcaacatcttcttaaacttatgacttagcaatttcacatcaggatatataaccaagaggtaagacaaggtattcagctatttttgtttgttcatttgtttaaggtactcacgtgcaataaagcccaaaaatatttgggatagataatatatagatatctatagatataaatataaatctatgtagagatatagatcagctagtgatgcagctaaagatatagcacatttccagcaacccagaaagctcccttgcacctgatccaataaattctgctacccccaatgtagctattgttgtgacttctgtcaccatggattaaatttttctgtttctgatgttcatctaaatggcttttgttaggctgggcatggtggctcacacctgtaatcctaatactttgggaggctgaggcaggcagatcacaggagtttgagaccagcctgggcaacatggcaaaaccctgtctctacaaaaaaatttaaaaatgaaaaataagattaaaaaaaaaaagataaggtcaggtgcagtggctcatgcctgcaatcccagcactttggcaggctgaggcgggcggatcatgaggtcaggagtttgagaccagcctgaccaacatggtgaaacctcgtccgtactaaaaatagaaaaattagctgggcatggtagcacacgcctgtaatcccagctactcaggaggctgaagcaggagaatcgcttgaacctgggaggtggaggttgcagtgagccgagatcacgtcattgcactccagcctggcaacagagcaagactctgtctcaaaaataaataaataaatgttttttgtcatattacaataaaaggaatggcaaaagatgccttttgtgagaggacttgcttccaggttggaatctaagttaaaggtgtattctacccaatagcagaaacagagattggaggatgtccctctgtaagagcatgacttttcatctctcctatcagctacgctgttcagcaggtgtttctgattaaccatttcattatcactatcctgtagtcttccctagccccagataagacagtactacaggagtctgaaaacttgggagtcttgggagccattgttgctagagaacaagtcgtcttgtgacaagtgcccaaaggcagaagaccccattctagaggttgttctccccctgtcaaggaagaagagatgtgtgcttttgtcctcccacagaaccggagatctttaactgagggagaatattgactgctctactctgttggggatgtctctctgaataaacaatccaggaggaagttcacgtttatgtttacatcattgtctcttgaccctgatgattccaagatgattacctgatgatctgatgattaccttctctctgattttccctatttttcttacctctaataaaatatctctcatgccattgaatcataaaaaattccaaacctggaaatatccaggcggcttttccttttctcttttcttttttttctttttctttttctttttttttttttttttttttttttttttgagacagagtcttgctctgccacccaggctggagtgcagtggtacaagctcggctcactgcaacctctgccctcccgggttcaagtgattcgtgtgcctcagcctcctgagtagctgggattacaggcatgtgccatcatgcccagctagtttttgtatttttagcagagacggggtttcaccatgttggctgggcttgtctcgaactcctgacctcaagtgatccacctgcctcagcctcccaaagagctgggattacaggcgtgaaccaccgcacccagccagctttttcttttaatatagaaagggcaaaagacaaaaagatccagggctttcccatactgtcatggccggcgagccacagagataggactggagcccaggctctaacccccagagcagcattcttctatcgtcggttccctggagaatctggaagctcaaattttcatgaggggagagactggggcaaaggttttctctttccttctccatatatttggctgatattgtcagcagcaaactacaaatttcagagtttgttctttagtttcctaagtgtggggtgggctggttttctgtcagagagtgaaggcaggtataatgtctttctaaaagacatatgaggcagggcacaggggttcacacctgtaatcccagaactttgggagaccaaggtgggagaattgcttgagaccaggagtttgaggccagcctgggcaacatagcaagaccctgtctctacaaaaaaattttaaaactagccaagtacagtggcttgtgcctgtggtctcactactcagaaggctgaggcaggaggatcacttgagcccaggagttcaagactgcagtgagctataatcatgccactgcaccccagcctgggcaacagagggagaccctgtcttttaaacaaaacaaataaacaaaaagacacatgggacagaccactccattgtgaatgctcccttgaaagagtattctacagttcggccccaattacacaagcaggaaagcaaaactgctgcacctccacttaagagataaccctcagttaacagacccaacctgcctaagcaaatcaccaggtttttctaatacccaaagagatgcaaactaccttattctgaacgttgttacagctcagagaagtcaattatggattgaatgccaccgagttaggctgaattggggtttgaggggagaaattcagagccgtcaagcctgactgagcctctcttcccacctcctccctcacttctattaaacagcagggagacagatgctgagtctgaagtccagaaatagtgtcttttcaaggtcaaccaacaaattcatagcagaagtaggttttaaagccggtgtcctggctcccacccagtctttgtaggatgtttcatgagagaggatgattccttagcctgctattcaaagcctgtcttcttgcagccttgtttctccttattctagtcaaatggcaactccttgctcttgccttgtgcttctgccaaattcagctcaaatattacttcctccaagagatcttctatggtcctggctggctcaggagcctctttcctgggctcttgaagttcctgtgcttctgtttgtcattattatgattacaccaggttgtctctgtctatttatgtgtccaccacaccaggagcactttcagagcagtaatggggtctgatcgtttctatttgatactgcaccatccttcccaggagcttagtgctctggaatgcagctttccaacttgccttgttttgctgataaatcatcaaataggaatgaaggggccattagtgattaaatagttttcacctaacctcttttttttttttttttttgagattgagtcttgctctatcacccaggctggagtgcagtggcacgatctcggctcactgcaacctctgcctcccgggttcaagcgattctcatgcctcaacctcccgagtagctgggattacaggcgcttgccaccatgtccggctaatttttgtatttttagtagagatggtgtttcaccatgttggccaggctggtcttgaagtcctgatctcaagtgatctgcccgcctcggcctcccaaagtgctggcatttcacctaacctctttattatatagatggggacagaaaagggagtcccagaaatgggctgtgactttcccaaggtcacacagtaagtgggtgatagaactagaactagactgtcaacagagctagattatcaactcaccttgagctctcctggaccagctctgccactctcttgctgtgatgctgggtctctgagcctcagttttcccatctataaaatgaggactttggaagcaatgatctccagcttgataaatattttgagtatctactctgtgtttagataaatgagagattcgaagacagatgtgtcatggcctcagcctcttaggaaggagagcaagggcgctctcatttgttaagcttctgttgcctgcttgattctttacagtcattacacatcattacgacgcccaaactcatgcagttctctcatgatattctcaccatcctgcactgtttccatagaaaaggagcaggatatacgtgaagcacagaatctaggtctattaactttgcagttagaaaggcctgagtttccttcctggctccaccactttgtgctttcctccaatggactgcaattccctcacaaattattcccatttctcttatcgtcatcagctttgcctccttgtgaggaattctcttccaagatcattagcctcttgcttgtgactgcacagccctgcccctgcctgcgagggtgtctggtctacactcacccaggctgactgcgtggttgacttggatcctgggaccctgacattcccaggatctttactgtggttgtacatgcccccaacctccctgagcctatctccccatcccagtctctgcctgctctgcgcactccatccccagcccagctcacctaccaatcctggtccgccttgatgtcttgtgtagagtcgtcacagttggccttggttgggaagagccaggtagaaactcaaccatggccctttaaaccctcgggcccctctctgcaaccaggcctgctggggctctctccccacaagaaggctcacccgtgggaccagataactgccagtcagctgagaacaacttccgagggtggagtgggggactttgttctgggctttgctgataatgaaaacaacatcattaacaaccctcatgggtcccagaactttatcaccagtattattcctgttttcccatctggtcctcacaatagccagggaagacaggcagagtcaggattatttccactattttacatttgaggaaactgagatctagagaagtgaggtgacttgcccaaggtcatatgagtggctggtggcagagctgggatttgtacccaaggctccaattctggttcagtggttcagcaacatgttatctaatgactaagacccgagttattcccagtaatatgactttgaacaaatcccttaacctcactgggtcttcattttgtcatctgtggaatgggtataacgacactaactctctcacaggataactgggcaggttgaggtgcttcacccagttcctgccacttattaggcattcaataagtgggagctattattttaatggaccaaagcagtaaagccttgttcaatgagtatgtgatacttccgctgctgtgcaatgagaacttgcaaaggttttgtggaaagaatgtgagggtggaagtctctgccccaaccccatacaggacaaagtcaagagtcacagactcttcctgcctcaatctttctgattctctcctttggctccagtgttctgtttctgacttgactgacttggtcactcctactaatactcataaaattttaatttttttttaatttcacaagtaataaacagaacctcattgtagaacattttaatcaatacagagctttactgagtcaaaagtgaaagttctaggccgggtgtggtggctcacgcctgtaatcccagcactttgccgggccgaagggggaggatctcttgagtccaggagtaagagagcagcttggacaactggcaaaactctatctctactgaaaaatacaaaaaaattagctgggcatggtggcatgcacctgtagtctcagtgagaggtgacagcgtgctggcagtcctcacagccctcgctcgctctcggtgcctcctctgcctgggctcccactttggcggcacttgaggagcccttcagcccaccgctgcactgtgggagcccctttctgggctggccaaggccggagccggctccctcagcttgcagggaggtgtggagagagaggcgcgagtgggaaccagggctgcgcctgcgcttgcaggccagctggagttctgggtgggcgtgggcttggcggaccccacactcagagcagccggccggccctgctgtccccaggcaataagaggcttagcacccgggccagcggctgtggagggtgtactgggtcccccagcagtgccagcccactggcgctgtgctcgatttctctctgggccttagctgccttcccgcggggcagggctcgggacctgcagcccgccatgcctgagtctcccaccccctccctgggctcctgtgcggcccccgcctccccgatgagtgctgccccgtgctccacagcacccagtcccatcgaccacccaagggccgaggagtgtgggcgcatggctccgggactggcaggcagctccacctgcagccccggtgcgggacccactgggtgaagccagctgggctcctgagtctggtggggacgtggagaacctttatgtctagctcagggattgtaaatacaccaatcggcactctgtatctaactcaaggtttgtaaacacaccaatcagcaccctgtgtctagctcagggtttgcgaatgcaccaatggacactctgtatctagctgctctggtggggccttggagaatctttgtgtctagctcagggattgtaaacgcaccaatcagcgccctgtcaaaacagaccactgggctctaccaatcagcaggatgtgggtggagccaggtaagagaataaaagcaggctgcgcgagccagcagtggcaacccgctcaggtccccttccacactatggaagctttgatctttcgctctttgcaataaaccttgctactgctcactctttgggtccacactgcttttatgagctgtaacactcaccgcgaaggtctgcagcttcactcctgaagccagcgagaccacaagcccaccaggaggaacgaacaactccagatgcgctgccttaagagatgtaacaccacgaaggtctgcagcttcactcctgaagccagtgagaccactagcccaccgggagaaacgaacaactccagatgcgccgccttaagaactgtaacactccccgcgaaggtctgcagcttcactcctgagccagtgagaccaccaacccaccagaaggaagaaactcccaacacatccgaacgtcagaaggaacaaactccagacgcgccaccttaagagctgtaacactcaccgcgagggtccgtggcttcattcttgaagtcagtgagaccaagaacccaccaattccggacccatcagctaccagggaagctgaggcaggagaaacacctgagcctgggaagttcaggctgcagtgagccacagctgtgcctctgcactctagccttagcaatggagtgagacccaggaaggaagggagtggtggaaggggggaaggggggaagggagggaagggagtgggggaagggagggagggagggaagggagtgggggaagggagggagggaagggaggaagggagggaagggagtgggggaagggagggagggagggaagggaggaagggagggaagggaagggagggaggggagggagagaaagagagagaaagttttttttcacaccaattcttacccatatttttcctccagtcttaacaatggagtgagatcctgtcagaaagaaaggaaggaagaaagaaaagaaagaagagttagttagtcttcttcacaccaattcttacccacatttttcctccatgctccagaagtaaacattattactgatttggtgtgtttcttccagacttttctaagcgcatgtgtttgtgtatgtgtgtatggttttgcttttcttttaatgtaaattgaatcattctgtatttattgtatagcatattttaatttaataagtctaggaatttttctgtgtctgatctacttcatttttttgtatctgatatttggcattttgtagtacagatacaacatagtttgtctaataactcatctgttgatgaacatttaagttctatctcattcttgctattatgaaaactattataattaatttccttttaacatgcatttggggtcacatgtgctcaaatatttctcggagatagacagatccttagaagtagaacttctgggccaagcagtcagcacattttcaaatggaatggggtgtgcatgtgcagggactatcccagcttcaaacccagaagctttgaggatgctgagtcacagtgatgactgagatgaccctgttacacccggcctgatgcttctgcccaggaccaggggaaaacccatgcatgaagggttcatttcagcctgcagaagagacttccctattagacctctgcagactgtagactttcaactgcagactgggaggttactaagtccttagcagctgagtacagaacacgatggaaatgaaaacatggtacaacagaggttacagccctctcctgacctgataaacttcatgatggagctaaagatggtttgggaagtttctttgaatcacaagcagaactgtatgtgctgtctcctcctgtctggatctactcactacttgctaaagagaagaattttggtttgggataaatttatgtggatcttcgctttggtgccataaaggtaagtgctaaagatgtttctgggggagaagactaagctctcttaagttaaaggcaaagaatcctgcaaaatcaccaggtggttaggtggattcttttgttctgttttccatttcttagacgtgatgagatccctaataagccttaaaaagccatcttttggcggcataagaatgacttaaggctttcgagatgttatgtatgaaagtaactaaaagacttgggcacttgggctgaaataacccatatggagtgcaacagttaagagaattgcaataagtaggagaaaacaaacaaaaactaaaatttagaatccttttggatttcctattttgttttactaaagagaatgaaccaaaatagagagtaaaactgttggctgagatttctttgtataaaaagccaacattctaagacttacttttataacattatgggataaaataggatttcttttattacctctaagaataaaactctcctcatcctgctaggaaatgactggcttttctatagccatagtaacaatgatcagaacttgtttaaaacatgcttaactggctgggcatggtggctcacacccgtaatctcagcactttgggaggccaacgtgggtggattgcctgagctcaggagtttgagaacagcctgggcaacatagctgaaaccccgtctctacgaaaatacaaaaaaaaaaaaaaaaaattagctgggcgtggtggtgtgcacccgtggtcccagctactcaggaggctgaggcatgagaattgcttgaactcaagaggtggaggttgcagtgagccgagattacaccactgcgctccagcctgggcaacagagtgagactctgtttcccaaaaacctcaaaaaacaaacaaagaaacatacttaattgtttaatcacagctttgagccagtacccacacttctgaaagtcagggaatctaaaagccactcagcaatggtttaactccagtaaccacacttccatagctaaaagcaaactaatccctaaacactcccacctttgaaagtccaccaaccccagatctccacattttccacagccctgtgtaagatcagctccctgtgtttctcaaaaacagactatatcataaaccatagcatcctgtgcttacactagtgatacattcagccttttgtttctgatattgagtggtgatctgttcctttaacatttcttatttatttccatatggtctatagtaatgtcccctctttcacttctgattttagtaatgggagtcttatctctttttatattggtaggctaaagttttaacagttttattgatatagtcaaggaaccaactttggttttgttgattttctttatttttctattctctatttcatttatttctgttctaatctttgttattttatgcccacttcttgtttgagttgagtttgcttttcttttttaatttctaaagataaacagttagggtactgacttgagatttgttttctttttaatataggtgtttacagctataaatttccctctctgtactgctttagctgtatcccataaatttgggcatgttgtgtgttcattttcattcatctcaaattattttctaatttcccttgttattcttttacccattggttatttagaagtctcttgtttaatttccacatatatgtggaagtagcattcagtgatagaggttttattattttaaagatagcacagaaaaagtggacaggttatttaaaacaaatattgcttagaaccaaaaaaaaaatttttagcaagtttacaaaaaaatgaagccctcaaagttgaaattagacaaagttatgcagatcattcaggaaataaaaggaggataaaaggaattaaattgaatcatgctatttgaaatataaacagaaagcacaaaataagaatttagtgtaagtattttattttatttaccattaagaatatattaaattggccgggcatggtggatcacacctgtaatcccagcagtttgggaggccgaggcgggtagattgcctgaggtcaggagtttgagaccagcctgaccaatatggtgaaaccccatctttactaaaaatacaaaaattagccaggcatggaggcctgcgcctgtagtcccagctacttgggaggctgaggcaggagaattgcttgaacctaggaggcggaggttgcagtgagccgagatcgtgtcactgcactccagcctgggtgaaagagtgccactccgtctgaaatatatatatatatatatatatatatatatatatatatatatatatatatataaaattaatgcagaagaaatggcatttcaataaatattattctagtaatggaatcattgtctcatgactgcaaaatgactaagtatttttactacatgtgataattgaagtcaggttttgagctcaatgttttatttgattttagaaatattttaaactagcttttgatatattagaatttatctttttatctttattctttctccctctcccagctacatcaagatataaaatatagcacatagtaggttcatgatatatgtacttactatgtgaatgacagctatgtcatttagctgacagttttaattttcttgcgaagcggtttaggtagccacttttgaggacagataaatgattaggtttaaaaaattcagatcattgccacatgtaaaacacattagtttatgtaagcatcccaatgtttggttaaaaaaccaaacctctactggagagaatcagtaaaattaggaccattagtcagacacactatgactcagaatgagcactgcactctgagataaaaatgagatcaattttaagacagtgttttccggatgtaagtgtgcctcatgtgagtttagtgtgaggaggctcctcagataacaaacctaactcaagtgggactttgatactgccagaccctcatcctatatgtctctgttcttttctctcatctcctcttctcaatgacttttccacaccttctcttcactcctcagtccaccaatacctcttcccatcgccactccagcaatcaagtgataactcccacagactgtcatcccacaaccacccacctaccagcctctgcacccacacactgcgctttcctacctgtgaccacagatgaactcctcatgcccttatgtaaagtcagtcacagcctgggcaacatgcaaaaccccattcctaaaaataaaaaattagctgggcatcttggtgtatgcctgtagtcccagctacataggaggctgaggtgggaggattgcttgagcccaggaggtcaaggctgcagtgagccatgattgtgccactgccctccagcctgggcaatagaaggagaccctgtctcaaaaaataaaaataaagccattcacttcaaatctcccctctctcctccatcaccaatttttctctctactgaatcattcccaccagtgtacaaatacattgtaatttttcccaccttaaacaaaaattttatctctataaactgctgattacattttaaaaatcaaggggcacaacaccttgtatagtagtagactatagtagactactattcattcagaaggagtggaaatataactctatagtcatatttatgtatcacatagcaatatttataaattatatatatgtgtaaacatgtgaaaatatcttctattaaaaatagaaagaaaaatgttttaatgaataaaaatggtttctttaaaggggatgcaataggtggaaggagcaggaatggaagctagaattcaccaaaaatgccttattttataatactgactttaaaaattgttataattatgactttaaaaattataagggtggtggctcacgcctgtaatcccagcactttgggaggccaaggtgggtggatcatgaggtcagtagatcgagaccatcctggctaacgtagtgaaaccccgtctctactaaagatacaaaaaaattagccgggcgtggtggtgggcccctgtagtcccagctactcgggaggctgaggcacaagaatggcgtgaacctgggaggcggagcttgcagtgaaccgagatcgccaacagagcgagactccgtctcaaaaaaataaaataaaataaaatcatgtactctgctggccatggtggctcatgcctataatcccagcactttgggagtccaaggcaggaggattatttgaggtcaggagtttgagaccagcctggccaacatggtgaaaccctgtctctactaaaaatacaaaaattagccagctgtggtggtgcaagcctatagtcccagctacttgggaggctgaggcaggagaatcacttgaacccaagaggtggaggttgcagcgagctgagattgcgccactgcactccagcctggataagacaatgagactccgtctcaaaaataataataataaatcgtgtactctgctgagctctctaggtcccccgtctctctgtgtgggggcctctcaggcttttgtgacaggaggggcaaatgccttctcttggagaactcactcctgatagagcctaaaccaaaggtagacctttccattattgttcccaagcagagactccaggcacatcccgggtcgcttttgtcttcctttctcccggttgctgcagcccagcaggtgttctgtctagtcactgtctgcccactctgctgttggctccgcctcctcaaagccaaaaggagcagtcacgagggccattgttgctagaagggacccagataactgaaagctgtagctgtccaaagagaagcctgtctcaaagttttcagggattgttctgaaaactttgacatgtgcgcactacatatgtgcttgggtcaagccctggactggtgcattggagctgaggaaatactggcttagcctacttcaggagaagcctctgatgggcggtcctgccagcttcaggtccacatccacattgctgctctttgacctccactgattccatgagcagtttgtctttgattttcttggaactacgtctacattcttttctagaacaaaagcattcgtgatgtgtaaagaaatcacgattcatactgtacaatctcaatctcataaaactggatgttatacctatattcacagaggacctagaaactgtaaactgcttgtgattgtaggtgactttgttctttacttcttgtgtttttaagtttcctaaaatgcacatattaacttaaaaaataagggttatgtcactaatcattagagaaatgtaaactaaaaccacaatgagataccatctcacactagtcagaatggctattattaaaaactcaaaaaataactcatgctggcaaggttgtggagaaaagggaatgcttatacactgctggtgggaatgtaaattagtttagccactgtgggaggcagtttggtgatttctcagagaattaaaaacagaactaacattagaccagcaattccattattgggtatatatccaaaggaataatcactctaccataaaggcacatgcacatacgtgttcatcacagcactattcacaatagcaaagacatgaaatcaatctaaatgcccatcaacagtagactggataaagaaaatgtggaacatatacaccatggaatactatgcagccatgaaaaggaatgagataatgtcctttgcagcaacatggatggagctggaggccattattctaagtgaactaatgcagaacaggaaaccaaatactgcacgttttcactttaagtgggagctaaacattgagtacacatggacacaaagaaggaaacaacagacaccagagcccacttgagggtgaagggtgggaggaaagtgaggatcacaaaactacctatcagggccaagcacagtcactcatgcccataatcccagcactttgggaagccgaggtggacgggatcacttgaggccaggagttcaataccaggcttggcaatatggcgaaaccttgtctctaccaaaaatacaaaaattagccgggtgtacgtagtagcacatacctgtaatcccagctactcaggaggttgaggcagaagaatcacttgaacccgggaggtggaggttgcagtgagccaagattgtacaactgcactccagtctggtaacagaacgagactctgtctccaaaaaaaaaaaaaaaaaaaaaaagacagtcctgggttgctcattgctctatgattgattgtgaagcctagctcccagattttgaagtggtgactggaaaatgctttgtctaaaatgaacatgggacaaatgaccctcctgtgtgagagctccctaataaagaatctcagaggtcacccccatgagcagtacaggagttgaacatggactatcatcattctaaagggttaatgctcagttaactagagccccatcccagcagatccaatagaaaggttttcaatgcacccaaaacgatgcaaactgcacttccctggacattgctgcagtcagagtgtgagtcatgggctgactgtctccacgttaggctgagttggggggtttgagtgacagaaactaagaaggtcatagccagaggagccgtaagaggccatccagtccagctgccctttctcctccccattcctcctttcactgctttgctgacaccccagcgaagaggtggtccaaggcttttcactgccaggactatccaagggtcatatcaggcttgagtcaccagcaaagcagggtcaccaaaaatacttcctgagagaatgtaacatttgatatttcaaaacatcattcaaatagtccatcataggaaatatcagaatttggctggactgtctcaacacttattttataggttagggttcttattttattttgaattatatactacatctaagtaatacagccctgtgcttagggccaaaagacattttcccagggcacagaacttgcccaagcagatctttcctgttgggtttttacagtgctggtggggaagaggggtcagaaaaaccaaccacctgaatgtccatcctgcactttctgtacgtcatctctccccatcagacagctctgccaggaagtgcttatgccccttcaactaatgaagaaaactgaggtcagagaaggccaggccctccttcaaggtcacagttggtgagtgagagcagaggctactcctggagcctggcaacccacagtcctgcctcctgggccagctctaacactcttgctgtgactgtgggtctctgagtcttgattttctcatccgtacagtgaggggtttgaggaaatcatctctgagatgtttccaaatcaatgagctattttctgagtgtccctctgcgttttgcagagtgggggttcagagacagatgtcacatgacccacacccctaagggtgagggctctcgcactgagggagcactgcagcagagccaggttcttgaccttcattatgtcatgtgcaccttagtggttacgtgtgcagactcgggagtcaacccctgctcctaactccagctgtgtgacattgagcaagtcacattcacctctctgagccttttggccctgatctgtgacctcatgggattttctttatgtagagaatgcttaggtatgcttacaaagagcctggaaaatgaaagagctcaaagttttctagtgtttccagtggttcctgctgtcatcagccttttctccctgtgggaaggccttggccaagaagatttgaatcccatctgtgagtgcatccattgcccagacttgccaggatatctggccaaaggcctcacagcccaggcatgcacctggatcctgggcacctgcctatgtgcacaccccatctgtctttctggattcctggcccacgctccacattcccccatctctctacccctgtcttcctatcctagtctttgctgaactctgggcactttacccccagttcactcatctgccaagcccgtcccctttgtgtctccaaatctggccccagagggaagagccaggtaggtgttgagctgtgtcccattaaaccctctggcccttcccttcagctaggcctgctggagcctctccctcaagatggtgctcctttgggcactgtgcccccaggcacccaggactaactttttgggcccttgtggagcagatgttgggaggagacttgcccctggaatttgccaataatgagaaaaacatcattaacagccctcatgggttccagaactttacaaccaatggggcaacttttaactaccttattccatctggtcctcagaagagccaggggagatagacagccaagaggagaaaactgaggcccagagaggtgaaatgatgtaccaatactaacacagatgtatcatattagggctgcaattcagacccagggattcattcccaggcctgtgcgctatcgtattccatagagattaagggcacagcgtccagaattagaaagccctgggtttgaatatcagttataatacattttagctatgtcaccttaggtaagttagcctctctgagtctgagttttccttctgtaaaatggggaggaccttctggggcaagtcttatgtgctagaaaacagtgtctttttgtccatatgcaccacattgcgttacttaggatccattatataatttcaaataaaacaagaaccctactctgtaaaataagtgtaagagagtccagccaaattctggtatttcctgtgatggactaattgaaaggtgctttgaaatatcaaaggtcaaattatcttaagaagtatttttgatgcccctgatttgctggttacccatgcatgtgcctggccaagtcatcctctccacttggttgtttcatgcctcttttgctgtggatgctctgagaattgagatttctccaaagttctaacacttctgtgattaagccctttgcttagtcttcagctcgtctgccctctgcagaggatgctgtcaaggagagcctctgactctcacactttgcactggggattaatacatctgagtctgttgttttctctctacccttcaatacatcattgtccttttagcaacatcctccaatcccacagttcttaaggtttttacttctgccacacctctaaaacactagagatgatgcacaagcttttgcagctgctttatctaggtcccagccagcttgcagcaggtaaaagtcttagcaatcacattcctgtagcataggccgcaatctcttgtttaccatcagtgacagggccctcattgccattcagatagtgagcgatccacttacagaatctcatcctcagaatctgtcttcaagaactactcctggcaccaactttcttgggctcggcttcccagaagcagagccagagaaagggattcttgtgcaagtgatttattgagggagtattctcagatgagacctgtaagggagtgagggaggtgggatagtgcaggagaagttaggcaaatatgagtttcaactgaaattgtacctcattccacaggtgctctggagtgtgaaaggcactatagcattgttctaccttggagtggagggataccttttatatcccctcatcagttagtcatcactataggttatccctggggaaaaggtgtaaactacaagacatttttcctggcaggaaaaattagttgaaggcaactctctagagaataacatagctgtgagctgttagcagctaatattcatagcagatacatggattaccaacagtgacttctacatatggtatttacccttctgtgtctggtttttttttcagtattgtgtttataatattgttgagtttgttttataatgtatagtatacattataaaatggtgcgaatatacaatctatttagccattatattattaatgaacatttagctggatataaaactgtaaattaaagttatttttcttcagtactttaaaattattgcttctatgtgtttttgtatccagtgctcctattaggaaatctggtatcaatctgaatcttatttctttgtagatgatctgctttttctttctggaagtgttcagagtttttaaaaatttgtcagtaattgatccagaagagatgttcatagtgatgaacttcaaaaaaaaactttaaaaacagaaaagataaaattaagcaatgtagacttctgctttcatgaagatggagtagatgtacttttctctgttcctcctgctaagtacaacctaaaatcctgaatattatgtataaatcaaacaaaagaagactatgaaagggagaaagaagaaggcagaatggcttaggaccttgggacacaaagaacagcatggtactgggttccaggaattttccttttgcttcataaatctcagacttagagctgaagaagctagcaacctggaaatgtcaacaggttcaaacaaacaaaaaaaagccaatgaaagggtagtctgtttaaccccaaaaggccagaacaggggcaattagcgagacaggaaacttttagtaaacaacttttgtatacttgccaaataccacagagaaaactgtggctcaacttccacctccaccagcaaaagccaaatggggagcctaaacttccaccagttccaggctgatattaggtacttcaagctcccctacagccccttcaccattgtgtcagagaattatctgatgaagattttaaggcagtcattataaaaatgcctcaatgagcaataacaaaggcactggaaacaaattaaaaaatcgaatttttttttttgaggcagagtctcactctgtcacccagactggagtgcagtggtgcaatcttgactcatggcaacctctgcctttcgagtccaagtgattctcctgcctcagcctgccaagtagctgggactacaggcatgtgccatcacacccagctaatttttgttttagtaaagatggggtttcaccatgttggccaggctggccttgaactcctgacctcaagtgatctgcccacctcagcctcccaaagtcctggtattacaggcatgagccaccatgtccagccaaaaattagaaaatttcaacgaagaaatagaagatgtaaaaaagaaccaaatggaaattttagaactgaaaattattataaaataaaaaaatcaatggatgggctcaacagaagaataaacagaggaagaatcaataaagagaaagatagaataaaagaaatcaccagtctgaacagtgataaacagactgaaataataaagctttggagacctgtggaaggatagcaaaagatctagtgtcattgaagttacagaagaataggagaaataggtagaactgaaaaaaaaacctacataaatcatggctaaagacttcccgagttgggtaaagaacataaacctacagctttaagaaactaagtgaaccccaaatagagaaccccaaggaaatacaccctaacatacatcatagtcaaacttcagaaaactaaagacaaagaagaaatcttgaaagcgcatgagggaaatgacaccttagctgtagggaaaaaacaatttaaatgacagtaggtttatcatcagaaactatgggggccagaaagaagtggaacatttttgaagttctgaaagaaaagaactgtataaccaagagtcctttatccagcaagaacattctttggtaatatagaagaagttaagatattctcagaagagagaaaactaagagaatttgttacctgaagacctattctaaaagaatggctaaagaaaattctctaagcagaaaggaaatgataaaagaagggctcttgggacatcaggaaggaagaaagaaaaatgaaaatagtaaagatattggtagatagatttttcttttcctcttgagctttccaagttatgtttgacaatagaagcaaaaattataaacaccgctgatatggtcttaagtgtatatagaggaaagatttaggacgattatattataaaagaaggagtgtaaaggaaaggaaatttaggtaagattttgtgagacaaagtaacaaacataagaagccacgtttgcccatttctgcttgcctgcataatttcacaaagccctgactctatgacaagtgcagctctccagagagatgctttgaaaacaagacgggatagagcacatggcccctcatgtctcttgcctgagtgactacattccttaaaagacaaatgactgcagtagtctgttttcatgctgctatgaagaaatacccaagactgggtaatttataaaagaaaagatgtttaattgactcacagttccctgtggctgggaaggccttaggatacttacaatcatggcagaaggcaaaggggaagacaggcacattcctcacagggcagcaggaaggagaagtgccaaacaaagtgggaaaagccccttattaaaccatcagatctcgtgagcactcactcactatcacaataacagcatgggggtaactgcccccatgattcaataaccccccactgggtccctcccacaacatatggggaatatgggaactacaattcaagatgagatttcagtggggacagagccaaaccatatcaatgactttagtccttgccttttcctacacataagataacatctgacagggttagtgattatgcgtctataatctataaccagatgtactttggtaatctataaccagatgtactcttgcccccaaactttgatgtgattttacatgtactgaatcccctactttctgtaggggatcagaagcacactcttctgtagtgtagattagagcacactctgagctaaaacactttcagaccagcctaacagaatctctctgaacaactcctctcaggctgtagtcctcattctacagtcctcagtaagagttctgaataaaactaactttaaaggcttgattttttttctttagtcaacagtttctctacttcactcaaagtgataaaatgtcaacagcaataaattgtgataagttatatatatatatatatataatgtaatacttggagctaccattaaaaatgctacatgcagagataacactcaaaaacattatagataaatcaaaatggaatgcttagaaaatgttcaggtaactcacagggagacaggataaagaacacaaagaattgaaaaaaagaataaacagaaagcaaaacataaaatggcagacttaaggcctaccatatcaacaattacattaaatgtgaatagtctaaatagaccaattaaaagacacagattggcagagtggatttttttaaatgacctaactatatgctgcctacaagaaacccacttcaactatgataataatgttggttgaaagtgaaaggatagagaaagatgtataatacaaacattaactagaagaaaacaggaggccaggcatggtggctcacacctgtaatcctagtggtttgggaggccaaagtgggaggatctctggaggtcaggagttcgagaccagcctgggtaacatagtgagaccttgtctccacacacacacacacacacacacacacaaagccaggtatggtagtgtacacctgtagtcctagctacaggggaggctgagatgggaggatcttgagcccaggagtttgaggctgcagggagccatgattgcatcactgcactccagcctaagcaacagaatgagaccccatctccttaaaaaagaaggaaagaaaaaaaagagtggctataccaacatagataaagtagacttcagagcaaagaaataatcagagacagagagggaaattacatagtgataaaagggccaatctactaagaacacaaagcaatcctaaatgtgtatgcacaaaacaacagaactgcaaaaactgataaaactgaaaggaaaggacagatccataattatagttacgtacttcaacactcttctctcagcaattgataggacaactagacagaaaatgagtacaaatatagaactccacatcaccgaaagggtcaactgtgacatttacagaatgctccactcaacaagaaaagagtacacatttttttcaggccaggtgtggtgtttcacgcctgtaatcccagcactttgggaggccgaggcgggcagattgcctgaggtcaggagtttgagaccagccagatcaatatggtgaaaccgatctctactaaaataaaaaaattagccaggcatggtggcatgcacctgtagtcccagctactcaggaagctgagacgggagaatcacttgaacctcggaggtggaggttgcagtgagctgagatcgtgccactgcactccagcctgggcaacagagtgagactccatctcaaaaaaaaaaaaaaatacacattttttaagtgcccacagaacgtatatgaagataagccataccatgagccatagaacaaatctcaacaaatataaaagaattgcagtcatacagaatatgttctctgaccacgacggaattaaactaaaaatcaataacagaaacgtaacaagagagccttcaaacactgaaaattaaacaacatattcctaaataattcatgggtcaaagagaaaatcccaagggaaatcttaaaaaaaaaaataatttaaacctggtttcaatacactgtaccaagggtaatttaaaaatacattgaactggctgggtgcagtggctcatgcctgtaatcccagcactttgggaggccaagggggtgaatcacttgatcccaggagctcaagaccagcctgggcaacatggcaaaaccccatctctacaaaaaatacaaaaattagccagactgaggtggtaagattacttaagcctgggaggtggaggttgcaatgagttgagatcgcaccactgtattccagcctgggcttgaaagatattttcactgggctagaattctggcagttattattttttcagcattttataattatttctggaagaaataattccaaaggctctggcttccattgtcactattgagcagtctttttttatctggctacttctaagttttctcttagttttgtttgtttgttttctactacgtcattattatgtacctaggtaatatatttctttttatttatcttgcttgggttttcttttttgagctccttaaatctgttgtttggtgtctttatacttatgaacattcttagccatttgctcttcaaataatatctctacccatttgtgatggttaatattaggcgttaacctgattggattgaaggatgcctaaatagctggtaagtattgttcctgggtgtgtctgtgagggtgttgccagaggagattgacatttgagtcagtggactgggagaggaagacccaccctcaatgtgggtgggcaccatccaatgggctgccaactggctagaacaaagcaggcagaaggtgggtgggataagctggtttcctgagtcttccggctttcatctttctcctatgctggatgtttcctcctgttccttcttcccttggacatcagatgccaagttcttcagcctttggattcttggacttacaccaatggtttggtgggggttctcaggcctttggccacagactgaaggctgcactgtcggcttccctgtttttgaggcttttggactcaggctgagccactgctggcttctttctccctcagcttgcagatggcctatcatgggacttcaccttgtgatcatgtgagtcaatactccttaataaactccccttcatatgtacatatatcctattagttctgtccctctggagaaccctaatacaccacttatttctctctttctgggaataggattaacatatatcagacctttttacttgagtcttaggttcatactctctcttttgtgctttttatagtttttgtctttctaagcttcattttgacctgtcttccagttcactaactcttttttcaattgtatcaaacttactattaaagttgttcattgagttttgagtctcagctgttttattagttatttctaaaagttctatttcattcttttttcaaaagttttaggtcactttttatattttcttgttttattcaaatatttttaatcatcttttatctatttaaacataataagaatagttttgtatgtgactgtttattccaatactcatttatgtttttctgcctagtctcactctggtgcttttatttatttccttgtgggcctggtggatcctttgagcccagtagtttgagaccagcctggacaacatggtgaagccctgtctctacaaaaaaataaataaataagctgggcatggtgacatgcacctgtagtcccaggtgttcctcaagaagctggagtggcaggatctcttgaacccaggaaggtggaggttgcagtgagtcaagatcacagcactgcactccagcctgggcaagagagggacaccctgaaaaaaaaatgaaaggtagaaagaaagaaaaagagagaaagaaagaaggaaggaaggaaggaaggaaggaaggaaggaaagaagaaagaaagaaagaaagaaagaaagaaagaaagaaagaaagaaagaaagaaagaaagaaagaagaaagagagaaagaaagaagaaagaaagaaagaaagaaagaaagaaagaaagaaagaaagaaagaaagaaagaaagaaaaggaaagaaggaaagaagaaagaaagaagaaaaataatttaaatctagggatgaatcaaatttcttctagcagaaaaataatttaaatctagggatgaatcaaatttcttctaggaggatttatgtttgtttttatcaggcacttgaggacactccaggaccaccttaagcaaaggtaagttatgaggttccttagactacccaggagatatgatcctgggatccagatcttcagaaggtctatcataattctggctcactgattaaaggatgtagcccattgaagttcaaggttattgtggtgaagtaactcttcattaaattctccaccttaagcatctttggtcttttatttctgtcccctcccacttccccatcccatgaggcaaacaagtaaaaatctgaattttcaaggttagaaatgtttgttactttgtctcacaaaattccctcagagaaaattccgcttcttttctttgcctgtctgtattccttccaattttggcctcgttgttccatagtatcttatcaactctataatgtaacttttacatttaaatatgcaatctagaatttttcattcttttcactgggaagtttaatctgaataacctaatccaccagaacccaccactgaacaatttcaaaagaataaaaaactcaaggatcaaactgagttagtttactttttacaggcttaagtgaagtacatttaaaaggcagggagggggccgggttgggtggctcactcctgtaattccagcactttggaaggccaaggcaggcggatcacccaaggtcaggagttcgagaccagcctggccaacacagtaaaaccctgtctctactaaaaatacaaaattagctgggcatggtggtgtgtgcctgtaatcccagctactcaggaggctgaggcaggagaatcacttgaacccaagagacagaggttgcagtgagctgagattgtaccattgcatgatctcagcttggagaatgaaaatccgtctcaaataaaaaaaaaagaaaaaagaaaagaaaagaaaaaaaagaggcagggagtacagctagaagtagataagaaagtatatagctgtcatgcaaacctacaactatatgattgctaatgcccaaattagaaattcatcacatgcattgtaaaaactgcagcttaatcaaatactgcaaatacccaaatacagtctgttttatggtcagtgttgctctgattcgcaaagagtgagactgtggcaactggatgaggatatatgggaagagccagaggagctgaggatgcttgactctccagcctcctctgaaacacatcctaccctatccttcacactttcacacttgataaaggtggcagagcctttaattatgaagccagcccaatgtttaatgttgaaatcccagagtttgcagtggaagtggcaatatgcaatgacagattaggaaagacagggatctgctcccccattatcttgttcccctacccacattagtctattctgcaacagggcctgaggctcagtcattaaggaaaggataacaggtatggaaggagcaagggtttagttaagggggttgacactaagtaaaagtaatcttgggggttctccactgtagaccaagaacagctctgaaaaatcagcattattcctgatagtccaactgtcccctctaccaaattatacttctagatatgggcaatgcaaattatatgttagcctttttagattatggttttaaggacttgaaggttcaaaatatgaccttttcagctcggaagccaagatggccaaataggaacagctccagtctacagctcccagcatgagtgacacagaagatgaatgatttctgcatttccaactgaggtactgggttcatctcactggggattgttggacagtgggtgcaggacagtgggtgcagtgcaccgagcgtgagccaaagcagggcgaggcatcgcctcacccaggaagcacaaggggtcagggaattccctttcctagccaaggaaaggggtgacagatggcacctggaaaatcaggtcactcccaccctaatactgcgcttttccaacagtcttcacaaacggcacaccaagagattatatcccgggcctggctcagagggtcctacacccacggagccttgctcattgctagcacagcagtctgagatcaaactgcaaggcggcagtgaggctgggggagggttgcccgccattgccgaggcttgagtaggtaaacaaagcagctgggaagcttgaactgggtggagcccaccacagctcatggaggcctgcctgcctctgtagactccacctctgggggcagggcatagccaaacaaaaggcagcagaaacctctgcagacttcaatgtccctgtctgacagctttgaagagagtagtggttctcccagcacgcagcttgagatctgagaacggacagactgcctcctcaagtgggtccctgacccccgagtagcctaactgggaggcacccggcagactgacacctcatacggccgggtactcctctgagacaaaacttccagaggaacaatcaggcagcaacatttgctgttcaccaatatacgctgttctgcagcctctgctgctgatacccaggcaaacagggtctggagtggacctccagcaaactccaacagacctgcagctgagggtcttgactgttagaaggaaaactaacaaacagaaaggacatccacaccaaaaccccatctgtacgtcaccatcatcaaagaccaaaggtagataaaaccacaaaaatggggaaaaaacagcagaaaaactgaaaattctaaaaatcagagcacctctcctcctccaaaggaatgcagctcctcaccagcaacggaacaaagctggatggagaatgactttgacgagtggagagaagaaggcttcaggcgatcaaactactccgagctaaaggaggaagttggaacccatggcaaagaagttaaaaaccttgaaaaaagattagatcaatggcaactagaataaccaatgcagagaagtccttaaaggacctgatggagctgaaaaccatggcacaagaactacgtgacgaatgcacaagcttcagtagccgattcgatcaactggaagaaatggtatcagcggtggaagatcaaatgaatgaaatgaagtgagaagagaagtttagagaaaaaagagtaaaaagaaatgaacatagcctcccagaaatatgggactatgtgaaaagaccaaatctacgtctgattggtgtacctgaaagtcacggggagaatggaaccaagctagaaaacactcttcaggatattatccaagaggtcttccccaatctagaaaggcaggccaacattcaaactcaggaaatacagacaatgccataaagatactcctcgagaagagcaacccccagacacataattgtcagattcaccaaggttgaaattaaggaaaaaatgttaagggcagccagagagaaaggttgggttacccacaaagggaagcccatcagactaatagtggctctcttggcagaaaccctacaagccagaagagagtgggggccaatattcaacattcttaaagaatgttaaaatttaaaaaattaaagaatgttaaaaattcttagagaaaagcattttcaacccagaatttcatatccagccaaactaagcttcataagtgaaggagaaataaaatactttacagacaagcaaatgctggagattttgtcaccaccaggcctgccctaaaagagctcctgaaggaagcactaaacatggaaaggaacaaccagtaccagccactgcaaaaacatgccaaattgtaaagacgattgatgctaggaagaaactgcatcaactaacgagcaaaataatcagctaacatcataatgacaggatcaaattcacacataacaatattaaccttaaatgtcaatgggctaaatgctccaattaaaagacacagactggcaaattcgataaagagtcaagacccatcagtgtgctgtatttaggaaacccatctcacgtgcacagacacacacagactgaaaataaagggatggaggaagatctaccaagcaaatggaaaacaaaaaaaggcaggggttccaatcctagtctctgataaaacagactttaaaccaacaacgatcaaagagacaaagaaggccattacataacggtaaagggatcaattcaacaagaagaactaactatcgtaaatatatatgcactcaatacaggagcatccagattcataaagcaagtccttagagacctacaaagagacttagactcccacacaataataataagagactttaacaccccactgtcaacattagacagatcaatgagacagaaagtcaacaagatatccaggaattgaactcagctctgcaccaagcggacctaatagacatctacagaactctccaccccaagtcaacagaatatacattcttttcagcaccacaccacacttattccaaaattgaccacatagttggaagtaaagcactcctcagcaaatgtaaaagaacagaaattataacaaactgtctctcagaccacagtgcaatcaaactagaactcaggattaagaaactcactcaaacccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcgcaattaaaagaactagagaagcaagagcaaacacattcaaaagctagcagaaggcaagaaataactaagatcagagcagaactgaaggaaatagagacacaaaaaacccttcaaaaaaatcaatgaatccaggagctggttttttgaaaggatcaacaaaattgctagaccgctagcaagactaataagaagaaaagagagaagaatcaaatcgatgcaataaaaatgataaaggggatatcaccaccaatcccacagaaatacaaactaccatcagagaatactataaacacctctacgcaaataaactagaaaatctagaagaaatggataaattcctcgatacatacaccctcccaaaactaagccaggaagaagttgaatctctgaatagaccaataacaggctctgaaattgaggcaataattaatagcttaccaaccaaaaaaagtccaggaccagatggattcacagccgaattctaccagaggtacaaggaggagctggtaccattccttctgaaactattccaatcaatagaaaaagagggaatcctccctaattcattttatgaggccagcatcatcctgataccaaaggcgggcagagactcaacaaaaaaagagaattctagaccaatatccctgatgaacatcgatgcaaaaatcctcaataaaatactggcaaaccgaatccagcagcacatcaaaaagcttatccaccacgatcaagtgggcttcatccctgggatgcaagtctggttcaacatatgcaaatcaataaacgtaatccagcatataaacagaaccaaagacaaaaaccacatcattatctcaatagatgcagaaaaggcctttgacaaaattcaacagcccttcatgctaaaaactctcaataaattaggtattgatggacgtatctcacaataataagagctatctatgacaaacccacagccaatatcatactgagtgggcaaaaactggaagcattccctttgaaaactggcacaagacagggatgccctctctcaccactcctattcaacagtgttggaagttctggccagggcaattaggcaggagaaggaaataaagggtattcaattaggaaaagaggaagtcaaattgtccctgtttgcagatgacatgattggatatctagaaaaccccatcatctcagcccaaaatctccttaagctgataagcaacttcagcaaagtctcggcatacaaaatcaatgtacaaaaactacaagcattcttatacaccaacaacagacaaacagagagccaaatcatgagtgaactcccattcacaattgcttcaaagagaataaaatatctaggaatccaacttacaagggacgtgaaggacctctttaaggagaactacaaaccaccgctcaatgaaataaaagaggatacaaacaaatggaagaacattccatgctcatgagaaggaagaatcaatatcgtgaaaatggccatactgcccaaggtaatttacagattcagtgccatccccatcaagctaacaatgactttcttcacagaattggaaaaaactactttaaacttcatatggaaccaaaaaagagcccacatcgccaagtcaatcctaagccaaaagaacaaagctggaggcatcacgctacctgactttaaactatactacaaggctacagtaaccaaaacagcatggtactggtaccaaaacagagatatagaccaatggaacagaacagagccctcagaaataatgccacatatctacaactatctgatctttgacaaacctgataaaaacaagaaatggggaaaggattccctatttaataaatggtgccgggaaaactggctagccatatgtagaaagctgaaactggatcccttccttacaccttatacaaaaattaattcaagatggattaaagacttacatattagacctaaaaccataaaaaccctagaagaaaacctaggcattaccattcaggacataggcatgggcaaggacttcatgtctaaaacaccaaaagcaatggcaacaaaagtcaaaattgacaaatgggatctaattaaactaaagagcttctgcacagcaaaataaactaccatcagagtgaacaggcaacctacagaatgggagaacatttttgcaatctactcatctgacaaatggctaataaccagaatctacaatgaactcaaacaaatttacaagaaaaaaacaaacaaccccatcaaaaagtgggcaaaggatatgaacagacacttctcaaaagaagacctttatgcagccaaaagacacatgaaaaaatgctcatcatcactggccgtcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggtgattcctcagggatctagaactagacataccatttgacccagccatcccattaccgggtatatacccaaaggattataaatcatgctgctacaaagacacatgcacatgtatgtttattgcggcactattcacaatagcgaagacttcgaaccaacccaaatgtccaaaaatgatagactggattaagaaaatgtggcacatatacaccatggaatactatgcagccataaaaaatgatgagttcatgtcctttgtagggacatggatgaagctggaaaccatcattctaagcaaactatcacaaggacaaaaaaccaaacaccccatgttctcactcataggtgggaattgaacaatgagaacacatggacccaggaaggggaacatcacacaccagggcctgttgtggggtggggggagggggaagggatagcattaggagatatacctagtgttaaatgatgagttaatgggtgcagtacaccaacatggcacatgtatacatatgtaacaaacctgcacgttgtgcatatgtaccctaaaacttaaaaaataataaaaaagaccttttctagactggtaactacttgaaaaccctaatggctagtacaatcatcatattatctcagctcagtgaagtcttgactcctaggtttggtagcccaagaccaaggtggctggttcattttcagctaatccagtgacatttcaaatcagacaggctgtgtggttttggaatcaagtatattcagtgactagttgtcaagttaactgttgagggtcattaagggggcccaattaccatacctcttttccccacttcagttctgaatgaattgtgggtctgaacaaaagcagagggcatgtaatatcactaggttgaaggacatggcatatatccaagagcatgggacttcttaaaacgaaactccaaaattagagagattcctgcccagccctaggcatggtagaaccaccccaaatatccctgcatgagaaaaagcctctataaaatgcccaaatggaggagcagaggagcatgtaaggaaggaggcgagagagaagagagaagttatgctaagcatattcagattagtcttcccaagcagactttaagtcatcctaaatgtcccaggatacagtggccaataggacaagaaaaggtcaaaagcattccatgaactgaattccctccacatggaagaaacgtcaggaagaatcatttcctcagtgctggccatttctttttgagctattcagtacttgtatacaggggatgcagtaacttgttggttgactaatgagttttttattttagctgttctcagtgctattgaggaatcaactgaattatttcaggtacttgttgctacgataggagagacaatatcactatctgggtaaaagaagggttttacatttcaaaacatctcttcttgggagcattgctgacatatggacagatttaattgtacatagataaggcatacataacaaatgttccattttgttcctcaacccattctttctgttttgggagaaaaagctaaccttgcaattggctgtgtttcgtattgggaaactgacatgtgtaactgcctaatggccaagtattttgggggggtttcaatgagtacttcttggtcatagtaaagaatatggcaaaggaagtttggcaatcttatcaagcaagacagagagacaattctgaagtctgagacagtctgtcattaaacctaagattacagttttgcccaagtttactcctagtcattgtaatattccgggaggactactgttttatagggcaagagatctgtgtttgagtcttggctctggcattgacttgctatgtgacattgggaaagtgttatgagcctcagttttcataactgtaaaatgggaaatgtaaaaccagatgatctgttttttccagccttgatattctgggactcctcattctaaccaaaaggttttcagatgtctcccagtgacgatgggagtgaaagccattcttctccctgtgaaacactatgatatggccaacacttcaccctgtcattctcatgaggcataagctcccttgtacaggatcttattgtgcatggaccatataaaattacaaccaagaacacatatgtaattgaaaaggaaaatttggctgggctcggtggctcacacctgtaatcccagcactgtgggaggctgaggcgggtggatcacctgaggtcaggagttcgagaccagcctggccaacatggtgaaaccctgtgtctactaaaaatacaaaaattagccaggcgtggtggtgcatgcctataatcccagctactagggaggctgaggcaggagaattgcttgaatctgggaggcggaagttgcagtgattcgagattgcaccactgcactccagcctgggcaacagaacgagactccatctcaaaaaaaaaggaaaggaaaatttttaaccaagtataattggctttccacattttctttctttctttctttctttctttctttctttctttctttctttctttctttctttctttctttctttctctctctctctctctctctctctctctctctctctctttctttctttctttctttatttctctctttcttttctttctttcgacagggtcgcactctgtcccccaggttggagtgcagtggcatgatctcggctcgctgcaacctctgcctccagggctcaagcaattctcctacctcagcctcctgagtagctgggactacaggcatgtgctgccatgcctggctaatttttgtattttttatagagatggggtttcaccatgtgcccaggctcctctcaaactcctcagctcaggtggtctacccatctcagcctcttccacattttccaattaatatatatttggtatttatttattcctcatctccaccactaacatgttatatagcatatcctaacagatgtaattctggctaagagagtgttctggaaggaaatgaagagactggttatttggtctgtcctaccatgggcatcaaactattaagagtgacagtcagatgtttccacttaatgcagaaatctgtttatgataccggggttaattccttaacgggtatattaaaaagctaatttgaagtttagcttgggaataattgaacccatactctgaaccgagaattatatgtagtttattatactattgacataaacataaaaccataccacaaaacctaaaggaaatactaattgcaatttacagccaggtgcctggaatcctagcactttgggaggccaaggtggaaggatggcttgaggccatgagttcaagaccagcctgggcaacatagtgagaccccatgtctacaaaaataaaaatcaaaaaattagccagtcatggtggtgcatgcctgtggttccagctatgtgggaggctgagaagggaaggtcagttgagcccaggagtttgaggttacaatgagctataatcacacccctgtactcaagcctgtgtgatagagtgagaccctgtctctaataataataataataatgaaaattgcaatttcctctgactaaaaactaccaagaatccgtggctctaagaaagtctttgatcttagacttgcctgtattcctcatctctcacagagtctggttctacagatgtcatgggcttgttgcttgtgggtctgcaggatgtcatttcctcatatgaatacccttattaatggggtttgtgaaaaattatccacttattcagtgtccggctaagtgctgaggctttcttgcagatttacttccctacaatatgcaccacaaagtgccagcttcctgctgtgtgctctcctgacaatggtgttcctttctgcctgattgggacacactgcagctctgtccatccttgctctgatccttgtgtgatttctaaggagaagtgagatttaaactcctttagcagtgtagcaggacaagccgcagacaaaactccttagacactggattaaagaaggaagaggtttattcggcagggagcatcagcagacttgcatcttaagagccgagctccttgaaaaagaaattgttggccttttcaaaggcttacaactctaaggggtccacgtgaaaaggttgtgataaatcgagcaagcctggggaatgtgactggggctacacgcatcagctaacaaaacagacagttttgcaatgctttttcatacaatgtctggaatttaaagataacacaagtagtttaggtcaggggttgatgttattattattacttttttaactcctagggccaggttgtggtgccaaggttgtctggctacttatcttacttctgtttctttccaactttttgctttctctctttcctcctgtcttgtgaactaggcaaggtggaggggaggagggcagcaggagtagtagtggtctccttccttagcaggaagcatcccattttttttttttgagatggagttttgctcatgttgcccaggctggagtgcagtggcacaatctcagttcactgcaacctccatctcccaggttcaagcgattctcctgtctcagcctcctacgtagctgggattacaggtgcccgccatcacacccagctaatttttgtatttttactagagacggggtttcaccatgttggccaggctagtctcaaactcctgacctcaagtgatctgcccatctcggcctccaaaagtgctgagattacaagcatgagccaccacacctggtcataagcatcccatcttgatggtcatccaaactaaagatgaatccttccaactgggcaggaacatggacagtgttaccactccctggttggagcagctagtggttttcttacccagtctttccaagctccccaaccctccactgcctgtgttgctgataaatgagtacttgctaacaaataagtgatactcaatgccaaaaatataagaacttacaggagaaaattttaacattgaattaaatgctaacttctgagctccttcaaccccttttgcttctctttgtcctatcaccagatgcttttttctctctgggtctgactcctacactcaactatagatgcctccagggaaacaatttttgtctggttcatttctgtctctagcacccaatatgaatttttatgaatgactgaatgataaagttttattcattacattaatgacggatgaaaattgtgaagtcggccaggcgtgatggctcacgcatttaatcccagcactttgggaggccaaggtgggcagatcacctgaggtcaggagttcaagaccagcctggccaacgtggtgaaaccccatctcaattaaaaatacaaaaattggggtggggggaggggggagggatagctttaggagatatacctaatgctaaatgacaagttaatgggtgcagcacaccagcatggcacatgtatacatatgtaactaacctgcgcattgtgcacatgtaccctaatacttaaagtataataataataaaataaaaataaataaaaatacaaaaattaactgggtgtagtggcaggtgcctgtaatcccagctacttgggaggctgaggcaggagaatcacttgaacccaagaggcagagtttgcagtgagctgagattgtgccactacactctagcctgggcgacagagtgagactctgtctcaaaaaaaaaaaaaaaaaaggaaagaaagaaaaaaagaaaagaaaatagtgaagtctgcaattattctataattattctatagtactattgggaaaacttcctgatccagtatttgagaaccagattgtagctgtctgctcaaataaacgaaaccaaattagattgctataattcatttaaaaatatttattgagttgttcttctgagctaggtgctgtcattggtatcctgggagctgaattagttggatctagggatctagggcccccagaacaccctagctcctggggacatgcgatcttggtgatggctgctttgacatccctgttcctcagcatgcaggtgagagtggagaacaggtgtgagaatggcatggcatatacagggagggaaggatgtattaaagaagaaagaagaagaaggagaaggagaagaagaggaagaggaaggagaaggagaagaagaagaagaggaagacgaagaggaagaggaagaagaggaagaggaagaagaagaagaagaggaagaagaagacatgtacaacattgcccatgacgtggaagtcgaggggcaggtcagcgctgtaggccacataggctatggcaatggatgagtagtaggtgcccactaccgggagatgggagctgcaggtggagaaggctttggagcgtccttcttgggagttaatgcgaagcaccgaggtcaagatgtgggcataggagagaagcaccaggagaagggggaggaaggacaccaccatggcgatgcagaaacccatgaaggtctgggggtggtatcagagcaggaggcctggaccacagccagatgatcacagaagcagtggtagatgtcagcaatgctgtcaaatgccatctgggaggtctgtactactgctggaatgggcaggaggagggcagtgagccaggcaccggttgccaagacagcattggtctgtgggttcatgagaacagggtattgcagtgggtggcagatagctacatagcggtcataggccatgaccaccaggatgaaggcttctgagcaggagaagctgtggaacaggtacatctgtaggaagcaggcagggaagctgaggaagtggtccccaagcaagaacaggggcagcgtcttggggacagtgactgtagtggagaggatgtctagggctgagaggtttatcaggaagaagtacacaggcttgtgaaggctggcctctgccatcacaaccaccaggatctggtcattacccaccaggataagcggatagattaagaagaaaatcaaggccaggcatggtggctcacacctgtaatcccagaactttgggacgccaaggcaggcagatcttttgaggccaggagttcaataccagcctggccaacattgtaaaatcccatctgtactaaaaatataaaaattagccaggcggtaggtgcctgtaatcccagctactccagaggctgaggtgggaggattgcttgaacctgggaggtggagtttgcagtgagcagagattgcgccattgcactccagcctgggcaacaagagcgaagctccatcaaaaaagaaaaaagaaagaaagatagaaacaaagagagagagaaagaaagagagaaaggaaaggaaaggagaaagaaggaaggaagggagaaaggaagggagaaagaaaagaaaagaaaagaaaagaaaagaaaggaaaagaaaagaaaaaaggaaagaagaaagaaaaccacaaagacgggagttgggggaagagggactctggcagagaggggatgctgaccaggcagaagacaggcaaggagtcctctgatccattacaggctgtggcctccacagtgggtcagagttggatgtctgtagacacacactgggaacatctggaaaccagagcaatcaaggaaacattcactagaacatgtatatttttcctttccaaccatggatctcagtcccaacactttctttgtgccaggaattgtattgcacaattaagattcccagagtggtgagatgtctaacaacaatggcagaaagagctggtcctgttctggggggaagagaggtggatacaaacacctaagaactgtcaaagagaaggagcaacacttacaaagaagtggggccactgttagcagcttcaggggcccagagatcaatcccacatatggaagcagtttcttaccattagaatgaccccataatgaaggccgggcgcggtggctcatgcctgtaatctcagcactttgggaggccaaggtgggcagatatctgaggtcaggagtttaaaactagcctggacaacgtggtaaaaccttgtctctactaaaaatacaaaaattagccaggcgtggtggcacatacctgtagtcccagctattcaggaggctgaggcaggaaaataacttgaactctggaggcggaggttgcagtgagctgagattgcaccactgcactccagcctgggcaacagagtgagaccctgtctcaaaagaaaaaaagaaaaagaaaaagaaagaacaactccataatgcaaaaacaggcttgataattagtgaagtccatgtaactagaggttgcaaggctgaggtctttttctggaatgctacagagatgtagtacttggatagcagctagattaaaaacctttaagtgaccttctaaccctagattcattgcttctaaaaataataataataacataaatgaatcacatgaacaagattgtagccaggtacagtggctcacacctgtaatcccaacacttttagaggctaaggccagaggatcgcttgaggccagaagtttgagaccagccaggcaacatagaaagaccccttttctataaaaagtcaaaaaagttagtcaggcattgtgacatgcacctgtaatcgtaactaccccagatgtgaaggtaagcctaggagtttgaggctgcagtgagccatgatcacaccactgcactctaagctgggcagcagagcaagatcttatcttacaaaaattaaaaaataagattgcggtgttggtgggcaaatttaacctattggagagaaaaaaatctgagaggcatctgcttgtgttcaaatgccaattaaaaaatcaagtagctcttttattagttcaagtagctcctttaaggatgtctggtttttagcccagttcccactagcacaggtgaagtaatcttctaggtatggtaatgttgatgaatacacttaccaggttttgcccactctaagcaccaggatcttgactgtagtcatttgacataagtccatccagtccagctatgcctgcacgattcctgaatggcgttctttatcttgggaccttgtgaagacagcagaatcactggttggcagtgagtaaagctaaactctagagtgaaaactatgtcgttcattctaaggttcccttgatggtgtgttcctctcagcctggaggattgtcaggggccaccgataaagactcctagctcatgagctctagggaactgctgggaaaacttctttggggatagccggaacaatggcttctgtcatgctctggattccattcctcttctacgccccgctctattctcatctcactctatctgggtcggaatgttatgtctgaatcagtgccctttgtttcagtctctccatttccattcacatgagaattccttttctgtgatatctttctcttcagctgcttccttcaagaagcacttcaaaatgctgtctgcttaccccagaaatagcttcctcttctgtgtgcctgtacaggggcttgctctgtctgtttctttctagcctgggtgccctgggacctgtctttgtatcctttctctttgtcatatcatacagtgaccaaccatattgatttgcccagaactgtcctggtttcagcactgaaagtcccatgtcctgtgaaactcctctgttggtcactctcagagggcagagacattgtatgtgcctttgatagaaggagttatttcctgaatggaacccaagttgaaaatgaattcactccctattaagataaagcagacctgggctgggtgcggtggctcatgcctgtaatcccaacattttgggaggctgaggcagatggatcacctgaggtcaagagttcaagaccagcctggccaacatagcgagaccctgtttctataaaaaataaaaataacttaaaaatacatttttttaaagctgataggggagctgatcttggtcaaggctacacagagagctattggcagagccacaccagaaaccagatgcctgctccctgttcagggctcccaggtgtcctctgtgggagggtccctgaagcttgcctgtctggcagcccagacaatactgggagctatccatgttcacatctgcttccctcaccagactaggcgttccctggggcctgggatgtgttctgacccctcttctacaaaatcaacatgtcagtggggtctgggcacctggtttcccagttttccacaggcagactggaccatgactgtcctaacaacctcagagctttctgtccagtgctgctgcagaatcagacaacactaggctctatagagagctcctagtccagctcctgtattgctgctgatacgcagggggaggcccagtgggagttctgacccagccacagtcacacagatggcaaaccagcagcatagcctgcctgccaggaatgctctaaatcagagcacaaagagtttggcccagatcccttctcttagagcccctctcctagcgggatgagggtccctaactgcccacctccccagacgctgccctcccagagcctagcccctccttggctatggctggctttgggcacttcactttcagccttcatgcccgagacctctgcaggtcaacccagctcatctgcccaacccaggccatgccagctgctccttcctctcccgaagtcagtgctgcctcagtgggaagaaccaggttggagctgagcctatttccattaaactcccaagctctaccccttcctggcctgctggggccttgacccccagaggttcccttttactggggccctgaataatattttctggggacccccaggtggctggttagcagctaccatgggctttgctgataattagaacaacaagattaatagtgcttagtgggacacagaactttatggtctatggggactttcctatgtgtggagcaaccattggtatccacatgtggcagatgaggaaacaggctcagaggtgaaagggattgcccaaagtcacacagcaatccaaacacaagtcaggataggaagtctcagatttcctaaccctcactccagcctctgcaccaatgacacaaatgaaaaagttagtgaaaattttccgtgtaaatgtaaaaggctgtgctattggttggtgggacccctcaagtgtattgaagctggaggaacaagcatgacagaacagagagccactcagtcttccaaatcctcactctcttgctcactcttgatcgttcttagcggctgatatggtttggctctgtgtccccacccaaatctcatcttgaattgtactcccataattcccacgttttgtgggagggacccagtgggagataactgaatcatggaggtggtttcccctctactgttctcttggtagtgaacaagtctcatgagatctgattattttatcaggggtttccacttttgaatcttcctcattctctctttgcctgccaccatccatgtaagacgagacttgctcttccttgccttctgccatgattgtgtgacttccccagccaagtggaactgtacgtccaataaacctcttccttttataaattgcccagtctcaggtatgtctttatcagcatcatgaaaaaggactaatacagtaaattggtaccgatagagtgcggcattgctgaaaagatacccaaaactgtggaagcgactttggaactgggtaacaggcacaggttggaacagtttggagggctcagaagattgcccagtcttgagtatgtctgtatcagcagtgtgaaaacagactaatacagaggccttataattctaagcccgacctcctccagggagccttctgtgacttcatcttcctccaggctccagtgctctttctctcctctggattgaccaggcctggctgccaatgctgccattttaaagattaagataactgaggttcgtttttcattccacattgaataaggctggctttgcactgggtgcatggtcacagggaattgacacagtctagtggggtagccagccaaaaccctgtccatcatatccactgtgatctgtgctaccatagagctgaagggcccagaggaggaaacaaagcgacttgcatcatggaagacatctcttaaatgggtcataaatttcaagcagatgaatagagtgcaggccacaaaggagggggtaaacaaagtcatgaagtgtagaaaaagcaggaggtgtgttagaggggagatagaagttggtttgggctgcaatatagaaggagagactgcgagtctccaaagatgaggctaaagaggttggcaggggccagagggaggagagtcttgaagccaagaacaaccctcagcatgaggacattggaaagccagaaccagggctcagacagagggctaagatagtcagctacatgtttgagaaagctcatacccactgtggcacggggaatgtcttcgagtaggagagagagaccagaggcagggcaaccagccaggaagcttggtggtgaggagaggaatagagaggagtattaatgacaatgatagcagatgatggctgccctttattgagagcttacttgtactaatggctgtgccctggtagtcacatacttcatttcatttaatccaaggagcaatttccattacccttgttttatggatgagggagctcagagggttaagtaactaagcctgctttggtcattctgctggataaatagtgagttagtgtagagtccaatccatctccaaagccatgcctcttaactatcaaagcttagagaatctggctgggcgtggtgcctcacgtctgtaatcccactttgggaggctgaggcgggtggatcacttgaggtcaggagttcgagatcagcctggccaacatggtgaaaccccaactctactaaaaacataaaaattagccaggggtggtggcacatgcctataatcccagctacttgggaggctgaggcaggagaatctcttgaacctgggaggcagaggttgcagtaagccaagatcaagccactgcattccagcccaggcaacagagtaaggaaaaaaaaaatttggagaatcttcaagaggtagaatagtcagaatttgacaactgattatggaaaggtccaagatgatgcccagtattctggtttgggtgacgagacagatggtggtgatgttgactgatgtctggagctcaggagagagagtggatgcaggcaaagacttgggaggcatatacttatgatagtgaacaagatcacctagggagagagtgtagtgtgagaaggacagaaccatggggggaaacaacatgagactgaggcagaacaagaaatttctgtaaaagatactgagaaacaacagccagagagcgtgaagcaaaaccaggagagtgttatatcacagaagctccctagggcagctgtggtcagcagcatcaaatgttgctgatgtgcccaagaggacaagaatcggatgaaaagtgtctgtggggtccagtgatgaggggatcactggtgccccaggtgtgaacaggccagtggaacagtgagcgtggaaggttgggagtgagtaaatggagagagaatagataacatcttcaagatgtttagctgaaaagagatgtggatggttggaggctgatgagatgtgtcctaggcagttcagggttttataacaaaataccttaaactgggtcatttgtaaacaacagaaatttattgctcacagttctggaggctgggaagtccaagatcaaggtgccagtggatccagtgtctggtgagggctgctctctgcttcatagatggcactttctagctgtgtcctcacatggtggaagggaccaacaagctctctcaggcctcttttataagggatgtaatctcattcaagagggctttacccttacaaactaatcacttcccaaaggccccaccattaaacaccatcaccctagaggttaggtttgctttattaaaaaaaagaaaattttttttgtagagacagtatcttgctatgtggcccaggcttgtcttgaacccctggcctcaaacaatcctcctgccttagcctcccaagtagctgggagctgagaccatgcctgaccttttaaattttaatttatttattcactcatgcattcattttttttttttttttagatacagggtctcactctgttgcactggctggagcgcagtagcaccatcatagctcactgcctcaaactcctggggttaagtgatcttcccgcctcagcctcccatatagctgggattacaggcacatgccactatgcccggctagtgttttccatttctgtagagacagagtctcactatgctgcacaggctggtcttgaactctgggcctcaagcagttctcgcaccatggcctcctaaaacactggggttacaggtgtgagccaccacacctggccaagatttaacatatggattttgaaggtcacaaacattcagaccatagcaagaaatcagggggaattttgttgtactttaaaaattggagatattttagcatatttcccacaattcgtgggtaggaagcagccagtagagagtgagaggatgaagaggatggtcaatagaggaggaggaggagagcttctgaagccagtgtctgggctcccagtgggagtgggagacaagagagtagaaagagtgcagtaaaggtcagtgtgcagatctggcgctgcagggggacggcctatcctcacttaagactggagtggtaggagaattttgtgaagatattgagactgtagaagtgtttgttccccattgaacgggactgggaggcagtatagtggttaaatgctccgatcttggtgccagactaatttggattcaagcctggcatttagctctctgagaatctgttttctcttctgcaaaatggaggattgataatcaggtatttcttttttttttttcttttttttttttttttttgagatggagtcttgctctgtcgcccaggctggagtgcagtagtgcaatctctgctcactgcaacctccgcctcccaggttcaagcaattctctgcctcagactcctgagtagctgggattacaggcacctgccgccacgcctggcttttttttttttttttttttttttttttttgtatttttagtagagacggggttttgccaccttgaccaggctgatcttgaactcctgacctcgtgatccactcacctcggcctcccaaagtgctggcgtgagccaccatgcccggcctcatcatcaggtatttcttaagtgcaagctctgagctggtgtagtgcaggttgagaagaggtaacagtcacaagcagacgtcataaacatttcatccaggttgcacaagccactgtccctctcctgggaccatggggaagtccagacactcacagtccatccactgtctccctccacagaaatcggagaggcacggaaatgtcttcagcaggagcccgtgtatttcaggaatacttttaagctaagaacaaaaaaatagcccaacccttgaagttccccctaaaccagaggctggctgcctgtgccctgtcctggcgctgctctgccctggaaacactgggaacggtggagctctgtctctctgtctggcccctaccgccctcactcccccaggtgtgcgaggctccgacagacgcgagaggctggaaaaggaaagtgccaaagggaggttatgaatatgtccagagagaacctgggccaccttaccgaccatgcagaggaggccatggagctcagggtaggagagtccagaatgtgtccccagtgctgggcctccggcatactcatcaccgccaccatcctcgctgccaccagggggcagtgtggccccagcgcaagggcatcagctttgggggccaaacgcacctggtctcaaatctcagttccacgtaccacctgtgtgtccttgggcgcgcatgacttcacttctctctgcctctgtttcctctttgggaatgggggtaataataatggcaacattggctcgagtgaggtttagtgagctactctatgtgagagctctttgcaaatcatcaggtgcctcagtgcaatcgccaccacagccacagagattccacccgctggatgccttcccctctgaggtttctcaccctgcaaagcctgagactcttgcactcagtttctcttttggattatgccagtcctgtgacaggtgaccctgggttgcccccattcttagtccagtgtctgagaaggggaagaaaaactccatttgcattggagcattggagcagctcagatgagtgaacaggaggaaggctgcaggcagaggaactggctgatgggaagctcctcgagtgaatggccagcctgctcgatgctggtcagccaaggacacgtggagaactagggtatgactgtgagcacgtgtgtattctttcaggaggaagcagggaacacttgggtggtgctgggagggattggaggtcgtccttatcaggtgaaggatggatctgtgcttatccagtggtaaaaggcaggaagggcatttgagctgagggaactgtgcatatgcaggcgccagggatgaaagtgcaaaaggtaggttataggtgtgtggtgatgagcagcaaatgttaggctaagaaataggctttgctctgaggagaatggctgggcacaataagattagggttgggagctgggcaaggtgtctcacacctgtaatcccagcactttgggaggccatggtgggaggatcactttagcccaggagtctgagaccagcctgggcaacatagcaagactctgtctctacaaaaataaaaataaaaaaaattagctgtgcatggtggtgcatgcctgtggtcccggctacttggaaagcttgaggtgggaggattgcttgtttgaggctacagtgagctaggatggcaccactgcactccagcctgaatgacagagtaagatcctgtctaaaaaaaagattagtgtttggaaagatggctccagtagaatgtggaggatggattagaactagggagacgggagtcacagatgattaaggaggctgtgcaagggttctacaggaacaaggagtggtctttgaatttagggagaagagggaataagacagacagaaatatgaaggcagagttgccacacaggctgcagggatgggggctgactctgaggagatgggaggggctcagaacagggaccagggaggggcaggtttccaggcaaatggtgagctctctgctgagccggagctggggttcaagcccctcctgttgtaggagggaaacctgagatttgacaaggaaagtaaaatgcccagggtcagtcaaaggcagcagcttagtacttggatcattctgtattcaacctcatggcttagggaccagtggataatgactgagtcctcaaatttgccctctgagacggttaagtgccatggttaggggcttggactctggggccagattgtctaggttaagatcctgatctgcctcttaccaactgtgtgaccttggcaggtctctctgtacctcagtttcctcatctgtaaattggggattataataggttgtttggagcattaactgagctgatacaagtgcttagaacagtgcttggcaaataatgagtgttagtcatgatcattgcatccattttgaagaagaaactgaggcttagaaaaatgaagtatctgccccatgccacacaactaatgttggccgagttccagcctaagctactccaaagacttgactggtttgcttaagctaactgcttgccaccgctggctctttctggaggatggttgatgtctttaactgaaaagactagagtccccagctgaaggactcttaggaggagattctgtggccctctaagcgtcctgtctggacccagctctgattctgacaccaccattcagcttgtttgctggagagatccacttgctcccctggccagagagcaggccagaaaccaggatccatcagggaggcctgaggcctggtctctcccctagttccacctaggggacaaaaaaaagacatgcatttaaatgaggacagtgccacttggaaggtgagatgattttagacgcgcatgccaggaacagttggagtgagtgaatcttggaagtgtgtgcacagaatgtggggggcggatgatgtgttgggagcatgatgtgaaaaggagagaatcaagcaaaacgcaaactgttgtgctctgaataagcaacactgatggaagcaagttagcctgctccagcccctcctgagagagctggcacacaggcaagttagggtgtcctaccctggtccagacaccagagagaatccaccttgccacgtggttcttatgtgagccactgcggaggccccgcccagctgagaagcagctgcttgtgttctgcttcctgccttccccatccctaggctcataacccagcagcagaggaagtgactcatcttcccagatgagatgggcggcatgcttccccagcagctctcagaaaatctgcccgagccacagaaatgaagccgggcagcggtaggctgtgggtttctagagatcactccatgtggtgctgctgcactgactttccagagcagcttcctcaagagaagaaaacaatcgtaacattgcctgagtacctattacccacctgtaagcacatgcaaaacacattcagtgattagttccatccgtcagatgagaaaacagaggtggaatgaagaacacatgaatctgagtctccgtttggaaagatgagggaggtctggagatggatggtgaggatggttgtacaacagtgtagatgtacttcatgccactgaattttacgttaacattttatgttatatatactttacagtttaaaaaagtactgcaggctgggcactcacgcctgtaatcccagcactttgggaggccatgatgggcagatcacctgaggtcatgagttccagaccagcctggccaacatggtgaaaccttgtctctactaaaaatacaaaaattagccaggtgtggtggtgcacagctgtagtcccagctactcaggagactgaagcaggagaattgcttgaacccaggaggcagaggttgcagtgagccgagatcatgccactgcactccagcctgggtgacagagcaagactctgtctcaaaaaaaaaaaaaaaaaccgcaaactaagaattaaataacacagctactaaggggggaagccagcagtcacacccgagaagtcctaccccagcgccttccttgctctaaacactcctgtaatgtctcatctgcgagtgaggatagtgacctgcagaagatgtgattggacagagagacaggggccactcagtgtcaggctgagaaggatggtctctcctggggttactgagagctgggtcagggttttacacagaaaggggcatggtaggatttaagggtcagaaagttccctctggcttgcaagaagatgggctggtgtgaaactggaggtaggaaagaggccggggcatggcccagacaagagcagtggtgggctaggccaggacagggctgcagatttgagaggctcgtgaagtggaatggacaggtggggaacgcgggcaggcaatgactgccctagctgggtttcttctggcccacccagttcagcctctggacagtggtccttcaaggtcccctccctgactgaagcctcagaggaaaagtcagggcacaggcttcctctccagcccccagggggcagtgttgcaaagtctttagggagcagggcccttcttccaaattatccacggcctggcaggggcttgctcccatcgcgcatttgccacccccactcaccccatccccaactcccaccctcggcatccctcccagcctttgctgcaccacccctctcccgtgtcctctctccaaggagacacattaataactgtaatcccacacttgacactttaggaaaacagtggcacagccattagctcatgtgggccatgagcagaatgagactccaaaagacaggggcagagcagaatgagactcttcccccaacccccaccacccccatccccaaccaccattaaaattttttttttttttttttttttagagacagggtctcgctctgctgcccaggctggagtacagtggtgcgatcatagctcactgcagcctccaactcctgggctcaagggatcctccccacttcagcctccccagtagctgggaccacaggcatgtgccaccacacctggctaatttttaaatttttggtagagacagggtctcactatgtttcccaggcttgcatcgaactcctggcctcaagtaatcttcctgcctcggtctcccaaagcactgggattgtagtcatgagccactgcacctgcaccccccaccctccaccattttataataaggaaactgaggaccaggcagggaatgagacctgaccagcatgtcagtggcagagccagggctgggggctgaaggccagccagtgcccaagctggagccctgcagcacctgtagaacaacagctgtgaaccgtggtccccccgcccacctgcagagtccccatttttctcctgagcttcctcctacctcagggggccttcctagtgatttattctcctgggttgtcagtgagatcaggctgacctggcacgtacgtgtcatgatttacttcctcctcatcctctgcttccagaattataagagtcatcaccatcaccatcactgctgtattaataatggctcatatctgctcagctctcagaattttggaagcactaatctatccatcagctcatccaagccatatgacagctctgggaaggtgttttgcagacaatggcactaaggatcagagagggcaagtgaccagccccaggtcactgggcgaggctgggggcggtctcccaggaggaagaagctgtaccacatacttaggagaagatcgggcaagataacagggtttaggacagtcctgccaggaggcttcttgtgtcaactaaaactaaaatctaagcccctcaattcactgaatggacaacccacctcttggccaaggggaccccagagaaacctttaaaaactgagttcttggccatgaagggacaagagacacacctcgtttatcctcctcccttttgtggcttagacactacacctgagcagcattaatgttaaaacagagatcataagactgacagaatggactctttgtggcaataagatgccaaactataaacatgacctagggtcacgccaggcaagggttaagtcccacacccatacactaaagaataaactatgttctcactgccacaacatttctctttttctctagcagctaaataagccctggtcttgagataagcagtggtaaaacaatttgcagctcctccaccgccagacactaactaactgatccccgttccaccagccataactatagctctgattggactagagactgtttcaggaattttttctgataagagaccaccgaccatggatgggttctggccagtttatagacaccgcacttgagcccttcatgtccttgcttcaccttttgatgtatatatgcatttgaatgttaagtctccaacccaaggtgaacatgggtcttatgaaacatgcatgtttattccatatgcatacattaggatcacctcatgaatattcatagctcctcctataacctgttgaatatgtatatttggtcaatgcgttcagcttaaatttctgtccaacccctcctcccttgaagtgtctgtctctggactctgccaaagactgagctccccagcccatcagaatggccaccttgtaggctgtaactcttcatgagaaataaagtctcatacctataatcccagcacttcagggggccaaggtgggaggactgcttgagaccagcctaggcaacatagtgagacgctgtctctacaaaaacttacaaaattaaccagccggggtggcatgcacgtgtagtcccagctactggggtgcctgaggcaggagaatcgctggagcccaggtgatggagactgcagtaagccatgattgcatcactgcacttcagcctgggggacagagtgagacattgtctctaaaaaagaaaaagaaaaaaaggaagaaagaaaagaaataaagtcttctctccaaatttatagatctcatgatttttcagttatcacgtttcatctctatttcacagatgaagaaacagcctcagagagctttgtactgggtcagggttgaactgacacccaagctcatgctctttctggggcccagagctgtcactttcagggaaggatgcagtttccaacacagtgtgttttcccataggctggagggagaaactgctgagagatggagggagttggaatcaggggaaggctgctgtggggcgaaagagcctggaggtggtggctgggggaggcagcttccaaagggagtggttggaggtagggagaaacctccagatggggtttaagctgctacagggagcacggcaggggctatacaagggtggggcactggaagagccaggggctgtgttgaggttaggtggctgtgcaacctggacacccacccggcctgcacacctgctcctctcctcgcagttaggagatgagctgtgtcctgatggagaagttgtgccaacaaaggcaggggaagccctgaatgcttggcaggatggggcctgtttctcatcaaccagctagagagactgaagcctgcttatctagggagagataaacagtgactcccccgtgatctccacactctcctggccccagtctaccaatctgaaaaaaggaaaggttgaattaaatgagctccatattccttccacctccgacttctgaggaccaggcatccatccttgctgcccttggctcagatcccagcccctgccatatacttgacatggagcctcaggcaagacatgaggcctctgtgagcggcagtgtcctcatgggtgaaataaggaggacattgccttccttgagcagagttaacgagccatacacgggagtgtgtctgcacagcgacggtctgactccaaggcagcatccagcgggcagggaaggctgaggctctggctgaggccctcgcttgtctgcctggcccatggctcatttttagatatccccttcctggctgccaggccagaagggaagtgggaacaaagatgctgaggtggtagtttggagccgttttcaggaagaagcctctgggcactcttccccttttcaccccgcccacaccccgtcttctgagccatctcacagtgatcctcaggacaggcctgaggtggagggttggatgtcaggatctccatttaacagatgggaagacagagacccagagaggacaaaggatcagcccaaagtcctacagcaggattatgacagagctgagaccagccttgaggtctttaatctgggcccagccctcttcctttgtaccccagagcagatagttctataaaatgaagagtctcctatttttcctggtttatcagaaggcattttcctaagtgggttggcttgaagaaggtaagggcttgggttctgcaaacagcccagggttttatgaacagcatcaggcttagcatgagacacagggctctgtgaatgttatggggccctggaagcagccgaggtttgcagactgtgctaggcttttgccaacggcacaggactctaaaaaaggcatcaagttttgtaaactgtgggaatccacagatggtgttgtgatccacacgcatcgtggcgctctgtaaaatgcaccttcatataatacttgaacaaagcacagcaaacaccacacactggcaaatggcaaagcccaggtgcaaaccagtgtggtcaaacctcagacctgggccactcatagcaggagccgactatggggttcaccagggagctggtctgaaggcatgttagcctatgtctcagaggctcctgggtacctgacccttgctcaagttccacagctcaagttcaggaatattcttggaccaggctttgccagcctggggaagttgaggtaataaatgaaagctgctcatgccagaggctactgtatataccatgccctgggggttattgtgcattgcttgactcaaagatcaatgagataggccgggcgggcacagtggctcacacctgtaatcccagcactttgggaggccaaggtgggtggatcacttgaggccaggaatttgagaccagtctggccaaaatggtgaaaccctgtctctactaaaaatacaaaaatcagccaggtgtggtggcacgtgcctgtaatcccagctactcgggaggccgaggtacgagaatcacttcaacctgggaggccgaggttgcagtgagctgagattgtgccactgcactccagcctgggcaacagagagagactgcatttcaaaaacaaacaaacaaacaaacaaacaaacaaacaaaaagaaaaagatcaatcagataaacttagccagacaagctggtccccctaccaagaccattccatgcacagaacttcttcaggccctggggccaaggtgggggtaactgggcttccagaaagtttaaagggatcttcatacctgtaatttggagtctggaaggttgcacccccgccagtcttcatgaggattcacaatgctgacgttcgtcagaaggatttggagagatagacccaatttggttttctcaagtagggtctgatcaggtcagaccctgggtcaaacccatgagggtctggtctttctattaatccaagccagttcttgacctttctcagtggaatggtcatgtactcacatttctggtttctcaaagactcatttattcatgtaacaagtatctattgagtgcctcctgagtgccagggagatctgtgattatttcacacattccctacatcctactagcaccctcatacagcaaataggagccaagtggagctggtgtatgtttctctgttattgcaccctgaaagttagactccaaacccacatcctcattccacgcaaagactttattccagagacagggtcaggttcacttctgcatcttggatttggggaaacccagatcttcctcagagaagatatcctgggtggagggaaaagcctggttctatcattagaggttcaaggcacccaccacctactagctgggtgatctctggcaagttactgagactccatgcctcatttgtaaaatcagggaataaataacctgatgttacagtgtcaaggggaggacccagtggggccttgtgtgtgaaagtgctgtgcaagctgggaaaggcaaagtggatttgctttcccttgctgccctgttcggagccccacctctgccactcccttctctgagctccaggcctgcaggcttggcttctctgtccttcaccgaaccttcacagtggctctgcaagggattactgtcccttctttatagatgagagaatggacgctcagggagatgctgggacttgcctgagatcacttgaccagcaaataacaactgaggtgggacccagatctctctggctcctgaacctccatcctcagtcctcagtccaggaaactctgagaatttcatattttccattctcttcccctcctcctttgcctagatggctgaaattgatggaccttctaccatgagctccacccaggcaggctgccactggatacttagtggacagagccccttcttgctgtggatccttggagctcagggagaagatgagggatttagtgagagggcacgtgggcttgagggggacaggggttcagtgaaagaggacaactgctagatgggggaacaagggctctctatggggccctcctatcaagggagggcaacaaaagttctgtgaagggaacaagagcttggtaggagaagggctcaggtgggaaatgggagtgcagtgaggagactgggggatgaatgtggaaggttggggagcttggggagacccatcagcatcccccctgtgcccccacctctctgctgctaacagagcaggggaaaatacctaagggaaatgctgaggcaagaggctggaaaaggacaggctgaggctgagcctcagggaggcggggtgcagcttcctcttcacagagaggctggacttgaacaaacccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggataggtaagtccgaacaaattaaggaagggccatggagagcaagcctgggggacatgttcccagagaaaagggtgaggccgtagagccagagtgggtgggatgggtgctcacagctgttggcacagagccaggcacatggccggagttcagtgaaggtgtgttaaatgaatgagtgaatgactggaggagcaggaagggacacgatttactcagctggagccagggaacccagccaaacctcgttgatgagaccgagacttagaggacaacagaaagacaggcccctgaccccctcttcaagccgtttcccctctcaaaggagacaaagatagagacagacagagcagagaaaaagagaaaagtgtagtcagacagtgcagacaggcaggctcaaacgaagaggcacacaggaggtcggagaacacaatatcaacaggtatcagcgagagaatgcagggaaaggtagggaggtcaaaccgggagagagggctgcagcagagactgggagagacaaagaggcaggagacagagcaggaaagagaatcagacggggacaggtgacggagagctacagacagacctgcaggcagcatcagaagatccacccagaagaccaggagattgagagtgacctgcagagacctgcatgggtctctgtgcagtgaggtctcttactatagagtggggaggaggctggaggaaaaaggtcttgaagctctgcctgcagggtgacaaggaatcgccttgtagcgagggcagtgtttctgggaacagagcacctggcccaacactttctgggaaggcagtatgggtagaagaaacaaaggatctttctactgggagtactccaggttagacgccctatagcagtcacctttggcctctttcccagctgttgatcctcccctgggctgtgtgagcctcacagccatttgggcaaggccccacttgctcccagaagcccagcagggagagcttcataggccatggagacagacccagctgaggagcagctgcagggactccaggagaacgcagccatggcttggggactgcagtacggcaggaagggtgggatggatgcctcctctcggggcacctcacaggacagatgagaatgaggtcagatttgggtgggatggttgggggggcggtgtgaatgggccattgacaaaccaaattccccatcagccttggctcagtatggatgggagggatggagagcggggagtgtgggaactaactagagactttggctgcactacacctccccacaagtccccccagtactatttttctgacccctgcagggcccagctctggaatattctccaggtgcccactgaccttccacacagacagcaggaagctgaccccagcatctgcctggtgggccattgggtgccatctctagccttgcttcccgagacccattctgggctgtggccaggctcaccacactactctgaggggtgtgggaatgtgggtggggtaggacacagagcctgcagcctgggaagagtccccaagggagaggggaagctgtcccagtcagggcagacaccagagaggagtgaagttcagatccggctccagcagagcccctccacccactcaccacataccccttaggcagcagtttccctgcaagtgctggggcagccattcacacacacacagtctgactcagagatttcatcttcccacctgttcacctttgctcaggaagcccctgcccacatcccattctggtgacatttgccctgttttccaactcttccaaatgccaactcctccaggaagccgttccagattcttccagctgggggtaacctctcccatatgctgtttgatgaccttctctttgaggttcatccctccttgtttccggtgttgctcttcctctctccagcccaactgtgttcaaatgtaagccattctagggcagacaggtggggcgagggaaagaaccagcagtcccaggttcaaattccagcactgcatcactggctttaagagaactcagtgaaatgtccttccccttttcaataggtgagaaactgatgctcagagggggcaagcaaggtccaagctcaccccaaagtaaacagcagagtggaggccagcccccaggtctgcctggtaccagagctcttcctctccgtgccattgcccttgtggtttctcttcccttccaccaatcccacacagggtgagcatggccagggaaggagatagcactgcaaatgcttagaaaagtgactacacctgcatgtctgtggagctagtgagctgcccagtaccgttggaggagcgggggtcactgggcaacatcttgggaagttaagccaaagaagttgatggggcccagtcacaaggaacttgtatgccaggttaggcacatggactttttcttaaaggcaattgggagctatagaaagtatctgaggaggaagtggccctgcttcagtggcccagagaatctgtgtcctgggaacattcattataaccccaatcatgtgtacagtactttttttttttttttttttgagacagagtcttaccccgtcacccaggctggagggcaatggcgccatctcggctcactgcaacctctacctcccgggttcaaacgattcccctgcctcagcctcccgagtagctgggactacaggcactcaccaccacgcccagctaatttacgtatttttagtagagatggggtttcaccatgttggccaggctggtctcgaactcctgacctcgtgatccatctgcctcagcctcccaaagtgttgggattacaggcatgaaccaccgcgcctgaccatgtgcagcacttttatgatgacaaagcactctgggcccattttccaaatgagggacaggagttcgagaccagcctgaccaacatggtgaaacacccccatctctactaaaaaaaaaatacaaaaaattagctgtgtgtggtggcacatgcctgtaatcccagctattctggaggctgaggcaggagaattgcttgaacctgggaggcagaggctgcagtgagccgagattgcaccattgcactccagcctgggcaacaagagtgagactccatctcaaaaacaacaacaacaacaacaaatgaggaaataaaagctaggaggagttctgttacctgcccaaggccatgcagctactcagcaacagaactggggctcaaacttgagccctccactggtaacagagcccttcctggcctcctcttcccctctttctggacaaatctgtactgaaggctccaatgttcccagcctgtgcctggtgaacacaggcctgagggagctggctctgcaggaagcctgccctgaccccagggtctctggtgccaaaacagcctgaagacggtcatttgggtcactttgtgtttggagcactacagcttcatgatccgagtgagatgggataacatggaccccttaaggggtcaatttaagcagagagagagattagctgggaccacatggagggaacagagcatggccttgagccatagctgcctatctctgagcctctggctccttgttttaggcatagagagactctccctccaggccctagttgctattttttaggtcatcctgggtctagatggggtagccagggttacaactgggaacaggaagtctcagctcagggtccctgactgagctgggaaaccaccagaaagtttgcctggcccctccgcaaacctgccagatctccttcaagaaacaacagctggagtctcacaaagctggacctcaagcatgctattgtcctcccagcagaccacccaaggtcctgctgggaggaatttcccaaatatgacagccaagcccaatgcctggagacatgcccccttcctgcctttgactctctctcctccagaatgctgggccaggccgaacaaggaactggagcattcagggcccttatgctgcccccatcccaactcatgcacaccaccgcagtccccacccacagaccccgtgctccagccttctcttccccttcatttagtttagttcaattcaacaatcttgttcttttattgagacggagtttcactcttgttgcctaggctggagtgcaatggcacaatctcggctcactgcaccctcggcctcccagattccagcaattctcatacctcaacctcccaagtagcggggattacaggcacatgccaccatgcccggctaattttggtatttttagtagagacagagtttcaccatgttggccaggctggtttcgagctcctgacctcaggtgatccgcctgcttcagcctcccaaagtgctgagattacaggtgtgagccaccacgaggccaggcgtgagccaggcctcgaaagataagtggtttgctggggaagaagaacactccacgctgagggggtacagctggtacaaaggctttgaggtggaaaagaacatgatgaatttggggaatggcaagaatctattggagccagggaataatgctcactagggtggggggtacgtgggatgggactggcttccactagccttgacctccttgggactgagcctgtactcacggtttgcagacgcagctgggagttggggaggggctaaccattgttgaggaccacagtataccaggcataggacattttcctttaatcctaataaaaacactgggagatagacactgctcactcacttacagagaagaaaacaggcttagagaggctaaatcagatgtcttaggtcacatagctacgatatgacaaaacaaatatttgaatccaaagtcttctcacccagaggctttcagcagggaactaacatgatccaccaggactgggggagtacaagacaacctctgccctgggggagtttattgcctagtcaggcagataagagggaaacataagtaatgcaagagagtgaccggcagaaattggcctgggagtggggttttatggagggagagatgagagatgagctgggctgcaggagcttggcagggggatctgcaggcccagggaaccccaagcaactttaggaggtaggaagggcccaaggcaggggcttgtggccttgaagttgtctgcctcccaccccaacacctctggagggaggtgtctgccattatcatgaggaatggattgcccagcatctgctgctgatgttaccagaaaggggtctggatccagaccccaagagagggctcttggatctcgtgcaagaaagaattcagtgtgagtctgtaaagtgaaagcaagtttattaggaaagtaaaggaataaaagaatggctactccataggcagagcagccccgagggctgcttattgcccatttttatggttatttcatgatgatatgctaaacaaggggtggattattcatgcctcccttttagaccatatagggtaacttcctgacattgccatggcatttgtaaactgtcatggtgctggtgggagtgtagcagtgaggacaaccagagggcattctcatcgccatcttggcattggtgggatttagccggcttctttactgcaagctgttttatcagcaaggtcattatgatctgtaccctgtgctgacctcctatctcattctgtgacctggaatgcctaactctttgggaatgcagctcagtaggtctcaaccttattttacccaatccctactcaagatgaagatggagatggagatgggtaagaatctcaattcaatggttttgaattttgtggggagagagtctgagaatctgatggccacagcctcttcccttgaagggctgatccatctttcaggaagtttctctaaagaacaatcaaaccatttgctttggacggacagtctaggaagaggaaaaatattgctaatgaagacagtgaaatagcaaataccatcatgtgaatgttgacggtaaggtacagtttgagttttttagctgtcaggctgaatgtggggatagatggctttcatcctcaggagatgctttctgcaccaggaaggagggattacagtctctgcatggtagctgggggcttcaagcctgtatcactgcctcctagcccagagagggagagagatgatccagagatggatgaatggcgatgtcaggatggaggggtttacctggaggaagaccaggtgtgtatggaaggggatggatccagctgggcccgattgcctcagatgtgcttgaatatttatcaggaaaagagagcaagggccacctatatgccaggccagctgccccaaaggccttacctctttgaggtcgtatagaggagaagagatttcttgtcctcactctttgctaggctggtggctgaggtccctataacaaaagacagcttaacaggagaaaagcatacaaatttatttggcttttaaaaatttaatttacttattattatttttacatagagatggggtatcaccatgtcacccaggctactctggaactactgggcttggtaattctcccacctcggcctcccaaagtgttggaattacaggcgtgagccactgcgcctggcccaaatttatttaatataagttttacatgacacaggggccttcagaaatgaagacccaaagaaatgggaaaacgtgtgtattcttaaactttttagtttttattatattgaattaaattaaattatttatttatttattttttgagacagggtctcacgctgtcgcccaggctggagtgcagtggcatgatctcggctcactgcaacctctgactcccaggctcaagtgatcctcttgcctcggcctcccgagtagctgggattacaggcatgcaccaccacacctggctaattttttgcatttgtagtacagatgaggtttcaccatgttgcccaggctggtttattattttttaatcatctagcctaaaatgtcaaaaacttgtgactttttatgccaagtttgatgaagaagtatatagttgtggaagtattgcacaaagagtgtgtgagctaatggtgatacacttaggggaacctagcaaggcctgtttgttcagattcttctctgtgtccttgcatcttcaaagttaaggctgttttttttttctccaggtacaaagacagcaactctcaaatgagaatcttatgacctatttcagggtgaaaggtgggagaaggtcagagtggggtgactatcctaggttttatgacctgcttctactgttttctcaaatgtggccaaggtgccatatttggagaatagtgtgtcctgaattccatcagtaaatactgttatattcaccttacaaatggggaaactgaggctcagaaagctcagggatgtgcccaggctcacacagtgggcttgtagcacatctgggattccaacccaggtctgaggccttaaagcctattctcagcctcacatttccctgagatctgtcctttgctgctgggaggcagccaaaggaggcagaatcctgggcctttcccacagagaacaggtaaaggaaggcggtccttgcagtcaggctggtctctgaaaccttgctcctcatcacccagactcaggtggtgtggagaaggctgactctacccatgaagggcagccccttgaagggtgagtctctgactgaccagatacctgggaaacgaagtttgtggctgacagactttcaggaacttgtctgactgtcttatgaggagctgcaggcaggtggctgactgacggcctgaacggacagctctcctgaaagacagtagcccgccggctggctggcttaccagcaggtggacacgatgtgcctgcatgagtgatcagccaagtgaccgactgacagtcagacacacagacccattgcgggccagctcgggctgtgggtccctagcccctggagccacctggcctacctgggaccccaaaacttagctgcccacctgggagagagagggactgggttttttaaactagggcctggctctctgccccaggtcccttcattcccgcaggcaaccgcctgcccagcccaggttcagtcccatggccgtcccatcctcctgtcaggggtggcccctgacaaaggccccacagcacagggcagggtctcagtgcccttccacaggaggacacgcagtcctggactggaccatccttccaaggggagttccgccctgagtcagggaggcgaaggtttgctgtcagcgcgtcagcagagaccccagcccacaggaaaggctcggagggggtgggcagcctgcctgacaagccccattcagtgaccagctgacccccaatacatgactcgtgctcctctcagaacccggaggaatgtggccagtgcttccctcccctgcccagaggcacaggctgtggactttgccctccacaaacagccatatctctaaaggataaagtactcccaggaaggctttgagccttggcagaaaaggctgggattgaagcttcagggagagccagaggtgaggctggagtgggagatcacctgaggcaggtgagcaggctccatgagtgggcaggtgagaggccagggggctggaactggggctagacaggctggggcacagcaaggatgccaccagtatacccaggaagctaagtggagggtccagggtctggcctggaggcgggggcctcacattctgagctggcccacaggcttccacccctctcccccatccattccttgggtttccttcagagctggggctccaggtcaaggacttctgctcccagcctcagctcccgctctctcacctggttggcttggccccttggtggactggcactgctacctatgaagtgacttggctaggtttgggtgggccaagacagagaaaagcactgtgcttcttccccctgtcaaacttgtacaaggagcattgagtgatgttgagtttaacacttacctgggcttgagtcctgggaccaatgctaaccagcaaagctagttcctctgagcctgggtgtccttatcagaagcatagagataataagacaccaaagggacggagctgtggagagggttcatgggccagtgcacagaaagcctgtggcatggagcccagactacagcaggaaacccactgcggctggtgagaggagctgaggctcagaaatggtcccctccacctcctctgggagcctttgctttgaactgccttatttcctccttgcctttaaagtgactcccactgagtgtcccatgacactcctcttccctaggccaatttcccgtctcctcgtcaggtgtcagttttgtttcaacagttccttgcttcctctgagtgtttatgccccgcagagggactcctccctagccacacgcacttccatttcctcagccaaattcctcaacctgtttgtatagacatttctccaaagcaagatatacaaatggcagtaggcacatgaaaagatgctcaatatcattagtcattagaaaaatgcaaaccaaaaccacactgagataccacctctaccctatgaggatggctataattgaaaaggcagacaatgaaagtattagcaaagatgtagagaaattgggacattgctggagggagtgtaaaatggtgttgccactgtggaaaatggtttggcagttcctcacatggttaaacatagcattattgtatatgaacatatgacccagcaattccgctcctaggtgtacacccaagagaattgaaaatgtatgtctccatacaaatttgtacatgaatgcttctaatacctaagacttgaaaacattatgctaagtgaaagaagccagtcacaaaaggccacatattgtgtgatttcatttatatgaaatgttcagaatataggcagattcatagagacaaatagtagatgagtgtttgtcagggaagagggaggaatggagggtgactacagatgggtacgggacttcttatgagtgaatgaaaatattctggaattagatagtggagatagttgtatggctttgtaaatgtactaaaacccactggattgtgcacttttaaaagggtggattttatggctatgaattacatctcaattttaaaaatcatcaggctcccaggtaccttgtaagaggagcacaaaaacttcacctgtggtggttcagggcctccgtagccccctccctgagtttgtctttagccctggagatagagtgagagtcccccagatcagaggaatcctgaggtcaattttcaggctccagaaagcatgctgagtgaaaggaaactcctgccggtggtgagagggacatgaaacaatggaggcttccggcaggaagtggagccgcagaaggggaggaagaccaaggaggcctgggctgccaggaggagcaggtggtttcagtctaaatagaggggtggagtctcaaggttggacttctgggctccccactgagagtgagctcaggagaccctgggaaatgcctctgaaggggctcagctttcctctcattgcagtgagtgagatactgatggttaccatagttaccatgtgaggaaagccaacatgcataagggaggccaagggtccaagacagctctgtgtcctcagttatcaccccatgggcctctgtccacaagagtgttaagtgagacgagctcagagggccctttctgccctgaccagcaacatggtctgatggtgtgatttggggattggctggttagctctgtgatgacatgcacaggggttccctgtgcaggggttgaaatctactccaatacaccccagaaaagcctttattccctgactatggacctagccttgaccctgcacctgccccagatctctgatcctagactgagccagacagtcccaggcccagactcagtctccaagagcacaggatgtctcacaacccaaggcaggctgagagtcttcacggcttaccctactgctggggccactacctgcaggtgtgttgtgtagagaggtcagcagcttctccctagaagggaagtttttctgggagcagagtgaagtgtgaaataggtacccagtaggtatttgatcagtaggggcacagggatacacacccttttaggaaagtcccttccagaactgtgacctaagaatgaggaaggctgaaggtgatttgattctcagattctcatcaaccactaagaactcttcttcctgaaagaccttggttctgaggtctagggctatctaatcaggtcagggccattctcggggattctatctattctctttccctggttttctgtccctcagggccagcgggtgaggtaccccaggtaccagacaaggaaaccaaagccacaatgggcacagaaaacacacctggaggcaaagccagcccagaccctcaggacgtgcggccaagtgtgttccataacatcaaggtacctctcagggcctggcaggggcctccgagtctagaagagcaggctctgccacgtgctggtggtgtaatgccaaggaagactttctctgagcctcggtttcctcatctatagaatgtgtggctgtgaggatcaaagggatgatctgcgaaagcactcagctgggtttcgggcacatggaaggtggccagtacatgttcgctcctcccagagaggaaaggggtgttcttggagtagtacaggatgaggcaccccttgtttcccactttcccagagaaacagagaagtgccctggggatcccgaacctatgtggatactgggagtcctagctccaccaagggcagctgtgaacatccaacgtccactggagcccactgggtgccaggcgctgtgccaggtgccactcacacgtgatcttatttagttctcacaatatccctgggaactcgggctgttgtcctcattgtacagatgaggaaactgagactcagaacagagtgaatatattaagctctgtcataaatactctattttttaatcctttgaagtttttcttctcttaggaattctcttagagtttcaggaggagactccaggcaggttgcgatgtttggggtggggttcagtgtgtgcaggtggcctcacagtgccactctgggagaggactagtgggggtgggatggagaaggatctgggtgaatctgagatagcttccctgagagaggggcaggatggtggaactgggaggaaagtccagcccagccaaggggggctctgagagtcagaggggctcccaccattcctggccatgggaagaccctactctcggtcttgtggctcttcaatagcccccaggctcctggagtgtacccaggatagcttttctagtttttagtcctgtgtgagaagctgtgagttacaccagtaaccatctctctctgccccctacctcctctggcctttcttccctttctctctttctctcccctccctcctcctctccctgtctcctttggtctctctctgtctctcttctgttggtcactctcccgccctctgtctctttctgtgactctgtttccccatctctactccttgctgctccctctgcctccttctgcctctttgtctccccctgcaccgcccacctctgcctgcctccgggtccccccacagctgttcgttctgtgccacagcctgctgcagctggcgcagctcatgatctccggctacctaaagagctccatctccacagtggagaagcgcttcggcctctccagccagacgtcggggctgctggcctccttcaacgaggtacaggccccacccagccacaggggtggacactgagggaggcttgcaccgcaccttccaccagcctcccctctcactaccctaccttaaggccttcccctcccagtgccctcaggcaacccctgtcccagcgcctgcctgaaacctcagagcgtttgcagctgtcttctaggacttggacttggctgtctccccttgggaacctctaatgggtcgggtcctggaatatttcggagctagccagggtccccatatccacccactcccactttgtgtcctttaccttttcaggcacccaactattgcctgtcccaggaaggaatcaaagaaagccacttcaacagtagtgagagaggcttaaatcgcatcaagagcagaacctctgggccttgggatggtcgcgggagggataccgcggcgcagggtgtctgtccttagaactgcctggggattcacaggcctgtggggcccgcagccaagcagggaggagcagatgagctgctttgggtggatttggagatcagagtccagctgtgccccagtccttcagtccttcccccgccagatgtttttaccctgaaggaagttgtctttctcccctgtccccagggcagagtcccatgaaattctccccccttggtaatgtgtcatatttctcacaacccaaggccgtccagctgcagtgtccccagatcctcctcagcacccgcctcataggtgggaggggaaagtccttactttgctctgggagtttgggcaagtcactcccctgtctctgggcctcagggccctatctatgaatacggccactatggagtgtggctgtcctttccagggtcagccatcccctggctcccctgctgatactgatccactcccccagcgaggagtgtctgggactcacccaaggtcaccaatcaataagcagcagagccaatgcaccccctgctcatggtggcagagactgtccctgccctgcatgcactgaagtcacctcctgaactcacatcctaggattgtgatcctaaggctcaaaaggtcaagccttgggccaggcacggtggctcatgcctgtaatcccagcactttgggaggctgaggtgggtggatcacttgaggtcaggagtttgagacctgcctggccgacatggtgaaaccccgtctctactaaaaatgcaaaaattagctgagcatggtggcgcatgcctgtaatctcagctacttgggaggctgaggcaggagaattgctcgaacctgggaggaagaggttgcagtgagctgagatcacaccattgcactccagccagggcgatgagagaaattccgtctcaaaaaaaaaaaaaaaaaattcaagccttgacctggctttagactttgtttatgacattcctgaaactcgaaaccccttcatttgatggcccatccttccccatgttctaacatggggtccaatctgtgttcaaaaatggaattgaactcctagctttctccactctgccctcatttctctcccctaagggggccgtgcggcccttccgagggggacccaggagagggacccagatgatttttattcagtccattattcagatgggcatacggaagttagacatagagacaaggatagtgcaggcccccagccctgggaactgttccaccttaatgggtcacctcgtccttttgcaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctggtaagagcagcaggggctgggcaggagtgggacgttagcctctgcattgctttgcgctggggcccaccccacaggcattcatctggcaggatacaccccaaaacctcaacaccccaggacagctgctagtccccccccaacctggctccccaggccccagcccaggtgggtctctggcagacctggggagtgcggtaggaagtaggccctgcgcataggggtgagggcctgcttgtatgtcactgtgggtttttttaggtgggggtgaatttacaacacagcctactttgagggcctggcatgcagtagaccctccggaattgcgtgtgtaataataatagtgtcatacactacttactatgcaccagacactgctctaagcacttaatgtgtagtcacgcatttaatcctcataaaagacattgggaaaagaaagaatgaatgagtgaatgaacaaatttaaaaaatgaaagaattctggacaggaatggtgaagccatgttcagcccagtgggattttgttgaggccctacttgacaaatggatgtctcttacagaatgaccctaacaacctgatcgttcactttattccttccctctcctacccactcacccacccacccactcacccatctgtccatccacccattcatccatcatctatccacccatcgatccatccacctactactcatccatctatttatctattcatccatccaatgggacacgcaacaaactcttaatgctgcctacttcgtgcctgagcctctcaggggaatcagtcctttttactctagggagctcccagcctgggagaggagacagataaaacaaaaaacaattgtgtgaggagggaagcacaggggtgggaggagcccacaccccagcctggcatggaggaagcctttctaggggaagaagactgtcagagagcaggtttcctccctcctcctcccaccagctcacacctctgaagtcccactctgtaccagaccagaggccagggataggggagagaagatgaagcagacatgacccagtggggcgcagggttggcgtgagcacgggcaactctgctacaaggtatagagcccagcaccttgggaggtggccagaggaggccattagagccctgaataggggaaggaccttggcagctggagggagctggaggggctagaggaggtggcacttgagctgcagcttagagagaaggtgggagttgcaggtggaggggagggcatgggtgcagaggcaggaaaatgggaaaactcagcgcgtgcatgaagaatgcagagtcgttctctaggcctgcgtggaaacttgtcaagagaactgcttggaataccagaaaataatacttcctcacatttctttgtacagaattttcactttacattttcactttttctgtgcaaggtcatgcatgttcttcatccttactaccatacaaacccctctgcaataggtgcccctgaatcctcaagcaaagcccttctgtctgagcctccgtctttacatcagcccaaagaatgggagagactcggggatctccaaactcccctcctgttctgactctccaggctattccactcacttattcttcatccaatactgatgaagttgtgttctgtgccaggccctctgcagggcactggggacacagggatggggaaggcagacatgacctctctaataattgttgcatctaacgtctagtaggccccatgcccaggcacactcaccacccaccactcttaatgttcacgactccaggaggcagggattatcattacttcctcacaagtgaggaaaccaaggctcagagaggggaggaactgccccaaggacacacccaggtagccctgccttagctgctgttctgaactgccgaattcttccacttctgaattccttatctggagaactttgttctttctttcttttttttttttttttgagatggagtatcactctgtcacctaggctggagtgcagtggcttgaacttggctcactgcaacccctgcctcccaggttcaagcaattctcctgcctcagcctcctgagtagctgggattacaggcatgtgccaccactcccggctaatttttgtattttagtagcgatgggatttctccatgttggccagcctggtctcaaactcctgatctcaggtgatccaccctgctcggcctcccaaagtgctgggattacaggcatgagccacagcgcctggccaaattttgttctttctttcatttgaaagatgaagaaaccaaggcccagagtgggtaagggcctctgtcaaagtcacacagcaagtcccaggcagcctccgtggaaggcttctttcacgttcttgaccttggttcacatggctctttgcagcccaagggagtggctctccgtgctgggttgacacagctcagagtcccagctccataaatggagggccgcagagagaaggctgcttctacagccacatttgggataataatagtgtgagggtctcctcaagtttgctcaccaaatattggtgagctccagggaacaaatgtcaggtactaaattaagaaattcttttctgtactctgcatctgtgtcccaagctgacactgaaccctcccccaaagtgaatgccaagggccccagggccctccacaatccagccccagctgccccaccctgttccactgtgccttcagccctggccttgccctcatactttgtgatctagccattctgagcttctcattctcccggcacggtgccctttcaagtccctgggttttgcgtgtactgtgacctctccctggaacacccctcccctccctctttttctggaaaattgtgtttattcttccggacccagttcaaactacaccacctttgaccaccccgccccacccaggggccaccgttgctatggcacttgcaaatgcctcagctcagaaaggtggtgtagggcagtttaagagcatggactctgaagccagacctcctgagttccaatcctggccctgtcaccttactagttgctgtctaagcatcagtttcctcacctatgaaacaggcataatgagagcactcacccttgaggtttgttgtggggctcaaattatttttatacacagcacttagaacagtaccttcccccggggtaagcgctatttaagtcttagctattgttataatattttttcattgtcgtctctcagaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcggtgaggaccagtgccatcccttggcctctgagggtcaggccaggctcaactaggaggaagagagacccagggttggggctggagatggaatccctgccccctgccccatctggccagtaaaggtccagggaagccctggagagttccccatccctgaccaggggagacagagtgttcttgcccatcagagactgggcaagcactggtctgcagagggaagccagggccagaggatcctaactcaggctttgtgttgtagggatcctgtttgcagtgaccatgatggggccaggcctggcctttgggctgggcagcctcatgctgcgcctttatgtggacattaaccagatgccagaaggtgagcctcaggagcacatgtttgctagaccctagctaactgactgccactctcataggagacattgagccaggggacctcggttcaaatcctagcagcaccactgaccttgggcaagtctcttagcctctctgaacctcagctttctcatctgtgagataatctctgtcctgtctgtctcctaaagctgtgatcagagtccagcgagatggtggagataaactgtaaagtgccatcaaattaggaaccatggttgccgtcactactattactgggagtcttcgccttgttccataccccaccttcaacaggccctcagccccctgctcacacatgctgtggggcaggtggaagagcatactctcttgcctgtagggagcccctgtttttagggggaaacaagacttgagttaaacagagaggacagtgcacactggagagaacttttggagcagaacttggtgactcaaagtattaccctgggcctctctcagatgggacatttactgtgacctctaagaacccttctagttctgaccagctcagagtctaggaaactgccaggggcaccatttgggaaagagtagtttctggtccaggcagtggtcagagtgggccaaggagtgggactgacgcttggtctgaaggtggccaggagggaggggtgttgggggttccagggttctggagtccttggagagcagtagcgtactcctgttagagcacgtcactgtggcatcccagctcccaactcgtcgcaccaagcagctccagatgtgcctcctgccattctcacctgcagactttctgccaggtcctgggagcctcaggtgacgtgtgtgtggctgaatggacatgcagacgctgcttctcgttccccagcttttgcccacaagcgcctccagccagaacagatctgcgcagctctgaacagcagccaccagggacagccccgccccgcccactctccttctggaaggctgggtccagagtgtgggctctggctgcgacccctccctcccctgaaagaaaagtcctgggagtcaggggttccctagatttccctgacacacctcagctccatgcaagggggtgtgttttctgactctgttgacattgtccaggcagacggggtatctccacaggcagatgtgacatttctgtggaccgacctgccacctcgaaactcccttctccatgggggatttcacagggtgggcagatcatgctagctgcaggcacagactgataagagagaagcggacgggttggagaggtgcatgtgtgagctctcaccagcctgacatggaggcaggggagataacaagtaaggagagaatcaagtctaatcagcgcaaaagccaaacccatccccggctttacaggtgcgtttgctaagtgccaactgagtcctctggtccctgcctgggaggagcttaggatcaagcaccaggggaaccagctctgtgtgtggggttggtacatcaaggagcatttggtttttcttgtttttgttttgagacagggtctcactctgcccctcatgcagtggcacaatcctagcttactgcagccttggatgcctgggctcaagcaatcttcccacctcaggctcttgagtagctgagactgcaggtgtgcaccatcacacctgggtaactttttaatttatttgtagagacagggcctcactatgttgctcagggtggtctcgaactcctggcctctaatgagtcttccacctcagtttcccaaagtgctgggattacaggcttgagccactgcacccagctcatttgtatttttatgaagcatttttggatgctgtggaaattgaaggaaaatgtacacaactcagccttgtgattaagaagtatgacgggagctttgtgtgttccagccaggaggtacacctgggataatctagtcccaattaaacctagtgggggatcaaaatcatctggggaacttgttaaaggtacgggttccttggtcaccttcccaccccactctgtggtcattctaagtgggtcttcagtaaggccaggtattttttgacaaacatccctggggatattaatcatcatgaaggtctgagaaacacaacagtaatcctaaacattcatttaagaataataatcacaatagtaatgagaaggaggaagaggaggaggaggaggagcaggtacctatatggcacacactcttctaagtgcttcacatctatttcgttaattttcacaacagtcctatgatttggaagctactaatatctatatttcacaaaggacaaaaactgaggcacaaagaggttgtgtaggttgcccaaggttatgagttagtaatggaattcagacccagcagtccgcctctagagtccatggccttgaccactgcactatactgccttggtagttgaagaagccaaggctcggaaagggccaaggacttgcccagggtcacacaggacacacctggcagagcagactggaactcaggtctcctgactcccagcctgggccacctcatgtctcagaggccagtcccaggatggcggcttagaagtgacagcctatcatcctgaccctaatgtcaccatgctcttctcttccaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaaggtaagctccctccatgtcacctgactgggtccaggctccagcaccacccacttgttctcctttgtaacattacacttcggctgggcgtggtggctcacatctgtagttccagcactttgggaggccaaggcggttggatcacgaggtcaggagatcgagaccatcctggctaacacggtgaaaccccgtctctactaaaaatagaaaaaattagccgggcatggtggtgggcacctgtagtcccagctactcaggaggctgaggcagaagaatcgcttgaacctgggaggtggaggttgcagtgagccgagattgcaccactgcactccagcctgggcaacaaagcaagactccgtctcaaaaaaaaaaaaaattacactgcatccccactgggcactatactttctgcctgggctccatcacatctttctgacagccttgcacagtgaatatcacctgctgtctccacagctgaggagacccagagccagtgttggaaagtgacttacccaagatcacaaagccagcaagcaaggcagcactgggatgagaacccgcacctttctgagcccatgcccccatactaaccactacaatatggcctctgtgctcatcacttaaagtttttgtaaattctgaatgtgccataggaatgttaagaattgggagggtgggtaggatcatctgggaagacttccctgaagaggagggatttcagctggactttgaaggatttgtggaagcacagaaaggagagagcaacagagattctaggcacagaagcaccctgcatgaaggatttggctgtagaaataaacctggccctttcggggacagtgaagggaagaaacatgcatggagtgcaggccccaggctggatctgaagatcagtccgtggcctccacccttccagcgggcacagtctagggaggacacagactcacggagaagtcacgaccggtgtgatgctccaggggtatctagaatcctcctcctctgctcttggggcaggtgggtctctcctcagaagcggacacagaggcccagcccagtggagggatttgcccagggtcacaaaactggtaggagaggacaggatcatgtgagccaccaggcaggatagccattctgggccagggacttccaagtttttcagatacccacaaaaacacgaggcctgaaaaacaacaaattggcttcaaattaaaaagaaaatgacaaaatagaaacaatttttaaagtttatttatttatttttattttttgagacagagtcttaccctattgcccaggctagatctcggctcaccacaacctccaactcccaggttcaagcgattcttccgcctcagcctcccaaatagctgggattacaggtgtgtgccaccatgcctggctaattttgtatttttagtagagatggcgtttcaccatgttggccaggctggtctcgaacccctaacctcaggtgatctgcccgcctcagcctcccaaagtgctgggattacaggagtgagccaccgtgccaggcctaaaagtttaattacaagccagtaatgtcaagttcattaatttttttaatacttatacacatttcattacattctgaaaatttgtgcattagatttcctccttctcaagtatgggaggtggctgttgagaaatcatagacaatcataaattaagtaacttacttgttgctaagtaattctaatttcaaagggacaatttataaaaatcctgttgaatgtttttgctgcaagagcatttctgtggcaggttgatgcatttgaatatgtttggagagggtgggggcggggagagaaatgagacagctctgatggtggtccaggccaggtggaagccgtgcattggcagtgaggggatagaggtgcatctgggagctacccaggttggggactgcacatagctgccctgctatgggatgtccccaagacagtgatgagttgggctgatgctgggattgggtgcagctgtctcagaggcagggggaagcagctgccagggagtgagcagtttcaggggaagaagacagtttggaactacagatgggcctttctgattctgcctagttcaggccaaagtttcgagaagatgaaattcctagaacttaaaggtggagtgatgtttataaaggaaagagagagagcctatattgctggttacagatgatctccaaattgagtcctaaatttgaacagagaagaatgccagttgagccacgggtgggataggtgacagaagcaaagtttaggggtgggagaccacgctgggctctgtcacatgccagtcatgtgaccttgagcagcaagccacttccccattctgtgctgctgtgtaagatgctgaggttaggttcctggagcaatatcctgtgcgcctcagattctgagaatgcacgagtccttgagtcggagctgctatgattcagatactcagattttaagagctgtgtctctatgatgctttgaaaccctggctccccagctgtgaacctgtctggctgtctggattcattctgtcagcacactggggatggggagtggggagggaagggggtgagaggttctttaaaaagaaacaagggctgagaacatgatgatctgcttccagcagctctcaggcaataaatattgatgtgggaggaattgttcctccacctccctgaggctgccttggccgggtctgcttgcagtaacgtggttggcctggcccaggagggccaccaatgaggagttgaataaaccaggagcaaaggcccaatgaggctgaattggctgccagaaagtccaggcccccagacatgggatgtgtatcttctgcagggcgagagaatgggcaagaggagaaagtgaagggcagagctaactctgaaatctcaccaggcgtcccctcccaggctcagggctcaggggtcccctaaataccctcttagaagtaaatgctgtttttaaaggtatccgggagattggcagtttgtaatacaagaattatgtgcccccgagaaggtttctggcctcagtgtctctatctgtctaatgggcagcagatcagacaaggtctgtcggctctgacaggttcaaggccatctcctctaaatgactcactgtctctggagaaatatgtgagcattttcacaggggaaaagaggggtgcattccacagcccctgccccgaggaggtctgagaaggtgaaggaaggccagatgcagagagacagggaatgacaaatgacagctcagatttctcccatggccatgattatgggattctctgcctggggggcagggggcaatagcagtccccacagagaagagcaggacatgggattgggggaggccatgcagggaatgggaggggacaggagccctactttcttgcctttggctctgtccctgtatctgcggcctcagagctcaggtgctaccaagagaccctcacaggagtgacccaggacaggcctcacctccctctaggcctcagtcttcctgtctacaatcagccagtccccaaggtcctgctaggcccatggactcctggcagatggctctgcagggtctgtggggtaaagatggtctcttgagggctccctgacagattcttcgtccccatctgtccctgtggtagtggtgctcccattcagccagcaactctcctgggcccgccatgccctctggtccttctgacaacctgcccttgggactgggtcaggggctcagaggggcccagagagctacttcctggcaggcaagcctgtgccatgaggacccctgtccctctccaggctctgagcaccaccggactctgtgaccatagagaccaggagtctgtttgtctgttatttctggaatatgtctgagaggttgggattctaaaattatatggttttaaagtctgtgttcctaatagagcttctcaagtacttacattatgctaaaagtctgtgcctcgaatggtctatgactccccaaatccacatttctaaatggctgcaattttggctaagagtctgtaagcctgtgatgtccactgtctcccagtcgttaacttccatgttcttctttgggagaatagtcagggatggaagacaggagtgtgaggtggcaatggtccttaaaacccaggacttagggctggtctgtagggatttgcccagccaggaggcctccatttccctgggactttgtgtctccgtggcagcatctgtgagttctgaggtgcgcaggcctcctagtgcccagggcctccactttgcaggcacagcgtctagaccctgctgcatctcactgacggagggattggcccatagagggttaaagacctgtccagaggttggacagcaccacgggcccttgcacctgtctgtacaaagccaggtcctggcgccagagggctgaggaagggctcccctagaccaccaggtctgcacatagagcttcctttaacatcgacgaggcttgaggccctgttggggcaatctgcttgagtggtttttcgaattgaacccccagaaccccaagggtaccaccatagggaggaggaggaggggcatcaccgagcagggctaagggccttccacccctctacacacacacacacacacacacacttcagtccaagtagttctactattttgtgtttttatacctgtctaaagactaaatctaaagaataagatttcagttgggaaaagggttctgttcctaaaaaccagctgagctagtccaatactgccatttgtcagaggaggctgaggctaaagaagggatgaaaggtagctgatcatgcccaagaggcaccatgcaagcttccttggtgtctaaggcatcctgcagtggcagggacagggctagacatggcaggggttagacacatgtcatgctggaggcctgctgacttcagtagggatggcaccatgctcgaggggctgaagaaaagacccggagtgagcaaacaagacatagggtttattgagggaacttacatacagggtggtccagtggtggtgggctggacagagaatcactaccatttgtaaaaaccatgcaaattatatggcaccctccacctggcaaccttcacttaacccaaaacaaagggccttgatccttcatacagcctgtgtttcatgggatgagccagaggttcagatgttcttcataaataagaaatgaatttctgggttggccactcccagattccttagctcagaactccaaatgaggctgggtgtggtggctcacacctgtaatctcagcactttaggaggctgaggcgggcacatcacttgaggtcaggagttcgagactggcctgaccaaatggtgaaacccgtctctactaaaaatataaaaattagctgggcatgatggtgggcacctgtagccccagctatttgggaggctgaggcaggagaatcactagaacctgggaggcagaggttgcagtgagccgagattacatcactgcactccagcctagacaacagagcaagattccatctcaaaaaaaaaaaaaaaacaaaaaacaaaactccaaacgcaagttctgtttagaccaatcattctcagggtatgcttaagaagctagtactgtcaggtgcgtctaccatgcaatatggtggccccaccataccagccaggctctgctacttactaattctgaaatctgtaaaatgggtataaccataacatctgcatctcggggtctttataagaatgaagtgaggcaaagtggtgaggtgggcagttcagtgccaaagcgcaggcgcagtaaacaggagtgcttgttcttggcatctttctccgagcaggccagctcttaaggggaaaactaagagaaaaagtgccttttttctaaacttgtatgcttttcctttttacatgttttttaacttttttattttttaaatttggtttatcaactgacaagtaaaaattatatgtatttatggtggaacatgatgttttgatctatgtatgcattggggagtggataaatcaagctgtttagcacatgccttacctcacttacttatctttttgtgtgtgtggtgagaacacttaaaacctactttcttagcaatttgcaagtgtgcaatatattgttattaactggactcatcatgatgtacaatagattgcctgaacttatttctcctgtctaactgaaattttgtatcctttgactaacaacttgctctggtaacttcccttctgctttttgcttctatgagtttggcttttttatatttcacaccaaggtgagaacatgcagtatttgtttttctgtgcctggcttatttcacttaacatgatgtccttaggttcacccaggttttcacaatgacaggatttccttcttttttaaagccaaatagtattccattgtgtatacatactacattttctttatccattcatccattgatggactctttggttgaatccgtatcttggctactgtgaatggtgctgcaataagcgtgagagtgcagatctctctcctttctttcatttaaatacattcttttatttgaaaatttgtgttttttcattttctttttaaaaatgttttcatttttaatttttatgggtgcataggtgggtatgtttattggatacatgagatttttttttttttttttttttttttttgagacagagtctctctctctctgttgcccaggctggagtacagtggtgcgatcttggctcactgcaacctccgcctccggggttcaagcaattctcctgcctcagccttctgagtagctgggattacaggtgcccgccaccatacccagctaatttttgtatttttagtagagacagggttttaccatgttggccaggctggtccccaactcctgacctcaagtgatccacccccctcagcctcccaaagtgctgggattataggcttgagccactgtgcccagcctacatgagatattttgaattggcatacaatgtgtaataattatatcagggtaaatggggtatccaacacctcaagaaacaagaaagaatttatcatttcttatttctttaatttatttttcaatgtataaccaatcaatagaatgcatcatttctttgtgtttcaaatgttccaattatactctcttagttgttggttttgttttgttttgttttgtttttttgaaacagagtctcactctgtcacccaggctggagtgcagtggcacaatcttggctcactgcaacctccacctcccgagttaaagcaattctcctgcgtcatcctcccaagtggctgggattacaggctccaggctccatgttggccaggctggtcttgaactcctggcctcaagtgatctgcctgccttggcctcccaaagtgttggggttacaggcgtgagccaccacacctggccctggtccctctcttagttatttttatttattatttatttattttgaaatggagtctctctctgtcacccaggctggagtgcagtagcgcaatcttggctcactgcaacctctgtctctcgggctcaagtaatttgcctgtctcagcctcccaagtagctggaatacaggcatgcaccacaatgcctggcaaatatttgtagttttagtagagacggggtttcgccatgttggccaggctggcctcgaactcctgaccttagatgatccacctgcctctgcctcccaaagtgtcttagctatttttaagtgtataataaatccagctctgtctctgtttaatatactgatttcatttcctttggatatatacccagtagtggattgttagatcgaagtttctatttttaacttttgggggaaactccatactgttttccatgatggctgtgctaaattacacccctaccaacagggtgcaagtgtgcccttttctccacagcctccccagcacttgttatctatcatattttttataatagccattctactctattttaatatattatatggtatctatacacattcaggtgtgagatgatatcccactgtgtttgcatatgcttttctatatcctacttgcactatagtctataaaaggtttgagacagctcacaccacacaaaggtacagtactacaacagtaggaattaggctaacatttattacttactctgtaccatgcaatgttctaagacctttgtatggatgatctcatttagtccccataacccacctgtgaagtagatatagttattacccccatcttataccagagggacttgggtaacagagattaagtaacctggtcacatagctagtaaatggtgaaaccaatcaattaaggctaaggagcaggaaaaatataaataagagcgaaaggttctcagaatgagagagaaaaacataaatgcatggacccataaagattaattcagttgataccattgagccatttatttggttctgaggtttctggtagcccaaagggaaaagaagcatggccagtggcatgaatctcattaaaagaaagccagggccggttgccgtggctcacacctgtaatcccagcactttgggaggctgaggcaggtggattacctaaggttagaagctcgagacctgcctggccaacatggagaaaccctgtctctactaaaaatacgaaaaattagccaggcatggtggtgggtgcctataatcccagctacttgggaggctgaggcaggagaatcacttgaacccgggaggtggaggttgcagtgagccgagattgcatcattgcaccactccagcctgagtgacagaggaagactctgcctcaaaaaaaaaaaaaaaagaaaaaagaaagctggaagtgtgtttcattcttcatggaaactcagctcttgctgaaaaacactctctttcatggggtgggaggaagttaagcagatctctcatccctgtggctgcttcccttcgtgatatgtgaaggaacccgaggctggcagagggttccatatcaccccagagtccacattggctctgtgggtcagggaccctagcccctggacaaagccttcttttaataggaacttagttctcaccaaggatagcgcctggatccctgggggcccagcagacaggagggccttccatgggctgagctacacacagcacatggtgtccggcaggcttgcaacaatcagcaaagagcccccagaggggaagttccagcagccctctccatccagggctgctgacccaggcaaacacagcccagatgggtcacactgcaatccctgcactgagcagaggcacgtttcctgtttctggagcccgttattactcagctgtcctcaaaacagatgagggggcaagcggcagaaatctgtggagaacacagggtcaggagctaaggacagatagggctcccaatagccacagaatatagcccaaatctcagcctggccttccaaaccacccgagtctggctgtggcccatcttttggccccagcccctaccccagccaagcactgctgtaatcaagttggtgtccccactgtgtcctgcacaagacctccaccaccgtgcctctgcttcaaatctgctctccctttctatctacccaaaccccaaagctcacttctccctggatgtcacccctgaccacccagcccctgaaggtctgtcactcccctcctgttccaaaccccatgctctttcacagcaggagacaggactgacacagggagactagagaacctgggtttggtttgagagcctgctctgccaataactgtctgggtgacactcccccttttggggcctcagtttcctcttctgtaaaataggtgcaataataatccctgcaccagacagaccattgtgggaattaaatgacatgatggatatgaaagtgcagtgtagctgggcgcagtggctcacgcctgtaatctcagcactttgggatgccaaggcggccagatcacccgaggtcaggagttcgagaccagcctgcccaacatggtgaaacccagtctctactaaaaatacaaaattagccaggtgtggtggcgtgtgcttgtagtctcagctactcgggaggctgagacaggagaattgcttgaacctgggaggcagaggttgcagtgagctgagattgcaccactgcactccaatctgggggacacagcaaggctctgttaaaaaaaaaaaaagtgcaatgtagaccaaataggaatgtacacgtgggagcagacgacattgtggttgtttctactctttatgagaacaaggaacccaagcaaggaactcagaagattctgcttaccctgccccttcctgataaaaaatgttgggaagtgatcagtctgtccccaggctgttctcctgcttcctggggcagccctcactccagcactctctctcagctgtccaggaccctcccaccactgtggcatccctcccagatcactctcccagagctcagacgggactcagaaaggagcaaggattcactgattctctttaaggcagcatgtccaaaagaaatgttatatgaaccacatatgtaattctaattttttttgtccacatgcaaaagtaaaagaaattaattttaataatacattttatttaaaccactatatctaaaatattcttattttaacatataatagtaaaaaattaatgatgaaacattttccttttttcatactaagtcttcaaaatgcgatgtgtattttatgcctacagcacatctcaatttggactggccatatttcaattgcttagagccatgcgtgacaggtggctgctgtatgagacagtgcagctctaaggtataaatgaataatccacgcaggctgccttacccaaaaaaataagacatggtaggatttcagtttccttcaaatcacaccacaaagatgcctcctaattctccagtcctgcatcagggctgtctgactcagggggctagtggataaagtatgagttgttttttttgagtcaaggtgttgctctgtcacctaggctagagtgcagaggtgccatcatagcttactgtagccttggactcctgggctcaagtgatgcttccacctgagcctcttgagtagctgggaccacaggtgcatgtcaccatgcccagctaattttaaaatttttgtcgaaatggggtcttactatgttgcccaggccagtctcaaactcctggcctcaagcaatcctgctgccttggcctcccaaaatgctggaattacaggtgagagctcagtcaaggcatgagttttctactcaggcaagcttgagctcggatctgagtcctgccactctctagttatgtgatgctgaacaagttgcctaccttcagaacttgtttgctcatgtgtgaaggagtgtaggacttgccggcaggtcccagtgaagatggagcaggctcatgtgtgcgtagctaccagcccatataccagtggcctggcatgtcctggaaaggtagttccgctagagctggtgtgctctgaggaccctttgcctgtctcggaaccatcagcagttcaagaactccctggcggcatgatggcatctcctcttgctttcattttttcccccaaaagcctggcattggctatacccacttctggttagaaccatctcttgcgctcctcttgcaattgatatttactagataaccactatttcgccccaggctcttgctaggcacaagagtttgaacagaaaacaagataaacatgaatcctgctcttgcagagctcagggtccagcaggggagaaagatgtcaaataaggtttgcctcagacctaaagcatgtataaaatagacattctttattttacttgaaaatcaacttaatttctactctgaatgcctatcctgccagatcatcaagaaattcaatctcagcctttctcagagctctctgaccaaggtgaagcaaaggtcctgtgtcttacacagtgctcaagcaccagggaggcccccccagcagacatcagcatcagcccactgtggtcactatggtgatgcccacttgccatcctggcccatatggttcccttaccatgcttggagcagagtcttggtgaggctgggaacctaggagcccagcctccctaagtcagcctgcatcctgccacttggaggtgaattgcttccgtgggccctatctcagagggtacgtggctcctcgctgctcatggaacccacagactgctctgtctctgccccatcctcttttccaggctttattttagggaagatggtattcttttcctctcatcctcagagcctcccccctctactcacacccaccacaacacccagcagaatcttctcaagggactcaagctctggagacaaaagacaggaagggaaatcttgcaatccattactgttttctgccatgccacaaacatcccctgaggacaggaaacctagagcctgctccctgctggaatgaaagaagaaagaagaaagggaaaaaaagtccaagggaacacacacatgaattaatatttgaatgaatcgtcctgctgggacaggccagccttgagccagccagcatcaggaagccaggttggggaggcatggaacaagggaccccccaaggtggtggctgacatgaaggttctgaaatgtggggaaatccagcatttgcctcatgatgatctcagaaaaaatgagatgggagaagaaagagaaagtgtcagacccaaccagagtgtgagtcctgtaggaacctcacaggcaacatgggaagaggaggcagaaccaggaagcccaaatgagtgctctccagcccagcaggtccttccctatggcccatggcatcctggccctggacgtggggaagccttgcctgcgcaccactcctagttacagggagctcgcttcctcccagggtagcctcttccaaactgctgtccccattgggtataagtctctttttttttttttttttttttgtgaaacagggtctcactctatcgcccaggctggagtgcagtggcatgatctcagctcactgcaactgttaccagaaaggagtctgaatccagaccccaagagagggttctcggctctcacacaagaaagaattcggagcaagtccatagagtaaagtgagagcaagtttattaagaaagtaaaggaataaagaatggctactccataggcagagcagggtgttcccgaaagtaagaggaggaacgcgtccaccctagctacaatacatgtttatatataggatgaaaaaagatcatggggagatgtgctctgctacaagggtttgtgatcaacgattttcttaatcactatattttgcaagaatcgatattattatatttaaagcaaaattagaaatgcttctgttctccagacatggggctatcaggacactcctaagtctgggtctctttagtaaacatgatcaatctgttcccttaaccataaacatctagaggctaagaatgcctgactttctgggaatgcagcccagcaagtcccagcctcattttcctacccctcagtcaagatggagttgttctgattctaacgcctctgacaaaatctccatctccctggctcagatgatcctccctcctcagcctcttgtgtagctgggactactggtgtgtgccaccacacctggctgattttttttttttttgagagggagtctcgctctgttgcccaggctggagtgcagtggtacgatctcagctcactacaacctccgcctcccaggttcaagcgatcttcctgcctcagcccccctagtagctgggattacaggcatgagccaccatgcctggctaatttttgtatttttagtagagacagggtttagtcatgttggccaggctggtcttgaactcctgacctcaggtgatccactggcctcaccctcccaaagtgctgagattacaggtgtgagccgccacgcccgactgattttttttttatttttatttttagtagagacaaggtttcgccatgttgcccaggctggtcttgaactcctgggctcaagcgatcctcccacctcaggctcccaaagtgctggaactacagccgcgaaccatcacacccggcctaggcataagtcttcttccagctaattttttgcttttaattctgacctcagcctacatagcaaaataactaaattacactccacttgcccacttgtattcagatgaccctgtgcccatagcaacttctccaagattttgtttcctcatctaaaaagtgtgcacggtaatagtacctgcctcacacagttttgtgttagagaaatgtaggtagagtactctggggccttggccttggttgcccccttccttcagggtgtaccagtgaagtgctcaggctctggagccaagccgtctggattcaaatcctagctggaccacttattatctgtgtgaaataagttgaaataagttattttctctctgtgtctcagttttatcacctgacaaaaagggattattatggtatctacttcattatttaaaaaatgatttttgactcttatttccttctccaagttgttggtagggacgtatatacttcaggaggttgtgaggtttcggtaagttatgcattagtcattagaacagtgcccagcatacagtaagtgcttagtaggcattaaccgttatttatcattatttcctttcttatttctgacagtcagaagatggtgattgtgccccctccctccacacacatgatattctcttcccctctttttcaagagttgcacatgggccgttcccacccaggtggagggacatactccagggtgtccatgggaatcttcacagcttggacccaaagctgagcccatcctctgggtgcggcctgattcatccaagaggagcagtgacagtgggagtgaagattgactggattggtgtgttggtgttttgggtaacattggtggtgatgatggcagtggcgatggagatgaggctggtgatactgatcttggtgaagacagtggtagtgatgatgatgttagagacagtgataatgatattgatgattctgatcatcatcatggtggtagtgattctgaaggttcaggtgacagtgataatgatgattgtgctggtggtggtgatcatgacagagacaacaataacaatcatcacatcgtgatggtaatgtcgtgactaaatttgtcatttagtcacaacgatatgggtgatgtgaatgagggtgatatttaagctgaaaggaatagaaatgatgatgatgattatggtggtgattttcctaaaaatgttggtgattattatgatgttaatagtggtcatgacaactaacccatgtggatactggtgatgacaaagtttaaccacaagaattttattcatcctttcaaaaccacttgttgggtacctatagggccaagaacaaatggaacactgcaggcctcaattgctcctgaagagatgacagggctctcaccctctcctctccaagacctctcctccccagcccacagccaactctgagtggggttgctggcatccagcggactgtccttggttttgtgtctccttcagggcaaggactctccctctaagcagagccctggggagtccacgaagaagcaggatggcctagtccagattgcaccaaacctgactgtgatccagttcattaaaggtaagtcagctcagaccaggttatggggagccagggccagaggggtcttcgagattgtcaggatccagtccttcctgcttttcttgattcatcttctctacctgcagacccctcatgagcaccatctactccttgtgagtctttgcacatgcaatcctctctgcctggaccatcattttttattgctttcaaaaccttccctatgggccaggcattgcggctcatgcctgtaatcccagcactttgggaggccgaggtggacggatcacttgaggtcagaagtttgagaccagactggccaacatggttaaaccctgtctctactaaaaatacaaaaattagctgggcatgatggtgggcacctgtagtctcagctgcttgggaggctgaggcagaagaatcacttgaacctgggaggcagaggttgcagtgagccaagatcacaccactgcactccagcagacagagacttcatttcaaaaacaacaacaaaaaaccttccctatccgtctaggtccagctaaaaacccactactttccccacatgtccagctcttccagccagcaaagccacttccttccctctttggttctcagaaccctcagggcttctagatcagttcagatctgagcctgtgttcctgaaggtcaggcctgtgctggctcatctatgacccttcctctcctcccacccactgctgagcctgcaaatgggaggccatcgggaaattgtcaaatttccagacagtggcatgggcgaagagagctctgggctaatatccagaacctgggcttttgtccctgatccctgctcctttctgggcctccgtttccccatctatatagccaggagtagactcaatgatctaacgtcttgaggctatgatcctgagactacgaactcagtctatcagtaaccagagtacacattatgaccaggccattctttctcaagattatgaccccaggagcattgattgagtgcctgccgtgtgcccagctcttacagagcactggatggcaggtcagaagacttggatttgagccctgcccctaacagtgaccagtgtataatcttaaagaagttagtttccttttctaaattgagtttcctcatctggaagattgggtcaataatccttgctctgcctgtctcaagggctattacgagaatcaaatgagacgaaacatggaaagcctctttatgctattaaaaaaaactgtacttatatataaggtacaattatttcaattattactcttgttccaccgttattctgaccatgccctaggatagtaaattgagctgcctgtggtttaggagggcatgtccacaggagttgcctcatagtccttactgaggatttctgcaacaggaaggaattaggcctattcttgggaagagcttcctaagatttgatgttggggcaggacatggtggctcacacctgtaatcccagcactttgggggaccaaggcaggaggacctcttgagcccaggagtttgagaccaaccaggacaacataaggagaccctgcctctaaaaaaataaaaataaaaaataaagaaagaattagccgggcttggtggtgcatgcctgtggtccaagctactggggaggctgaggtgggaggattgcttgaacctgggagtttgaggctgcaatgagctgtgatctggccgctgcgctccagcctgggtgactgagagaaaccctgtctggaaaaaaaaaaaaaaaaagacttgatgttgggatatcagtaatctagcccccagttttttcagcattcccagggaaagagagggcttggactccatgcatggtgctgggcctagacgcagcggccgggactccctagcctcaggccacccccagatgctattaggtccccggcactctgcgctgctgaattgcttattaatcactgtttgggcttctgcccggagggaagcttctgaaattggaacctagagcaagtgttctaggccagattgtctctggtggtttcagcttctacatgagcctggagggaatcagggcaggggtgccctcaggccctgtggctggtgagccagcctggcttctgctgagctccaggggccagtctaactctagggcctggccttgaccacctggtgtcacagggaaggccgagggaggaggaaccatggtccttcagctggaggtgccctatactcttggggaaagataatccctgagctaggaaaggcccctgtcagatgggggagacagtctctgagctgggggaagcccctgtctaatgtgagagatacaatctctctgatggaggttacgtagtccctgaatggagcgagaccctgccttgtctgatggaagagacctgacctctgtgatggagaaggcccctgtctgataagggagacgtagtccttgaactagaggaggttcctgggggagacattgcccttgagttaagggaagcccctacctaattggaagaagcatagtccctagactgagggagaacctgttctatttgacagaggatacctggcctctagctgggtgaggctcctggctgatgaggaagacagagtcactgacttgagggaggccctggcttgtctgatgggggagacactgtgctgtgctaagggaagccctgtctcatggcaaaggtctgcctcagagctggagatgggccctggaattcccctgcaggtagacctatctcagtgaaaggcatagcctctgccctccaggaattttccatctattccggtgccatgctgtggatgctgaggagagatgggggatggctacaaagcacactgcagtgatcagtgcaggagaatggactggaagcaatccatgagatggagccctttggagtcaggcagccagagaggcacaggatgggggagggaggatagaagggaggatggaccttgtactaggagccaggagaccctaggaaactcctggccttaaactggcctctggatgaacttgggcgagcccctgtccctctctagactctaccatgcagtaggggcacctgtacaacctggaccatgccagattgaaattcatggctcaatataaggcctcagatgccctggccagagcagcttatggcaagaaggctgagcagctacctggggtcagagcgagcctcatacctcttcactctaatgctagttaaatgcatggtgtgcagcaaggaaccagggacaggaggcaggcctggcacagaaaagagggggaattccacagcccccacccaccgtcctgaactgtttgtttttattttctggttcccaaggaaacagatcctagcctggcccagggggctagggaaccagctggcttggccctgctctgaggacagacagaaatcttcccatgacagaggccctggtcctgctgctgcaggaacagaaggagcccccacctggcccagagaatccccatggccctaccagcccagccgggcaagtgttttgctcctctccctccataccttatatttgacttcagtcttgcctactgcaggcagaaacacaggttagtggagagaggatttcatgtgtctaacagaaaatgtccttgacactttcacctgggctgcccctaccaatgagcatcacttggctgctggagcccagagaggaaaggacttacccacccttttgtgccctttggtttagcagacttgcagtgggggcaacctgtgaatgaggcaccattttaggagctagcaggagactggggaggtaattttttgccaaaacagtcactttttttcctaactccaagcatttgcccctcctgggcccctactcaattccttttcctcctcgctttacctccccagatcccccccaccattctttaggccctagctctgtcccacctccaggaagtctcccagcaccaagcagactcagatttcactttctctggaggtctttgattctgccccagacatattgacatttgatcacatattagtccatatatccattcattccttccttcattccatgaattcaggtgcctcctatatcccaggctctggagatttagtaattaacacaacaaacaaaaccccctgatcttttaaagaaggcttacgttctggtagggtgacaataaaacagctagatgagtgagaggtatagtacgttaggtagagggctatggagaaatgcaagctaaggatagggaggtcagggcagaggattggggcctgtgtttgggatgcgaaggaggatgaaggcctgggaggcttggaaaaagctgtagcaggacaggatggaaagaactgggtggggcgggggagaggaatgaatacgtagagtagaaaaaatgaaatgacatgggatgggatggacgaaattgaatcaaataggatggcatgaaccagaactatatggaactgaatagaattgaatggaagaaaaaaacacatcaaataagatatagtctaactcagtggaacaaaatgaaacagaatttcaaaaatgaactggaacaagggccaggcatagtggctcacgtctgtaatcctagcactttgggaggccaaggagggtggattacttggggcctagggttcgagagcagcttagccaacaaggcaaaacccatctctactaaaaacacaaaaattagccagcatggtggtgcacacctgtagtttcagctactcgggaggctgaggccgagaatcacttgaacccaggaggcagaggttgcagtgagctgagattgcgccactgcaccccagcctgggcgacagagagagaaaaaaaaagggactagagtaaatggaatggagtcaagtgggataaaattgattgcaatagaattaagtggaatggggcgggttagaagaaatggaactgcttgaactgagcagggcaggagggcagtctctgctggacagcttggctgccctgcctgccctgacctctgcactcgcccccacagtcttccccagggtgctgctgcagaccctacgccaccccatcttcctgctggtggtcctgtcccaggtatgcttgtcatccatggctgcgggcatggccatcttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccaggtgagtgtgtgcgtgggcacgtaaaggcaagcctgggaggacaggacagggaggacaggggccctgggcagaggccaggatggcagggcaacccctgcctcaaatcttgcctccccagttctgcttaacagccctttagagattcgagtcaagcagtggggtgctccagaaggctccagggtaggtgtcaggcaccactggaaggggcatggatgagacttcaggggcagaaactctcaagcccaggagggtgtggaggctgagatagggcagagccacccatgggatggcatgtccagggtgaccaagccctgtgggcccaacagagatgagccagaggctacatcacaggagccaggacccagctcagccagaggaatggcctgcccaggaggaagcatgctctccatcctggggacgagaggggatgagagggtgagcaagggactggatggcccctatcagggaggctgcagaggggactcaggcactgggaaaagattggacagcagacctctgataattttgggttttagagcttgggagctaaaattctgatattccacgactctaaaattacagaattctttttccacatctgtgaggcagcacctgcctctgccctccgggaggaagtctcttgatttctatctctccaattctccctcacacctttacccttgggagccttcttggagaggatgttggaagtcacattcctgcctcttctccagaatgatttcatttttcctggaaactgctccaggcttaggttggcccaacactcggctagaatttcccaactttctctgtacccaccccttccttggcatcttctgcctccacctaggtgccagctttcatcaccaggggtcctcctgcatggctgtcgggggctcagctcagggccaaggagcacccagcccctccccgtctgtcccaggtcccaccctcgctgatctctcccccatctcccctccctcctccccctttcattctctgcccctcttttcccacatagggaggcaactctgctctctagcctggggcctcctgtgtgcggagccttgttctaggcactgcagcgggggtttagccacctcctcaggaagtccctggtctgaggagggagccaggtcctcaatcaaatgatttttagagtaaaaagtaaatggatattttatcacaattttttaaatagtgcagaaaaagtcagctcatctcacacaccccatctctcttttcttctccctttcacaccttagctttgacatctcatgtcacctctgttctcgtctaaattcttgcgatttattcactaagctctgggttctaattcactgaagagaccatttgggaccaactgagctaggcaagaagaactttccatatttctgcacaaccgcaggtactaacagctgcaagaaccgacggtctcccttcgctcagcgtcttcccacgttacctctcactgaacccccacaggatctctgtaatgggtcctgttattagccccatttcacagatgaatacagcaaggctcagagaggtgaagtcaccccacagctggaacagggtagagcctggagccaggactctccccacagaagcaatcagctccaggtggtcaatgacagcgaggagcggaggaaggactccctagctcttatctgctcagctttccagctgctagcagagggttctgggaagtgcttcacccttggcagagtcccctggcactgcctcctgatgggccctcagctcagacagtgccagccttcccactcccacccccaccccgagggagatgtgccaagatgttgtcagacacacacaagcactgtctggcagaggaggaagaggaaatattttgtggctgatgatcttccttccctctctgatagagtgccccctcaccccagggagggagaggagctcactttgccccatgccccacttccccactccacaccctggctagagactgtctccagctcctgctcaccctcttccccatggaactgacatttcactaagctccagtcccagcctcactgatcatcctgggcctctgccccacacccaccccaagcccaagacagggacatccagcttccgcctttggcctcctctgcagcctggccactggacccctgtgtgaccctgaaaggcgcagcctctctgggcctctgtctccctggcaggttagctgtgctccccgctagcgtgaagccaggtgacactgtgagtcccaggggacacctccctgccctcctcccagggtgacctccccctcagactaagcctccctctgacatcctgcccctgcccaccttcaccttgccctggccacctggagctggggcaccccagggatttgggaacaggcccttggagggaggcaagtgggactaaaatgtgccctggacacagtgaacagggtggtgggagtgagactgcaggatggccatgacaggcagagaaactgaggcccagagaggcaggaacaggctggagatcccacgggtggtcaggtctcctgatcgggtcccacactcatagctctgattttctgagaaatgaagcaatcattgattttcggagaaaggaagctgattgagggaaagatactcctcatctgacactaacttctgggaggaatttatcttgtataccctgtagaagggtcactgaggtgcagagatgtttgaagaagctcaaaggcttgtaggattgagggggcctgtctccatacttgcccaccttcattgcaaggagctcactatcacgccatcatcgggcagccctgatgatgaaaatcctctgtgtggagctgaaatctctggccattgctctcggctacagggccgaggatgccccagctagtggcctaagggagggaagccaggccaaccctactggtcttctctcccaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggtgagtcaggcctctcgtggcaacctctgcccctcaggactctgcctgccctgtctctgtgggcctgtcatactctccacttctgcatgctctcactctgtagctctcgtctctctgtctctctctgttggcagatgtagaacattattctcacaataagctttcactggccaggagcagtggcttatgcctgtaatcccaacactttgggaggccgaggcaggcaaatgacttgaggtcaggagttccagactggtgaaacccatctctactaaaaatacaaaaaattagccaggcgtggtggtgtgcacctgtaatcccagctactcaggaggctgaggcaggagaatcacttgaatccgggaggcggaggttgcagtaagctgagatcatgccattacactccagtctgggcaacaagagtgaaactccatctcaaaaaataaaaataaagctttcattgccagcctgggcccagggcacagaggtgaatcattctggcttccagatctctgtgcaggggagatgcaaaaggaaagaactcacaggaattccagaggtgctgataggtaaaacaactggtccctacaagcacatacaaagatgaaaagagacacatcccacctgggtggggttgggtcccagaagccttcatgggaagtggcatttgtgccagacattcaagaatgaatgggtaaactattcatttacttgggagggaagggctttccaggcagggggaaatgcgctcagcagagatttgaaggaacacacatgcgcaagcatgcacacacactgtttctgttggagcagaagcacaagggttcatgaagggaaggcagggcccagaaaaagaggggccttgaatgccaggccaagagtggggactttctggagagcagtgggaagccatggatgggttttcagccaaggagtaacaagttcagatctgtgtttgatcacgcttgaggccatagtgtgggggcaggtgagcagagtacaggataggacacagaaggctagcgagcattcagtcagtcagtcagtcaacaaacttcactgatctcttcctctgtgccaggccctgttctgggagctgaggactcagagccaaggggcccagtggggaaatgaaggcaatgtaatcagcagcagtgcattctgaatcttaggagggctaagaccagccggttcctcctcccctttttcctcagttccccaaaatgacaaagggggacaatgtctgccttctcaggcccccaggctgtagtgaagcttgggggatttgtgggggcagcagcatcaggctggtggttatgacaacatctccctctctccagagtcctcccacctcccaccctcatgctgggcatcagcatctaaacctgaggctcctccagggagagacctgggctgcactggctggtgcagaagaacctgttgatggtgcatagtccttcagaagccagccaggcaccacctgggcctgagagcccttccagagacccccaggccttggcaggtggagcagtgaactcctgtggatatgggaaccgattcaaatccttcttaggcctctaactgactctgttaccttaggcaaattatttaactagtgcctcagtttcttggtctgtaaaataggggagatattattaagtgcctactacagagcaggaatgtgctgaataaatgctttacctggatgaattcattaactagtaagcaaagcgccacataacgttatccatgaaagcacatagcacagtgcctaggcaattttaaatactcagtaatacacatttctattacgcccattgtacagatgagaaatggaggcccaggaaaggaccagacattgcccagagtctcaataccagggctgggactaggcaccaaggccctggcctcccagccagccccctctttggagcatcacggaggcttggatttaggtgcagtatttggaggagggtgcagctgagaccgggccagcactcagggactgttgtcacactggcctggaatcgtgtcttgacatgtctgcctccttggattgtgaacatcttggctcagggatgggtggctcagtgcccagcacagctgctcagtaacagcttatgagtgcatgagtgaatgaggtaaggtggggcaggtgggcgcctgaacaggtgtggagctgaatgctctgggggaatgagactctgaggcagcagaaagattgaagtcattcataagaaaaacttcctgccatggaattagatgaatgtgaagggtcaggaaaaacccaagtgaagggtgaggaaaaacccaagtgaagcctccagcctttgcgttcatcctggcaacctctgcttctgagaaaaggagcaggggcaggatgcctctctcccaggaaccttgcttagcatttccctttcttgtccctccattgtatctccagcctgtagttggaggttcaggggccgcttttcctgcagtgtaagatgatatgcacttaggggtcacacagcttgtgtgaagggtcttcagacccttgtgtgaaggatcagcacagcttcatcatgtgcattggttctgccggccagtggagagtgcctggtcacccaaccctaagtgctcacgtgctcactctctcttgcctttgtctgattccacctgctaagtaacttcaaatctaaacccatttatccatccacccccaagcccactctatgatgggctccttggcctgcctccccgatctggtccctcctccatgcagctcccagaacaccctttgtaccacccagtctcatctaccccttgcttaaaattttcccaaggcccccagcatccacctcagggattcccaacccttttcacactgggaagtgtctgcagctgccagggctggaggtgagaggcccagagggctccagctgtccaggccagccagccacttcaagggttgatgggactaatccctgcacacctgtctcccatctgaggccctgtgtggctggggcacatgagtctagaagctctggtctatgggaaagcaaagagaagcccaggcctcttggcttgggctggcttctatcgggtgcctgtgagccctggcagtccagatcacttcgcagagtccttggctggaggttttcctcgctacctagggagtgagtgcaggctgggatcaaacactccagggggcaagcccggggacatggccagcctggggatgttttcttacagttggtgtgtagaatgtgggggaatgatgctctcctggctccctccctcttcttctctactttctctctgcttccctctccctgcccaccacctcagcccaggctcaacttgcacatagacagcccttgaggtgcctgctcctcaagccgtctttgctcagccaacgggtcacgatctcggactcccagccagctctaccccaactggctgtggaacttgggcctctcacaagccttccccgctgcaagcccttggccagctgcctgcccttggaggctcttgaagtctcttcctcctcttcccactccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaaggtgaaggtgggggtggggcaggggcaggtggataccaggaggtccttaaccacaggcagaacaaggaattccaaggacggagttcaagaaaggaggccacttgggtgtcctggcccccacaatatggccttaactgtgttcatcccatggcaacctactgaggcaaggttttctccccatcttgcagataagaaaattgaggctcagagaagttcaggagctggcccccatcacatagcaagtgttgggtggaatagtactggttccctggcccacagcccaggctcctacttgcccaggggagaggaggacatacctagggccctgtcctggcctctggaggtgagggcataatacctgcaatggatgagctgcaggaggtgcatctaggaaaccaaactgtgtcagtctggtgcatgactctgaatgctgcttcaaggctacatacaagtgcttattaggtgcccgctgtggacccaacccatgctgagcactgccttttgggccaagatctttgtggccctcgtcctaagaatgcctgctggccctgacaaattgtcacctgagttcaaagtcagggtctcctggggtgagggctgggataagaggactgagtgagaaaaaaatagtttttcctttttttttttttttttttttgagatgcagttttgctctgtctcccaggctggagtgcaatggcgcaatctcggctcactgcaacctcctcctcctgggttcacgccattctcctgcctcagcctccctagtagctgggattacaggcacccgccaccacacccaactaattgtatttttagcagagacggggtttcaccatgttggccaggacggtctcgaactcctgacctcagtgatccacctgccttggcctcccaaagtgctgggattacaggcatgagccaccacactcggctgagaaaaacagtttttctattctctcactcaacaatcaacacagaagacttctgcaaccagaagtgtgggggtattttcccacacaccaggcactcaattaattctgcagtggaccctagccagtgtcccccaattctattctgacacaatctacctggagacagcatcagatcccacaggctgagtgctcagtcccacaagactttccctccacttcccatgccaaccacaagcctcaggctgttttaccaatgattctgactgaccagccgtatgctggggtttccacagccccatctttgagtttgctttatttgctagagtggctcacagagctcaggaaaacatctacttaatgtttatcggtttattataaaagatattacaaaggatacagatgaagtgatgcatacggtgaggtatgggggaggagctttcatgccctccctggctgcatcctgcagggacctccatgtgttcagctatccggaagctcgccaaagcttcattatgtaggcatgattgattaaatcactggatattggcagtcacctcaaccttcagcccctctccccttgctggaggttggggctgaaagtcctaaccctctaatcctgccttggtccctctggtgaccaagccccagcctgaagctactaggggctgctcaccatcaatcaactcattagcatacaaaaagacacttttcactttgaacattccaagaattttaggagtgtatgccgggaagaccaaatacacatctcacaatatcacagggacctcagagcaagataatttccattttccttctcctgggattattttattcactatctactttctaggaaattagaagggaaatggagcctcttgcaaataccagaagacatgtagatctagaacacaagctggcctgggagagaaaatagaggaatcagatgcccaacaggcagcctgactaaaaggagttgagaacacagcctcagggctgcgtggatacaggccctgaccgctgtcagccatgagatcttggccaagttattgaatctgtctaagtgtcagtctccttatctgtaaaatggggctaatgtacacctcgctcataggagtgatgtggggttgcagggcagagttactgagcccgtagtaagcgctccataaatgccagccactggtgttgtctggcaggagctggcgttacagtggttggggatgctggggaagtgtctgactgtcccagctccaggtcttgccaactgtaggagtaaggggagaatttgatgggaccagtgggtggaggaagaggagtgatgtctgtgaccagaaacatacagaggtcagcacaggaccctgatggtcagtgggtgtgttgtcttgtatatgggaccaggctctgcaggttgaaaaaggatggggtacgtccctgagcccccagcctagatcatcagatgggagagaggctggctctgggtggtgggagagaagggcataataagaacccttcaacgttgatgcatggcccttgggggctggaacccctccaacctcatgttgcccatgtctctgcttgttagaggagtgaagaaagaagacaagactttggctgtgggcatccagttcatgttcctgaggattttgggtaaagatcttgcttgggaccattggtggtggtgatggggtccagatgcccactgtgtgccaggcctggggcacaggcatgagcggaattcaatccctgatcttagggctcacaagctcatggggtgacagacctggcccagctctcctagagcggggtatagaggcagagtctagacagcccgtcaggaagccacctcggatgcaggggtggggcgggcttgagggccagacagccaagaggccccagtaacccagagcccctgaggggttgtacatgccagggagggggcagggtaggacggtgggccttcattgtcccctgagcaccacctccctcagcctggatgcccagccccgtgatccacggcagcgccatcgacaccacctgtgtgcactgggccctgagctgtgggcgtcgagctgtctgtcgctactacaataatgacctgctccgaaaccggtgagacctggtttgatggcttgtgggaagggtgctggaaatactctcagagtcccaggcaggataccagcagggaggggaggtttcatttaagtctacctgctaggtgacaggtgtcattatatattcagtgctgagctcaccagtccttcaagctaaacactgcccccctccttttatagatgaggaaagtgacagttaaagcaagtagcccaaggtcacacagctaataacttgcagagctgggccttgaccacagagtctatgcaggaacttggggagaaacagaggagcagccatgctgcgagagggacttggggtgaagggctggggagaaagccctgtctaggacacaggaggcctgggtttcaggcccagctctgtctccctcatcatgggacttatcttgtctggggctcagtcttcccatctgtacaaaggggaactcaaaggaacctgaaggcacagaggcggctggcctgggatggatgtggagaggacttgctagcagggctggggacagggagctggtcactttcagctctgaggaggtgaggagggcacagtttctgtgggctgggactgtccacagggggcttcctagaaaaggaaaagtcaaacaagggctttgatagttaaacaggggagagggaatccgtttgttcttgtggcaggtggcgcaatataaaattgcacttgtcaggccccctgagcccttgggctcggagagaggcagggccaggccaggccacagagcagagtccaggacagggcgatgaagatggccaggcctctgctcccacccagggctcctctgcagagcctctccccctcctccagggaagagccacagcagaggtcaatgtctccctgaggcctcagtatctctgatttcacaatgagtgatgactgctgacgtccatgccctggcctggcagctcttgagttcaagggtccccattctttccccaggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataatgtctcttctattacaaaaattctttcttcataaactgcattagaggtttgcaacaaccacatcatttccattaacttagatttaggttttactggattcattgctcaccattattgcttgtatattacatcttttccaatctttatattctggtctaatttttgtttgagtgtcttcgtctactaatggtttcaaaaatggaataaggtcatgaggatttctgaatcctcacctgtccaaattgtcattcacattttatagaagaggaaactggctcagaaagcacaagtgacttccccaagatcacacagaaaataaatgatggagccaaggttggatgtgtagaccttgtgggaactgaaggttttataatttgaggagccctctttaagaaaaatatacaaaattatgaatataaaattaggtacaaggtacctatatttacctataatgagaaaagaaatcaaaacagatacatcacacaatccccccaaaatgcgtaatacttttattaactgccctgcttaacctctgagacacattttctccccctgatgattagaagaattttccacagactagcttctggctctgtacatttcaaacctggtttctcctgtttcttgtctactgcccatatacttcctgggctgggtgccatgacacacattcatatcacgatatgacctctgcatatggcaacttaatatcaccatgccaagtgagctgggcagtgggtagaattcctagaagctattctctacacagagattactagcaatgatttatctatacacagagaaccacataaatattaatatatcctctgtttcagaaaaccacataaacatatcccagtgaacccaactcaaatcagtcccccactcagcttccccttggtcagatcccagaagtgcccatggccactccaattatcccacataaaggaaaattgaaacacaagggaagttggagtgggaagaaaatagtaattttgattgtggttaaagtatcttacctttgcaaattttataaaaatatgacaacgtgaacacatcgctgaggccctccctggatctggggagagtcctggatgctcaagctgcattcacatcacggtgagtccgcctcttggttgagccaagatctgaaggaaaagacgaggtccttgtgcctaaagtcttccaaactggacatggtgaggagactcaggagttacccaagagagaaatgggtcaagagccaaggggtggagcaagtcagggccagaggggttttccaggccctgtgggggtcccagggaagtcctctcccctaatatagcctctggtcaatgaagagccacaagcatttgcatctgcaagcttactttcttacactgtaccaggaagctgggaggagaagacattaagtctccctgctagattgtgctggtgtaaagtcagcagaggacaggactcagaccagaactgacatcctgatgcctaggtttcttttcttgtagactctgggaaggtctgggatgctagatgctgggaagttctagggtaggcagatgacccatcaggagctggcatccaggggtcatgactgacatgcagataagtgaaagagaactcagcgacatcctcaccattgcctggaggtgttgaattctttccccttcacatacctttgcttatgctgttccctctgacctgggttatcttcttcatccccatcgcacagcttgtctctccatccccacttcataaagtcctacccaatcttccaggcccagctcaaaggccaccaactccaggaaggcaacatggtataggcaatggggggcaagtgaaaaccacctctggggatccaatcaaaggcatagactctccactaaatataaaacaaaacacacacacagagacatatacacaattgtgcatatgatttcagaggttgaagaccatatgatgcctgggtgtagacctcctaagcatcccaggtccccagtcaaaagcccttaatggagtgaaaagattatagagttgtggagagagtcagacttgggatcaaatcttgactctgccacttattacagtgtgacgatgaacaaatgatttaacctctctgcacctcagtttgctcacctgcaagtgaggttgagcatgcctagctcctatctcccagaagctgtgaggaccgggtaagatcatgtacatgctcacaggcaccacacctgatgatcaggatttgtaagctcccttccccttctgtccctgaaaaaatttcataaacacatagagcatcagagtcggagggggaagtgacaacagagggaggaacacacctcctttgccctaccctggccacagctccgttgtccccaatctctcctccactgtcagccagggctcagccagcccagtcttatctctccccacagccagcttgggacagcttttctcaaccagatttacatttttattgattttctttctccctcctagagcagtccctcccttctacttcccctttggctatcaaatgggcttaccctgggaaacagcagttctagggctggccaagaagtgatggttcaaggttggattcattcacccttccttccttcattcattcagccactcacatgagcaacacatatcctacatgtctgctctgtgcccttctcctggcattgctggggacacaaccatgtgtcagatacagtctctactcaggaaactctcagtgtaaacagacgacaaacagtaacaaaagcatgagtagtcatacaggagagggaagaagaggaagccaaggactcttcctggggccaatagggaaggcttccaagaggttatatcagacctggtgttaaggattaggcaggacttcctcaagtggacaaggtggaaatgggcaggaaaaacaacaggacgagcaaagatagagagaggtgtgtctgagatacagtgacaagagcaatgtggctggagggcactgcatgtgcagggcaatcaggagacagaagagagcagaggctggaaagaccagcagggaccaagcatggagacccagctgaaggtgtggatgcttccctgagggcaaggaggaacccctgaagcactgattgatggattattccattggccagttattttaagcagggagtgacatgacaagatttgcattttggaaaggccgctggttgcaccatgggggctttgagtggaaaagagaagctgaaggccaagagctcaggcagggggcaggtgcaacaatcaagagaagtaggaggactacagccaggtcaggagaggcatcctagaagtgggatatctaaggtcagtcttgaaagacgagtgggaatgcaccaggaagagaagttgggaagggtgtcaaggcagaagaaactgcacagacaaagtagacagaaacctcctggcaggcttggggtatttccactagtttagcagggctgcagcatggcctaagagagaaggcatggagagggtgaggctgaagaaagtgggttgatgctctcaatgccactcagtgttgtccacctcccgaacctagccccaggtgagagaggagagggagccctcacctctgtacagaggtggctgtacaggtctgagccctaggtcaggggtgctccttagtccaaacacaccttttagtgttcactacatttcacattttacacagtccctttacaccccgtcctcatggtttcctggtgaagaaggcaggaaagggattattattgccatgtagtaggtaaagaaactgaggcccagaaaagtgcagaaacttgcccaaggtcactcaagagcccaggtatccccctcctaaggctcccatgttgttgctaataaacctacttgtccctgaatcacatatgtacaatagatgtagtaagtgctaactaatgtggttgggatgaaaaaaggggggaggagagaaaacacatcagagaaagaggtttcctttttatgtccccatttcctcagccttcatcctgcagctggggacattccagctgggaaaacagaacccaggtccctctgctttggaatccaacagacaggaaggtcaatccaagctctgccacttaccaggcatgggaagtcactgcactcatcggagcattggttttctcatctgtaaaagggataaataagcttcacctatcagaatcgttgagaggatttaatgtgataaagtagcaatatagtaatctactactgagtaataaattttctggctgacacagtggctcaaacctgtgatcccagccatttgggagactgaggcaggaggatcacttgagccccagagtttgagaccagcctgggcaacacagtgaggccccatctctccaaaaaataataataataataaaaagaaacttagccaagggtggtagcacccacacctgtagtttcagctacttgtaaggtttaggtgggaggattgcttgagcccaggaagtcaagattgcagtgagcagtgattgtactactgcattccagtctgggtaacagagcaaggccctgcctcaaaaaaccccccaaaaccaaaaaataaattttcccaaagtttagcaacttaaaacaacaaatatttattatctcatagaatttctgagggtcaagaacccacagatgggctaactggaaggtgctggatcttcatgaggatttctgatgaagttgtagtcaagcatcagccagggctgcagtcatcagaaggctcaactggggtgagaggatccacttccaagttcattcgatgattgctgttgggcctctgtaccttgttggcagttgaccaaaagctttgattccatgtgccttttatgatctaatattggaagaaacataccgtaacttttgccatattctcttggtcatgtagacaaaccctggtataatgtgggaggggaatacaaaaaggcatgaataccagggggtatggatcattgggagccatttggaagctggctacaacaagcactcagaccagtgcctgacacacagtaggtacttattcattagtcgctgctataactcttgcaatgacctatcacagcctggttgagaagataagatctggacatgataaggtgagaaatctttggcaaagtgaaatgtaacttgaattaaacaatgttcaattacattagaagagggtgtgccggacaaggccctggcaaccagggaagacttcctggcggagatggagaggaggtaggagggcaatccagagagaaaacagaagatgagtatggcaggttgtattggttgccttcccatggcaaatgctctcttcttcattctggtagcaaggtgctcagccacagggatgatccaaggcagcaatggaaatgccttcccctttgccagaaagtggtccaagagtagacatgtgacctcgtcttagtcaatgacatgtttggggatagtctgctgggaaagcttctctcctggataagagaatgatgtgaagggagaataccctttttgctaccatgccctttctccctgcttgggaggacatggttcctgatggcactcagtcatcttgcaatcacaggggtagtcaccctcgaggctcagaatgggaaatgcctgggtcatcaaagacattgttgaatcagcagaccaatcctcattccaacttcttctggcctcattaaaaaataaaaagtttaagccactctaaagcaggtgacctcttccttgcatcctaaatgattcagtgagaaaagtatcctggttccctctgggactattttctttttctgaggaagacagagggaagagtggaatgggaaagggcccaggctgggaggcaggcgtccttggtctaaccccagctctgcctctgagttgctgtgtgatcttgagcaagtcccttctcccctgggcctccaatgattacagctaatatttattggctgtttactgtgtgcccagtgctcttctaagagcttcccttgcatcatctcattcaatcttcacaacacctctgttatgtcagtatcactattatctttattttagggataaggagactgaggcccagaaacttgaggtccaggatcctgactataaagccatattgcctagcagtaaaaggaagtatccagacaaggtgacctctaagggcctcttaagctcaaatattctttcatttgctgtcccatttctagctacatgatcaacaagccagcttagcctagagaaaaaagaaataagggctgtctttagacatctgaaaagctgtcacgtgagcaggagattagacttactcggggtagctcagaggacatgaactggaccagtgtgggagcatgatagggagatagagtgcaacttatataagggagaattttctagcacaatttggcaggcggcagagctatgcccagatgtgatgactcccacgtcataaaggttatgcaagcttgtgtttgataacgcagtattactgacaaaggtttgagcaggtatgggactgaatggcataagacttgtggtagaaattaaatgggataacatatgagattactcctaacatcatgaccagtgcaaatagacaggatcaataaattattgggttctttttttcctttttaacactgagattcttggattttaaaattgtctaatatggagttttggctctctggctctaatattttaccattctataatttctgtaattcttccctgctaaggtgctatgattttaatactagaactttccataattgtgtggctctagaagctgagaagcctcttattttataatttaatagtctttagctttaacaattcaagtcaataaagtgtctctcatcaactccagaaatacaagggagttgctccaaatgctgtggttcagtggcctggacacacattgggcttttccttctgcccaccctgtcattccaccaacatcctcccacccccagcctcaggctctccattccaaccaaccctcctccccaattccgatcccatccacactctgctgtctcccagcctaccaaagaggtacattactctctacctgctggctactgtttattaaacaagagtcttcactgtggccaggcttatacttatttcaaaggtgatataaaaaatgggaagacatggttattgttctcatgtggcctaaggtctagagacacatgtctcttgctttcctgttaacccaactcaaatgtacctcttccaggaagccttccatggttgacactaaatctctaacaccaacaatctcaatttgagtgtgaaatgtgaagatctgagttccttggttggttattgtacagacctgtaacttgtctgtctatcctgtctccctgattatatgtgagatttccccctgaatcaagagtttgtctcctcaaccagactgggaattttacagaggaagacaatgtcttctccatcagactggaggctccatgtagacatgggccaatgttcccttgtatcatacttgagtagagttagaggcacagtgatgttcctctatcagatcaacaaattcccaaaggcaagtatatgtctctgccattggactaacgatttcacaaaagcagaagccacacctcccctttaagatatggaagtcctcagctgggcgcagtggctcaggcctgtaatcccagcgctttgggaggctgaggcaggcagatcacctgatgtaaggagatcgagatcatcgtggccaacatgttgaaaccccgtctctactaaaatacaaaaaattagccaggcgtggtggtgcgtgcctgtagtcccagctacttgggaggctgaggcaggggaatcacttaaacacaggatgcagaggttgcagtgagccaagatcgcgccactgcactccagtccggcgacagagcaagactcagtcttaaaaaaaaaaaaaaaaaaaaaaagatatggaaaaaaaaagatatggaagtcccttaaggactgtgcctccaccctggggaccctctccctgacagcaaggagtctagggctctgccttctctgtgtattccctccctctatcccagcccaggactctggtcataggaaaaaatatttttcttaaagcagatagacaaatatatggaaaaggaaaggttcaggaggcagagtagaaactcgagcctctcccaacatgtccagaccctctcttggtctctcctagatcctattctaagagctgctgtcccttggccaggagggggcctctcccagctcctcccagcaactcggagcaataagtgaagatgtcagcaccttggacagcgcccaacccattacaggacgcggagccagcggaagccaagctctccacctcccttagcctctgggtgatggatttcctctcttctcaatttgattaaagcccagtagataaccagagcgccttgttcctttctcttctcccttcctgatgaacataattaactccgtcaggctgggaatgcttgctcttaaatactgcctgcccagctcccacccaggcatgaatcagtaaaatagaacacttggaagattcacacgtttcttcctagggaatgaaagtgggagaggaagctgtctctgagatatacagaggctgtgaatgaaggctgacatgtggtggttgggtagagaaacccctaaactggaagtcaggaagtttactttagtcctagctttgccactaatccagatatgatctaggcaggtcatgtgccctttctttctgagcctgtttttccatttgcaagatgtatattggtctagataatatcagatgctgagttcagtgctaatgtgctatggttgaaaatctttaaacagagagggaaaggaacttgcccaaggtcacacagcaagcttatggcaaagcagactttaattcatggctcctggcttctaccccagtgctatttccacaaacttaccccttcattcatatcacagactttcttgcctgaagatggaggctaaggaagttaaaaacagataggattgcattaattggtgttagcatttagaaaataacatttaacatatgtgtaaatgctaatctctctgaagagaacagaaagcatggcataaataattaagattatggggaaaggatcacctgatagagacagaaaatcaaccccacactcagagaatcccagaaaggttttgtgacttgcccaaggccatctagtaaggcaactcttgaatcttttaaaaagaaagagtgaactcttaccttaagtgttggtggtgcccctgtcggagaaggagagagagagagacaatatgaattagcaagtatgtattaagttgctgacgtgtgcccagctctctactaggcacttgaggagggatataaaacataaggtatgaatgctgctctctaggcaccaggtctttgatgttttgcttcttctacttggaatgacttccaatgtacctgtgtatatccaaatactgctgttttatcaaggcccaaaccaaatgtctctcctgacaggaaggcatccataacctcatccagaagccactccctcctccaaatctccaatgcattttctgtgttcctgttttatagtatttcacaccgtttgccttatctgctcctattccttcccctaagaaaaggaaggagagagagagagagagcacaaaatactcaacacaagatttgacataccatagaatctcagtaaaaaatggatagatgggctgggcatgatggctcatgtctgtaatcacagcactgtgggaggccgtggtgggtggatcacctgagttcaggagctcaagaccagcctggccaacatgatgaaaccccgtctctactaaaaatacaaaaaattagccagacgtgatggcacatgcctgtaatcccagctacttgagaggctgaagcaggagaatcactcaaacctgggaggtggaggttgcagtgagccaagatcacaccattgcactccaacttgggcaacaagagcgaaactctgtctcaaaaaaaaaaaaaaaatggatggaaggatggatggatgatgaatacagatgtatgggtgactgggaaagagggtagatgaaggcatgaatatgtggatgagtgagtgggtgggcgaatggatggataaacagatagggaagtatatcattggttaggaaggtagaaaattgattaaatgtaagtgggtttgtggatgagtaggtagttggagaggtgaatgagtgctctatggacagatgaatggaaaggaatgtgggtggttagctgggctggtaaatgtatgggttaatatatagtggttaatgcatgttctcacttataagtgggagctggacaatgagaacacatggacacagggaggggaacaacacacactgggacctgtcagggggtgggggaacagagaacatcaagataaatagctaatgcatatggtgtataatacctaggtgatgggttgataggttgcaacaaaccaccatggcacatatttgtctgtgtaacaaatctgcattatatatggttgggtagttgcatatgggtgggcaaacaagtagatgaataattgcatcattgtatggaaagataaatgtcagagtaggtggagagaagaattatttagtggggggacatggagatgttcctaatatctttttcatagaaactttccattgctggtgccagaaaaattactatggggtttagttgactctgtgcttaagctgagtcaaagtgtgttaacacccccaaagatctcaggtgatttcaggctgtatcaatggaaatctaataacaagaccaaaaagagtgatgattctatcctgccctgagctgttcacacttccctggggtctgtgctccactctgtacctctgaagagatgatgccatccatagcttgtgcattgctatggtgtcccccaaagttcatgtgttagaaactgaatttccaatgcaacagtgttgagaggtggggcctttaagaggggattagttcataagggctctgccctcatgaatgaatgaatatggctatcatggaaataggtttattattgaaagagtgggtttgttataaaagcaacccctctcttgctcactctctctctctctttctctctctatctctctttctgtctcacacacacaccctctcttgcccttctcccctttgctgtgggatcacactgcacaaaggccctcaccagatgtgggcccctcaatcttagacttccagaagtgtaagaaataaatctctgttccttataaattgcctagtctcaggtattctgttatagtagcacaaaaatgaactaagatgtgcacataggagatacagtaggaagtaatctattaagtccaccaaatgaagaaccactgaaagaaccataagtgttcagcctggagaacagccaactcggtagtggcaaccactgtgtcccaggatctggctggctgtcctggggcatgccctatgtcctcagcagcagagctgggtcctaggggaagtcaccaggctgctgtcccagccccatgtgaaaaaggactttctcctaggtggagtcatcacataagggaaggactatcccagggcagtgagctccctattcctgagggtgtacaaatagggcctgggcatcctctatcaaggaagctccaaagtagaggcatgcttggtgtggaaagtaaattaaggtctcttcgcagcctaaagttaaataatttgttcatctcttcacttttcaatgaattagatttatctatgtcctgtgctcagaactggaatgcagggaagttctgttcatagctaagggttagggggatctaagagacagacagggtcttagggacccttgtctttctctatatgtaggacaggggcttgaggaatgaggagttgctgaaaatgtcctttcatagacacaaatgactagggaggaggaggaggatcagagccactgagagccaatccatgacccagattctctgtaattaatgagtctacgtcactgatgtgttggcttctgatcaacaccatctccccaaacccggccccactctctggtatgagaagattaaatcaattaggaggaggaggaggagatctggttggcgctggttggggacagcagatagttcacttacataactggggattgaggtttggacttggtccttgagtagtgggggtggattccagaccccaggcctttagagagggactctgggacttgagagtgaatgcagaaggagaaagggagtccaggagaggagggagtcatgagcccaggctcatcttgtatcttcctgctaaggaactaatccctgtcctctgggctagaagaggtccaaaatggaaaaatcactgtccagtccccaaatgagggtgtcccagccaccagtatcattgaacaatgcaaatctagccaagcctcctttccttagcctggcattcaaggccctgcaacctctctagctgcatcatctgcctccaaaaagtgggtatgagtgaaaaggaactaccaggtcctggcattccttccgggctaggtaccagctaggccctggaggtacagaaggaaacaaacccggttctttcaggtatactgcttcgtggggggacacatactcacaacactccgtgccaagtgacaaacagagttctgcatgggcaggcatggagacagcacaagggagggaggcctcccaaggccagtttcaacaggcttcccagaggaggcagtgcttgcactccctgagccttaaaggaaggatggatttgtgggagttcatcaggctgccctggttgagagagggctttgggtggagggaaaagcatgtacaatggcttggtgggtgaggtgggttggcatgcattcagagaactacgaacgagtcttgtggttggagcctggagagtgaggtagggatgggaggtgcaaggtaagagaggtaggagggcttaggtctcacttttgatgggatgccaagaaaggattgaggcaataatcccagactgtcaatccacactttctgagcactaacggcaagccatgccccatgctggaactggggtggggtgagagtgggggagcagagatgaacctgactcaggccctgcacccatgggagctctagaagcacacatgaatattccctctttttaagctcgttagtaccaacttggctccaagtgggattcaggccagacatggtatttctggggctccaattgttggctagatctgcctacagccccttgcctaaggactgagatatccagacaagcagtcttgctgctcagaggggagctgacctctgggggcctgcccctgacaactacctgacctcccaaggatacgtcttatggtaatccagggccttgggaagaaatgcagacagatgagaggataaactggaaccctgaggataggggcaagacatggattgagaggtgtttagggggtgaactgaccaggactgctggatgctggggaagagagatcaagggaagtgtcctggatggcactcaggatttctatcttgggcagtgccatccgtggtaaacatgggagaatgtgagatcagaaagggaaaatgagttggaactgtttcaggctgctggaatcaggattcattgggtagaggcccaagagccttaggaattcaaatgtaccacacataagctgccttcaggagctttcttcatcacatggaaatctttgtactctctcccttccctcccttactctttccatcagcagccctctctaagaacctcccctttccgtgctggctctgggccaagcagggaggcaaagatctgagagtcaccctgttctttgtccagaaggacagcacagagaatggcacttctaccatatcccccaggacctttctgcatgaaaacttgggctggaaattgaagctaacgcttcaaatttactttattattggaaagatttaagaactaactttggctgggcatggtgattcatgcctgtaatcccaacactttgggaggccaaggcaggaggattgcttgagcccaggaatttgagaccaacctaggcaacacagtgagaccctgtctctacaaaataaataaataaataaataaatatatatagataagaactaacctttgtggtgcaagcaacagaaactgactgaggttaaacaaagcagaaaaaacctattgaaagttccaccaggcagctcagaatggatgagaaagctggagatgaatgaacagctgaattcatagtcaagttcataacatcggaacagctgattccagtgtctccaacagcatgatcttggcctctgaacatcaccccactgcatacccagactgtggcatgacacaaacacaatgagttctaatgaagcttcctcccagcctcaccaattctcacaccaaatcctgaaccaggcaccctgtcggccaaattgccagggagtggaagggaaagagtatctggccacgtttgactttgaagggggagatgggatcctagtttccataaaggctcacctagtgggatatttactcaaaatacaaagcaacagattagtcctatgcagcaaaaaaaaaaaatgtgacaaatgtccactgcacctttattgaggacccactaagtgctgaatgtgttgccaggaggtttttttgttcgtttttgattttgtttttttttacagtaaaggcccagcactgtatagggctccaaggcatctgccttgcctgcagtttttatatacacaatttatttttatttttatttatttatttattttttacttttaagttcagggctacatgtgcaggtttgttacataggtaaacttgtgtcatgggggtttgttgtacagattacttcatcacccaggtattgagcctagtacccattagttatttttcctgatcctctccctcctcccaccctccatcctccaataggctgcagtgtgtgttgttcccctttatgcattcatgcgttctcatcatttagctcccacttataagtgagaacgtgtggtagttggttttctgttcctatgttagttcgttaagaatgatggcctccagttccatccatgttcccgcaaaggacatcttgttcttttttatggctgcatagtatatatacaaattttcaaggcaactctatcagctagatgatgcttggtcccattctacagctgaggaaactgaggttaataaaggtgaaataaatttcccaaagtcactcagctagtaggtgatgaagccaggactcaaaaactggtgggttttgttgttgttattcataaacacattatgctgcctcccaaattgtaaatacaaagcacttgtgcacattaaaaaaaaagtatggggcacaaaaaaaaattactggaaataaatactccaatatcttcacacaatgattgatgggatcatgagtaatatatttttctagctttctaatgtttttctgtactttcctgtaaaaaaaaagagcatactttaccttaataatcataaataaaaataacgtaagactgtttttttgtttttttgtttgtttgtttgttttgagacaggatctcactctgccacccaagctggagtgagtggtgcaatcatggctctcttcagccttaaactcctgggctcaagtgatcctcccacctcagcctcccaagtagctgggactacaggcccatgccaccacaccccagctaaaaaacagttttttgtttgtttgtttgggttattttttgcgacagagtctcacattgtcacccaggctggagtgcagtggtgtgatcacgacccactgcagccttgacctcccaggctcaagtgaccctcctacctcagcctcccaagtaggtgggactacaggaacatgccaccatgcccggctaatatatatacatatatattttttgaaacagagtctcgctctgttgcccaggctggagtgtagtggtgcaatcttggctcactgcaatctccgcctcccagggttcaagcaattctcctacctcagcctcccaggtagctgggactacaggcacctgccgctatgcccgactagttttttttattttagtagagacggggtttcaccgtgttgcccaagctggttgcgaactcctgagctcaggcaatctgcccacctcagcctcccaaagtgctgggattacaggcatgagccaccgcgcccggcctaatttttatttatttcctgtggaaataaggtcttattatgttgcccaggcccatcttgaactcctgggctcaagcaatcctccagccatggcttcccaaagtgctaacgttataggcgtgagccactgtgcccagctgtaaaaccgttttaaggattatagcagtgttataataattatgaagaaaatatgcatagaaaaaagactggaaagatgtccgtcaaaaaaagtctctagatggtgggactatgagcataattatttttctttcaacttctgtttttcaaattttcacaccaaaaaaataaaaagtaaaatacattttattttaaaaacaagcataggccgggcatgttgattcacacctgtaatttcagcactttgggaggccgaagtgggtgagttgcctgagtccaggagttcgagaccagtctgaccaacgtggtaaaactctgtctctgtacaaaatacaaaaattagccagatgtagtaatgaacgcctgtaatcccagctactcgggaggctgaagtgggaagatggctcgagcccaggaggcggaggttacagtgagctgagatctcgccactgcattccagcctgggcgacagagccagaatcttgtctcgagaaaaaaaaaagaaagaaagaaaaagaaaaataaacaagcataaataagatattaccctagtgatggtactgacgtgccttggtcctttcaagttctcatagtcctatcctatcatggttggaagcataggtagttctgtgttttctgggacagcctggcagttcctgcagcattcactatccgaggtggtgtggccagcatgagggcacagtgatcacggttatctccggctgaccactcagaaccagggtgggaagagcccagtgtgcccacgtcttgtaacaatgtgtatggtatcaagcccttctgcactatgaggacttcagctccagtagctggaatcctcctctctgctggtttcatccctcatttcccaggcttcaaggttcaccttcctctacaaatggggcagggctgctcagttgtgtgaattgtgggcccctccctggtgtcttctgtatctttcttgtctgagtggcaagcccccagccctttcttccctgcactgtcgtgacctcccctggcctccagagcccgctgccttgctcggcctttctcacccttccaagtgcaaggaggattcttggtgcccctctagaaagtcaggccccctctcttctcagttttttcctgggcaaaaaactgaggagctagtaacctcataggccacccagcccagtgctttctgtgtctctttctcctctccccaaacctcttcccttccctctgccctcccagcttcttcaccaagctcctccctctccttttccttcccagtacactccctgctgagcccctagaatctccaggttgaggcccactttggctcaggtagctaagccgctgcagtaagagatgcagtgggtaaagtagaggcagccggggaggaggagggcccaggccaaggctgaggtctaggaggctaagcagggcaagcagccaaccctaacagcccagaccagagccacctcagcagcttctgctaaactctagcgaggtatctatgcttgggtggcagctccagggccaaagaggctggtggcaggagtagggcattctgctgagctcagcacagcctccaaaaacctctctggagaaggaggaggccacagagtgaccatggactcggggataggtgaaaacacttcctcctcccttggggaggtgactcagatcctggaaaagactccagaggacacctgctggatggagggctctctctcaccctctgtctgtagagccctggctctcatgccttctgggacaggaagctcatttccctctctggcagcccactccactcaagctgctgaaatgcctctctgagccacagcctgtgctgggctctggggaagcagggatgaatgtggtccctgccctcaggagctcgccatctgggggcaggcagggggcaggtggcagaaactgacaacacacccccacagggaagcagagggagctgaagggggccctaagctagccttgcagtggggtaggcatcaggaatggcttcccagagcaggtaggggactgaagagggccttgaatatacaggtatggtgggtctgtagtttcaattatcctctaagtgctggcaaatcccagctgtgcacccccagtcctgacatggctcctgaattctaggcgtcaatatcccactgcccagtcaatgtctccacttggatgtcttggcatccctaactcatcaggaccaaggctaagttcaccctctctgcccacctcacacctggtcttccctctgtcagttctaccatccacaggccagaaaccctgggcccatccctccccttcaccccgtatccagtctgtcaccaggccctgagtatctcaaacccacccaccactccccacctcctcaccaccacccagcccaagcaccattgcctttcacctgtacttctccaagcgtctcctcatttatcttctcatacttggctctttcaatcatgtggtgagagtgatctttacaaaatacaaataaaattatgtcacatttctacttaaaagctttcaatggcttctctttgcctttgaaacaaaggttaaaatcttcaaggcctgcaaggcccagcatggcctggccttcgctgacagcgccagtagtatctcaacaaccccctcccttgtctcctgacctcccgcctccagcccacctggcctcattgcccaccttagaaacttctgtatgtgttactcacattgtctttcctgtgggcacaaaaacctgggatgtcctctttttctctcccaaatgactcccaggacatctgtttatgtgctcactgaccctgaacaccagtctctagcccttctctcctgaaggatcagctgcaggacacagtggggggttacaaagtaaccggcctgtctggagctaaggtcccagaacctcccagtgtccacagaggcgtgtccctgcctggctctcagatgccttccagagctcccactcccctcctgctctctctgtctccctgtctggtgtttgtttgtttgagacagagtcttgttctgtcgcccaggctggactgcagtggcatgatctcggctcactgcaatctctgcctcccggattcaagtgattcttgtgcgtcagcctcccaagtagctggattacaggcactcatgcccagctaatttttgtatttttagtggagatggggtttcaccgtgttggccaggctggtcatgaactcctgatctcaagtgatccacccaccttggcttcccaaagtgctgggattacaggcatgagccaccatgccccaccccctcctgctctcttcttccatttctggtgaagagttggcaaacctccttccctcagccctaccccttccggggcctcagtgctcctcaccactgaggggcagaggtgaggcccagcctgggtcatcgtgctgggacctacaatccatgtcctccctgggctcccagacaagccaaccagcctcgggcctcaggccaggcactgcctcttctacagtttgctggagggttcaggttttctctgggctcccacagtattctgtatgcccagcactgtcaaatccacctgttctagtgttggttgctcttcccccgaccaggagctcaacttgctcaggggctgtgagttttcatctcttcaccccaagcctagctcaaggatggtcccagaagagaggctcaggaaagacttagcatatgaattcaggactaatatcacataaatgtgtggttttgttttctttccacataaactgctattaaactctgtttccttcatcctgaactttttatgaagaatggacctaagagtcttatgggccttggctttgatctgagctccatctcttactatgtgacctgagcaaatgcttagcttctctggctttcagtttcttccactataaaatgagaacagggtggaaggggtgaagactgaaaaactacctactgggtacaatgttcactatttgggtaatggatacactagaagcccaaacctcaccattacacaaaatatctgtttaacaaattgcatgtgtacctcctgaatctataattaaaaaaaataaaatgagaacaacatcctcctaaggttttcactattaactgagatatcttatgttagggtacagcacgaagtatgtgctcaataattccttcttctctccctcacccgaacctctgagccccgatgaggacttgacatttacctccatgaacgtgaacctatggtcatcacctatgggccaagttaatgcagatcattttgaaacccagttctgccatctgacataatcactctcccacccagatttgataagcatgctttatttggcctaatccaagtccctgaaaaaatacatcagactgagcaagatagcagggaggaacaagcccggagcagggcactagtcttccctctaagctgccattgatccacttacccgttctccaccacctgctgtccaggcagccagggattcccctagtgtatcacgatttgatccctactgtagcttgccatgaaagtaccttgggaggctgggcacagtggctcacgcctgtaatcccagcactttgggaggccgaggcaggaggatcacctgaggtcaggagttcaagaccagcctggccatcatagtgaaaccctgtatctactaaaaatacaaaaattagctgggtgtggtggcaagcgcctgtagtcccagctacttgggaggctgaggcaggagaatcacttgaacccaggagtcggaggttgcagtgacttgcgatcgcaccattgcactcaagcctcggcgacacagcgagactctgtctcaaaaaaaaaaagtaccttgggagatgttccaattgcctttttgaaatcaggattctcaagacttcaacagacccctgatctattgcaattttggttctcccaaagcaagagagatgagagattagcctgacttattttaagtaaacctaggctgggtcctggtgatcactatgttttattcttctttaattttttttttcctagctgggatttgaactatattcttctttttaaaatgatatataccattccttttctgctgtctttgttaatgccgttaaattggaagaattttcagtgatcagtgaaaagtctcagttaggaattattaaattaacacaggcttcttgcctacttgctgttggctgaaaatagtttaaaatacttaagtgaaaacttttctctaccacaggaaatttgctttctgagtgaatgaaggttttctataggaagataaatgttcaaccttctcttctgactcattataatcgtggaatggtaaaattcaagtaactgctgttttgtaatattgagtcaaacattcactttaaaaaaatgtaacaatactgtcttaataaaagcttagctgtatattcttaagacttagaagactttgggaggccgaggcgggcggatcacgaggtcaggagatcgagaccatcccggctaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagaaaagaaaagaaaaaagaaaaaaagacttagaagataagcttgactgatcatgattttcaaagttttataagattactgaaaatacaaaaagccagtacaagaggaagcataatgaaatccagcaggaataatttgtaattagaaaaccccatgcaattcttcagccagggataatggtgatccatcttaaaaacacatgtgtcccatgctgagcactgatgagcctaatcagacacactccactgacatttttcacaataccaaggggtccttaattgctggggggtacaggcaggcaagcttctcgctgctcctctcaggagatcataatgattaagagcaggcctggagccaaacagccaggggaggcatcccagccctcctccaactcaactgtgactttaggcaagtcacttaccctttctgtgcctcagtttcctcatcgtttttttttgagacagggtcttgctctgtcacccaggctggaatgcagtggtccaatcgtggcttactgcagcctcaacccctagggctcaaacgatcctcccacctcaacctcctgagtagctgggacagcaggcgtgtgccaccatgcccggctaccttttttaatttttttgtggagacgaggtctcctgaagtttcccaggctggtctcaaactcctggcctaaagtgatcctcttgccttggcctcccaaaatgttgggattacaggggttagccaccgtacctcatctttaaaattatggctggccgggtgtggtggctcatgcctgtaatcccagcacttgggaggccaaggcaggaggatcacctgagatcaggagttcgagaccagcctgaccaacgtggcgaaaccccatctctactaaaaatacaaaaattagccgggcatggtagtgcacgcctgcgatcccaactactcaggaggctgaggtaggagaatcgcttgaaccccaggaggcagaggttgccgtgagccaagatcacaccactgcacttcagcctgggtgacagagtgagactccatcaaaaaaaaaaaaaaaacaaggctgagaatcatcacctttcagggtgatggttgtgaggactgattcagccactatgtgaagtcggtctgacccacagtgtgtctctcctacaccccagttgctactggggttctcagggacacaggatgatccacttccctgcccccatgccactgcctgttctcctcgttagggatacttgaccctgccagaaggtccagcccatgtggaagggcatcatgcccacagtggccgtacccagaggccctcttctcctcaataccccttggtcccccaaccctgaatcacaagctggctctgggccagctggcctgctggtgatctgccttggctccagcatgggtggcttggctccagcaagagcttaaaggttcttcattgtgttttctgcttcagtgtaaccatctgggaattggaagaagagggaaaaataaatacaatgttcccccacttctaccttctctgcctccccccatggctgggtacaaggctgtgtactgtccagcattgtcttgggcctcaggaaagctccccccagaggtcccctgcatggtgtcccgtgggatgggagtcatctgctgcacctccaccattcctccatctgtctccctctttttgtgccctttcctggctcagcctctcctgcctgtcaagttcaacagctcctcagcacttaccatgtgcctgggcagagcactgggagcacagagatgatgtgagcaagggctctgccctccaagtgctcattgtatagcactgagaatatagactgcagcatacacagcctgaaccagactctcttcagtaaccttggatcaactacttaacctgagggtccacctctgtatttaaaacttgttgtcccagctacctgggaggctgagggccaaggtacccacatttcaggaccattgtgagaattaaacataatcctgtatgcaaagctctcaactcagtgcactgcacacagtgggtgctcaatcgcatctgcctgccttccctccctccctctttccctctttccttttagccagttgcctcttccagaggagaaggtctgaaggtctgaacagggtctatgggcagaggtggagccctgcccctagcagggctggggcagtgtcaggtgggcctgtgtggggccaagccaatgctgggcagtcaggggtgatgaccaaccagggctctgcctgccagatgctttctttcggaagtagactcagtcctctgacctcctttcctctctcccagtggctaattagtgccgattgtgggctcctttttagcctttccttttctgaacttccaactggcttctttttcccttccccagggcagggatggggacacactggcagggcaaagctaaggccccaaccacagccagtccttgtgctaagaacagggtgagagctgcctatcctggctgagctgtgggggctgctgagacccagagtttggggttgccccaagggaacttcttgcctacacaacctgcttttcatccatctgttctgaggttcatgtcctatgtccaggaatatgtgggacagccaataatcaatgtactggccaggcttcaaggtcttcttgcacactcacagccttccggtgagtgatgagctcatagagatccccaggggtattatacccgtatggggttgggggaagctatcccaacccaacctggggctaaatgctttttctatcactctgaaacgcagtcagggaaatccagtgacctagaaccagacccactgggggaagccaagaataggtcatcctggtaaatagccaacatgaggctgggaagggagacgttctggggtggcggaagcccctagttctggaggtacgggctagtggcaatagatgatctgtctgcagagtggaatctcttggggctccatcatgaacccggagctccagtgctgcagtggcaggaaattaattgacagtcattcatatgagtcccaggaccaagggttagcagcaagggggttgagacccaagatgggactcagacatcttcaatcactaggaaaggactgcaagtgccatgaaatggagatgctccagcaggaaagagaggagaactgcggcagctgaagctaggcagggctgtcacttccaaagaagcacagatcaatggaaatgggaggcctgtcagagcaatgtcttatagcagctctgagcagaagcagaaaaggaaagagactaagtgggggagggggcaaaggaggcatcaggatggcttcctggaaaaagagtgtcactacaaaggtcagaaaagcttgtgtcaaagattcgggaggtgaactggaggtgagctcaccgaaggttccagaggtgagctccagggcccgcactgtggatagctctacattctaggtgggtgctgggcagggggtgattctggaattactcggtgccaaggtgtcctccatgcaccagctccagcaagtgggaggctgccacatgttctcatcacgccttctcacctggagtcagagcctgctgcctgatggtccctctgttaatggcttccagatgtgtccttgggcccctggagggagacttcctggaggacacaccccctcctacccaagcctcacccctctgatcaccttcagtcacagagcctggtgaaggccatggtgcactactgcagtatcacattgtagatgagaggggcacggaaggtcagactgcccgcttctgtgattggctactgacctctgagcccctcatcactgttatttctggctcctaggtatcttcagtgcataggatccagctggtaacatgaaagttgtccattggagtatgatggctgagtgggccatgggcagtggctcatacctgtaatcctagcactttgggaggccaggtggaaagactgcttgaaaccaacagttcaggaccagcctgggcaacatggtgagactctttgtctctacaaaaaaattttaaatattagccaggtatagtgacacgtgcctgtagtcccaactacttgggaggctaaagcaggaggatcgcttgagtccaggagttcaaggctgcagtgagctatgattgcaccaccgcactcaagccttgatgacagaggaagacctgtctcaaacaagcaagcaagcaagcaagcgcacaaacaaacaaacaacaacaacaaaaaaatggccaggtgtccatatctctttggggagacagattggccatccttgtgagactagtgtgtctgtgcctgttggtttctgattgtgggcctgttcctttctgcatctctgtaactctctctctgtttttgtaatgacttgattctatttctgaagctatgtgtccatgtgtttctctatttcacagcaaaacttttcttgactataaccacaaattccatcagtgcttattgtctaataaatggaagtccaatattgcccttcctgcttcacatccctaaggcgtaaaattttcattccagagttatttccagcctagatagggggaatctgattcatgttctgctggggatgacttgtacccaagaaggcaggaggcttgtaactgatgaactgcaaatagcaggggtgccagaatcactcctgcatggcttggagcagaccccaaggctcagacactttgcagtcaccgggtccatctcccagtattctcctggtccaggctaatgtgtaagggagtgtgtgctcctggatctgagttttaccagccaccagcttcattcatcaccatccgtgctatcatcaccattatcacccccactctcccaccaccaacaccaccactattaccatcaccattactaacactacaactattataccacaatctctgtcaccatcaacacctctgttccattactaatgtcagagatttgtagttgcttttcaatagctatttcttcttcctcctcagtaataaggaccataacgttttgctggacacattatcttacttagcctcttgaagctagttaggtgtgcttatgtaagtgaaagtgttgaatgaaagtatagaaagtgccaataaaggaaagggggtacccttatttatagctttcctccatctgctatctgatgtgatggctggtgctctagcagccatttggaccatggcaatgagaactatagggaaggcagagtgggaggctagaaggatgtgaggtactcatgactatggagagaccattcagactctgggctacatctggaccttcttttatgagaagaaaagaaactgaacttctatttctctatcatttaagaaattcatgtgggcatcctgacgcatatagttgaaactaatcctaattaatatgcatcatcatcaccacatattattttgcatttaatagtccaggctaatgatctgtatatgggggagggtgaaacaatggaatgtggggaatgtgggaagtggccagtctgatgcagtcactggcaagaaggaaaaagacattcaggaccacggacagatccaggactgccagttgtgaggcaacagggcaggaagaaatgagaagtgtggttggtggtgccagttgttgtcctcaagatatgttctggccagacactgtgctaggaactgggatgaatactaagataaatttccacaaagtccacatttggctcccaggaccagagcaagcagatcgatataggaaggcttcctagagaaagggactgagaagccagctgaggggtggaaccagaagactgtgacagaatgggcacaacgctaaagaataagagacacctgtgggtggggagagggctcaacgttgaaagatgagtggtcacctggtctgacagtgaaaggagagggtaccattgggtgggagttaaggcgttttcaggactcttctgtttcttggattctacatcagtggttccagtttctggtcctggggttccacgatgctgtgactgtcagggcatattggatctatgaccaagattctacaatgatgaggttctgcatccgttatctactgctgtgtaacaaaccaccccaaaacttagtgacttaaaacaaccaccattttatttgttcacaattctgtgagtcagaaatttgggctcgggtcagctgagtagttctgttggtcttatctggggtcactcaggtggctggaggcaggcggaagaccatcagggagctggttcatctccagctgggatggtttacttctggtctcttcctctaaaaggcatgcttgtgttcctacacatggcagtttcaggggagcaagaagaggtgaatcccaatgcacaagcactttttaagactctccttgcatcacatttgctgacgtctcattaaccagaggaagtcacacggccaacccaaagtcagtatggggtgggacaacataaaagtatggactcagatacgcagaattcatttgggaccatcaatattaacaacctaccacaagctctaagtgtctcattcaccaccaccatactaccaataccataagtctttgttctaattcagagaccacagttctatggctctctgagtctgtggttcttagcagtcaatgttttgattccaagattctgtgattctagaagcagaaggctcagtacattgaagaagagcatgaggacccaagaggaggctaaagaagttgggcaaacaaaggtcacccctacagaaccagctgcctctcccatgctcacccctcaggccccaacttcctgcctgaatcagggaagtggcatgaacacggagttgggaatcagaaaacctagattataggccctgttccatcattaatctgggatgaccccaagcacagctcttaacctcccagtgttctcatatagccaacagagatatcaatccctgtcttctgaataatgcagaacagtggcaaaaccaggagaactgggcccactaacttccatgatcaggatcctgggcctgggcacagctgaggaagagggttttgctcccacctcattaaactgcatccacagtggtagagaccttgggttttaagagaaccaagacaggttattgcccttggtctgtcccaacctctactggcaaaagcaagaaataatgaaaggggaggggagtggaggggagggaagggaagacaagggaagggaagggaaggcacccaactctgctcctttccctttcccctctcccctacccactcctgtccctgactcaacagagtggaatcctaggggtcagaccttagctggcctttagcctcagtcggctctgccctttagcctttccttgaagaggagtggagaaacagaggcttcattagggaaggagacctaggccagcacagcaaatcataacattacacagccaagggggaccaacaacaacccactggccgaaccaccttgcagcacagatgaggaaacagaagcccagggagggacagggacccacctgcccacagccacacagccagccaacagcagacaaagaccaaaagtcaagtgggatctctctccttttctaaatgtccatttcccattctaaactgggacaacaaacccagcctgccaccacttagaaactgtaaagcaaggtacagatgtagtaaggagtcatcttttccaatggtctgagagttgggggttggggggaagactgaggtgggggtaagaacatttaggactttcggaggacgcatccagctcatttattctagcctttccccagaggcccaggccacagagcggaggaggagggtattaaatatcagagagttatttaaaagccagttgcctgcccctcagaagcagcgctggcctctgctgactcaacggagaaaatgaatcttgggcctatggattttcctgtgtctcacagcagtgggggaggggagggggagtgagaaatgggaatggcaaggcccacagtgaagtctcccgtccctgctggcaaggaagccaagcaagaggagagaagctggggcctcccccactacctcgtggctgagttcatcacgtcaggccgcctgctgctcctccatttgccttggaggaggggggaacagagggatgggaaggcagcaggagggctgctgggacagaggacaaagggagcctggatctcaggatgctacagcatccgctccagaaggaccccagaccacccctaccactttcttcctcagcccccctgagtagctgggactacaggtgcccaccaccacgcccggctaattcttttttgtatttttagtagagacggggtttcaccatgttcgccaggatggcctcaatctcctgaccttgtgatctgcccacctcggcctcccaaagttctgggattacaggcatgaggcaccacacccagccacccctaccactttctagtcgggcaaccaaggccttaattggggtggtaccaagttcaaggtcatatattgagaaggtgggggcaccaacttgggcaaatcccagtatgaccttcccctccctgacccccatccctaaaatgccaaggggcacaagactactaggccccccaggaccatcccatccacacacacttttttgcagacagggaaactgaggtgtgtccaaggactttaataatattgacacacctctgatgacaaaacagagctggagaaggggctacctgctgggtgatctcagggacgtcatcacactctgtgctccctaccaaggcttagtggagctgatcaacagcagggtctgtgccagcagaaaaggcccagcgaaggcactagaggctcaggtagagacaacaccttggaatactaagagaagggctctgggacctagtggagtaataaattcaagcaagcgtgaagatccagtgtggctgacatgaggggtactcatctgggcaaagggcagatgatcactctgcttgggtggcgaggggtgcctcgcttcttccgagtcctaaggaaaccctgagggcgtgagctctttgcccacaggctcccctgggatctgacccagccacactcccaggagagagggatcctaggatgagggggggctgcggcaaaggagatgggcaagaaacccgagcttctatctggctcaggtcccagtcaggtgtgcaaccttggggaaagcacttaacatttctgagcagctatctcctggtatgaagtgtagatgaggggtcctcaccgagcttgcctcatagggatgagaggctcgagtcacagatttttaaatcattatttcagtcagcaaatattccctggtgccttctctgtactgatccctaagaaattagaccagacctgagccctagctgctgacagtcaagaagatcaggggagtcttagccctctaattgatcagtgaagttcaaaggatggagagggaagccatgagggctccctgaagggggcaaaactcacaagtcctgagggacagctgactggactggagaaacagaatcaagaggagagcaccccagctggggcaaacagtccaagaaaagagacttccaccagatgcatcagagaataaacacacagcctcagactcaagtggacacacatttattgaacacttaatgcatactgaacactggcaaatctaagatggagagcgctgttcctccaaagaacagagatccctcagccccaatggctcgcagacttgattccttggggaacttggacagagagaaattggttccaggagaatttagacgggaagcacctttacaaagtgggaagagaggagaggaggctgagtagaggccatacagagagacaagcagagactcattaacatccaccacaaatctgctgtgttggagaaggaaagaacatggaacagggaaaaatgacatgggagctaattagtcccagagaggggcaatgccttacccagggtctggcaggacgggtgctaggcccccagacccaggtgaaatgttttttcttgttttgaggcactttcaactcactttatcataacagccctgagaggaataggaagaacaggaatttaaagcctatctaccttatagaagaggaaggtgacagcccaagattgagaaaggcctgaggtcacaccagatcaaccatggcatccattcccagcctcagcttcttggggtcaggataagcattccttgtggtgcaggaccctctcagatgcagcccaccatcttggacagagtcctgggcaaggaccctggggtcaggtttctaggctaaactctgaaaacttgacaggggccttggggcccctctggcctatttccccatttgtgcaaaacagacgacatttgccttattctctggcacctgatgattctaaattctctccaggcctcatttccccaaatgaggtgttgagcacccccccaatcaaggctgcctgtggtcctgcagctcctttcctggggggcagcaggggaggggggcatcagccaatctgaggccagccaccaccggggcctggggaaggagttccagccttggtagtggtctgattcctcagggcctggaagcagacaaggaaacagagacttctgttcattcagtctgtcatttgcaccacacactctcctgagatagtctctatactggaaacagaaaagtgaaaacgacctagtgcctcctaccaggggagatgtcagagctggggcatgttgctgtgtgggccggggtttaggggagggctatagctgggggcccagccccagtggcatctacttgagcacgtgtgcccatgtgagaaaagacatcaccagcctgttacctccacagaccaagggcatggtgcagggcaggaggagtagggtctgactgtgctagccaatcgctgggtccctatgcttggcatggcttaagcatgggcctgtaagcttgccctctgagaatgtatccacgaacctgcatgggctcagaagtgtgcatattcaaatatgtatgtctttatgaatttatggacacatgccaggacgcactcaaacctacgatcctatgtccacatatgaatgagtctgcatggacttgcatgagacacatctgagctctcatacctgggagagttaagacagggggtagggaagagagaggggcttggaggaggggagagctgggagacccccatcatcaccagctctgttccttaatgttggtccttgcccaagacccaggccactgcagggtctgcctcttctccttaagtggtattgatcctttggtcgatctgttaaatataacctcagggaaggagtcaacataacaaccgtacccaattcaggagaaagagactgattcttgggaggaggtggggagcctctattccaaccagctctgctgatacccgaatggcctgcggatcaagtgtcagcctctccagcctgaataattcatgctaaggccaggaatcctcccttctcaggagcctgtctctttaaatcaggtttagagcttcccagttctgggggaaaaaaaatccagaacaaaacaaatctgtaaacagctcagcccccccaccctcagccctggccccttctgagacccccaactccatgctgcaaaatctgctcctgctctcccaacctctggtgccccaaaccccactcacaggcggagaagcctggagggactagttgacagtgtccaacggaaccccaggagtcttaagaggtttgggggcagggagtgaaagcaaagagcagaatcactacacccccgggtctctgtgcctaggacagtgcttggcagagaagcccagcccggtggaggaaaccacacgggggaactcctggcagaggcagagcagccagagttggtgggtgggaggggagcgggtgccacagacttctcctgagaatgggatgggatgggatggagaaaaagctggtcccataggacctgcaggggtggtgacacagccaggtctaatggaactagggtcgcagaggaggaagcagagactggggattttccagtctctctgccttaggaagaggccggaaaatgagtaactttctcagcccacccctcatcccttcctccggtagtaggagcagctctaaagtcctccccaacccccgaattctccctggtggtgacccacctgcctgctctccgcagtcgggccccgccccacacgtgctggagaaggaggaggaaggacccagcttaaatgttgggggtggaggaggaggaaaaccaagtcggagcctccaggagccaaacttctcggcagcccggaggggcgggggcggagaggatgaagagaaagcgcagcagccgacagccctgattctcgggagcctcccaccccgcctcccacggcgaggagggcgcggagactccgctgggggcggaggacgagaccgggaggcggggaggggggaggcaaaccctgcccactcggctcggagcccggagcggccgcggaagccggaggccggcgcgcagggcgagggcaccgggggcggggggctccgctccccgtctgacccctcttgcccccggccagtcagccagtaagtgcggctcctcagactttcgagacagcgaacggaccgaccgggactgccagccgctccgggtcaaggactcgccccacccgtgccccccaccaggcgctcccaactcactggtgagcgcggcggcccgggcgctggatgcgggggcggccgcgatggccccgcgcgcgggacagccggggctccaggggctgctgctcgtggcggcggcgctgagccagcccgcggcaccctgccccttccagtgctactgcttcggcggccccaagctgctgctgcgctgcgcgtcgggagccgagctccgccagcctccgcgggacgtgccgcccgacgcgcgcaacctcaccatcgtaggcgccaacctgacggtgctgcgcgcggccgccttcgccggcggggacggggacggcgaccaggcggcgggcgtgcgcctgccgctcctgagcgcgctgcgcctcacgcacaaccacatcgaggtggtggaggacggcgccttcgacgggctgcccagcctggcggcgctcgacctcagccacaacccgctgcgcgccctgggcggcggcgccttccgcgggctgcccgcgctgcgctcgctgcagctcaaccacgcgctggtgcgcggcggccccgcgctgctggccgcgctggacgctgcgctggcaccgctggccgagcttcgcctgctgggcctagcgggcaacgcgctgagccgtctgccgccagccgccctgcgcctggcgcgcctggagcagctggacgtgcgcctcaacgcgctggccggcctggaccccgacgagctgcgcgcgctggagcgcgatggcggcctccccgggccgcgcctgctgctcgccgacaaccccctgcgctgcggctgtgccgcacgccccctgctggcctggctgcgcaacgccacggagcgcgtgcccgactcgcggcgcctgcgctgcgccgccccgcgggcgctgctagaccggccgctactggacctggacggggcgcggcttcgctgcgcggacagcggcgccgacgctcgcggagaggaggcggaggccgccggcccggagctggaagcctcctacgtgttcttcgggctggtgctggcactcatcggcctcatcttcctcatggtgctctacctaaaccgccgcggcatccagcgctggatgcgcaacctgcgcgaggcgtgccgggaccagatggagggctaccactaccgctacgagcaggacgccgacccgcgccgcgcgcccgcgcccgccgcgcccgcgggctcccgcgccacctccccgggctcggggctctgagcggcgcccccgggctcggggcttcccttgcctggcccgaagccgtggagatgagacacccgcgagccccgagctctgagaccttcccctgactcggaggcgctaagccgtaccctctcgttcccgcctccgagagctcccaccgtcaaagacccagagatagccggtccgaatccagaaaccccgcctgcccaccctagtttccgaaacctccctcctgaaccactgaaagtccgttccccgtctcggagctcacacagagaatctgtccttcaaggccaaagctctgagacttgcccccagcaccctgtgcttggagctccgacacccgagactgcactgacctccctcgccagctcggagccctcagtcccctccggggcttgagggcccttccatcccattctggactcgaagcacagcacccccatcagaatggttttgtggattttgagccctttgtcccatcccagagctcagagccctccatcctgcatggaggcccaaccctggggctctgaggattgggcaccctcccctcatctaagaatatatttcatacccctgcccccccttcacccacccccgcctctggctcaggcccttcccttcctcggctcaggcatggggctcagctcctagtctgtccctcccatcccagggacaagcacagcccatctagccttagtgtggagccaactctcagcctttcccaccagggcgctgacctcccgatactcagtgctggtccccagtctcagactctcagctcttcaccccgatctgactttcgtcctcctgcccaagcctttggctcttgaccccccccccatacccaatgctggcactcagcacccacccctgccattcactagtcaaggtccagtgaggaatccgtccctgggatgtcctcatccccttttcgtcccaggacgagctcttcagtcctgccggataggtgcaggtgccatgcacccctagtgcatactggcagatccttgtagggaaggagagagtcttgggtgtgtgaaagggatagtggggcatcgtggcctcagagaggggcaggaagtggggtctgaagggctggaagttgctgcccttcgatttctctatgctctctcccacccctgtggctcttcgcccttggggattccttgccaccaccgctaccaccaccacctcaccccgtgtatcttctgaaagagaagtaggtctttcctcctgcctcaggcacaagccctcctggttcagggtcagaagctcagcaccttgccttctccatgatcccaaagcacaattggtgagtgggggagaggaccccctctccctgactccccaccctctagatcaggcagaatggctggcctgtgctgcgtctgcacacaggaagtcaccttcctttaatatattggcttgaggcctgcctgccctccccatacccagaaaatctggatctcccttgagcagttttctataaagtctgcaataatctcagatactctactcttgttagtggtgccgtatcattcctgctgaccttggagtactgatgggggtgggaggggactcttgggagggcattttggacttctttttggtggggcagtgacccttgatgcgttctcccagactgtgggaggagaaatgggttctgattgcacatagcaggattaaggttagatacatggagggacttcccattgggatgacattgttccccaagccagcctgctttctatcatcggaggaggggttatgcacagccaaagtgggattcgacacttcctctacatcctcttccctcccgttcctcatcttcaggatggggatggagttagactaagaaacattagcctcagccaagaccatccgggaggaaatccagctacagagaatgaggagttaattcagacaggaaagagggattgtttgctgctttgggatcatcccctctaatgaattattatctgatactcctttatgtcctgtgtcacttcacactctcctggccagagggtaagacctgcgtgttgggtatgtgagaggctgcgtgtggggagtgtggatgaaatgactccttgagatatgtgaagccaggggaccggagggccaggagggcctccaggtccccaggctggattgttttgcattcagggtcacagagccctagaaccatagggcagaagcctagaattctggcattttctaatttcagggccacataattctagaatgtgtgccttctaactattgaaaaggactgcagaggtaatgtgggaagcctcctaagctgtctcaacaggaggcatcatctcgtgatgggaggctccctccctcccttcctttcagtgtctgaggagcctgcctgggactctgacagccccagctttgccatggggccaggagcacccctcagcccaggacagctcttcacaagtcagagaccgtgcatggggctccttgtcttttcccggcacgctctctaccccttctccaagtcattcctcatgagaaagtattaagtcctcttgacacattcccctctgtcaatgacctccaaagggtgccccgcagtcccccaggacaatatagtgatggtctctctaacgcaagttagagcttgttagttgatttttgataactattgatttaatacttagtttagcagtagctctcataaaacctcaaagatttttgctgacaacccatagctaattgcagtttcacttgccaggacttactgtagtcttaagctacattagcagagagcatgtccttggaactgaggaggtgatctgtaaatctgtagatctctccagttccaacgatgtatgtgagagctactgctaagtatcaaatcaatagtcatcaaaaatcaacaaattgagtgtctactgtgtgccagttggtgtttaacgttagtaccattcactgatccccattaaatgtcttttctgggctgccatcctccttgctgtctgtcagtggcctatagccttatggggctatcaaggttcagggccgccagcttcacctcttctacaaacccagccattcactcagcccttactgaatgcaactctgccagtcctagaaaagctaacaatccagggaaggaatcacatttaatcaagatctggagaaaagaaatcccaggaaataatgagagctcagagtaagagccctgaccccacctagacagacttcttagaggaagtcacatttgaactgggttttgacggatgagtagaagtttgctgaacagagaaagatcagaagtaccaacttctgcaaaggtctggaggcaggaagatctcattagcctgaggattgaaggccagcaatggctgggggtaggtaggaggatgcgtatggggtagaatggatctactacattcaccacattctccactgggaagcgctagagggacctctgcccttgaaggaagagtcaggaaggtagagaggtgtgatgggggcacaggcaactgcactgtgcctcctgcttgtaaagcctggttgttccttccttctgcccatcctttttgtgcctggcctcatgctgggcactggagacacagagaggaatcaaaccaacaccatggccagatgagggcagtgagagaagggaaggggaggggagcccggagaagccttgcagtaaaaagtgagatggagcagccgactggccctgcccagactccctgacaccatccactccagactctttctcagaagtgccaggaccccactaaatggccagcctcctcctctgatcacacactgggagtgctgttggagtgtgaggtgagcagaggcccagaggcctggggcctgcctgcagaagccaaatgacagaggaagaaatctacctctaggatgtccccttaaggagcaggcatggtaaagaacaggagaggagaggacaggtgtgtatgactgtcagaaacgtgggagatgtgaagccagctgcacacctggagaaatgtggcagacttcccaggttctgtgacctcaaaaacactgtgaaattgcctttcaaagacgtctccttgagaagccttttgcttccaagccccctcacctactcacaccctcagacctgggctgggaaccagggaggacctagctagagtcgagaggactgggtttgagtctgaactcagcacctgacttgtcatgtcacctagtccttagccagaaataccagttgagaccctactatgtgccagggtctggggattcagcagtgaccacagcagaaccagcccctgccttcctggcccagcctgacactgtggcctcggacacccctgcctgcctctggctccgggttccttctgtccaggctggggctggacttgtgacctctaaaggcactgcctgctctccctgaagtccatctccttcttcattaagccgctgcctggcagactctcggccctaatttatgggtatggcctttcccagactgggagaagtgacgggggcagttaatattcctgtgctaataatacacttggctgccttctgagtcccccctccacccttcacccctgcctcaccacccccacctgcttccctcagcactgtcacagggcgatttgccaggagctggccaggcccatgcagaccctcaactaacccttcattggatgggtggggaaactgaggccaagagtatgcaggagctcgtccaggtcacacagattgtcaggagcagatcccgagcccaggatgccccagggctacccctgctctgccctgggtctgagcgtctggcagagccaccccgcctcctaacttgctatctccaccctgtcagtgcatccaggagccagtcccaagcctgaggtagcctgaagatgaaaataagaaagtgagccgtagagggttggaaggactcttcagcctctgtcagcggctccggacaggcctcaggagccccatgccagcatcttgcaggcagcggccctgctgggagttatgtctcccctccctgagaggagaaaggggcttgtctggacctccaggctctgaggtcccaggcattaaactcattcttcctgagcttctatcatctgagcatgaggctcacctggatgaaccagatcctgctcctgttctcgatcaagatggtgaccacacacacaggacactgtgatcatggaagcacagggatcccagggaggcccctaacttaggggatcatccaagctggcaaactcgggagtgaaaggggccactattaatcattacattggagcaagaataaactaggactggctgggtgcagtggctcacgcctgtaatcctagcattttgggaggccgaggtgggtggatcacctgaggtccggagttcaagaccagcctgaccaacatggtgaaaccccgtctttactaaaaatacaaaaaattagctgggcgtggtggcacatgcccactcgggaggctgaggcaagagaatcgcttgaaccctggaggggaggttgcagtgagccgagattgtgccattgcactctagcctgagcaacaagagcaaaagtctgtctcaaaaaaaaagaagaagaagaagaagaactaggactgtaccaagatgctgggccctggacttcaatgacttttgacaagacctggagagaaaagaaaaagtactagactgctagacaagaccagcaaatctaccagcaataaataacgaatacactccccttctttgaaccctattttccagctgcaccaaactatggggatgttagtaatagggcccagctcttccatgccctgtgcctttgctcacacagtaccctctgtctaggatgccttccccaacacagggagcactcaagacagcccaggagtcccccagtctttatgaccccgctgtctttctcctactgctgtaccacccagagctttctttctacggactggtttccttgcctcttgtctgcaccagaccagaagctcccacaggacagaggccagacccagtcactttaagtccccagtcagggtgcacagagatttgtgaacgctctcccagcccctgcccccacagaaatacaaaacacagaggaagaagcatcacgcaggactctgtggcctacccctctgcacgttgaatgggtgcttcctttgactcccacaacccccccatcattaaactggggtttcgattatataagatcccaggatggctgactccgttgtctacaaagtgagcgagcagaaagaaaatgcagttttagaatatgtggtcatgcaaaacacaatttagtcttagcctcttaactttggcactgatttatttgtttatttatttatgaggtcggcctctgtcacccaggctgggaatgcagtggcgttatcatagctcactgtaaccttgtactgctgggctcaagcagtcctcccgtctcaacctcataaagtgctgggattacaggcatgagccaccgcgcctggctaactttggctttttaatacaattacaacttctggccctgcgtttgggatctttgtccagggctctgtttgggcagcccctgctactggcttagtcttggttcctccccacagggagctgcagcgacatctattggccgatccgtgtgggagccgagtcagctttaacttttcttggtatacatgcgtcatctgctggtggagatgggaaagtgcctttcttcgttcagtcaacaatccaacaagtatgtaagtgcctgctgtgtgccaagcactgtgctaggaagatgaggatacaattttaaagaaaactagagccgggtgtggtggctcaggcctctaatcccagcacttcgggaggtcgaggccggcggattgcttgacctcaggagtttgagaccagcctagggcaacatggcgagaccccggtctctacaaaaaatgcaaaaaatagctgggcgcaggggcgccctcctgtaatcccacctacttaggaggctgagacgggaggattgcatgagcctgggaggtggaggttgcagtgagccgagatcatgccactgcaccccagcctgggcagcagagtgagaccccatctcaaaaaaagaaaaaagaaaaagaaaagaaagaaaaccaataagatctctgtccttataaaacagtaatagtaaaaactaacacatacagaatttactatgtgccagagattgttctaggtactttatatatattaatccatcttgtcctgatgacaattctgtgaagcagttattcttattcctacttcacaaatgaggaaactaaggcacgtagagatgaataatttgctcaagatcacactcctaataagaggccaagttaggcttagaactcaggctctgctccagagccctcttcttatttagaccataaacaagcacgatacttatgagggaaataagcagggtaatgtgagagtgagtgacaaggagaggtctcctttgagtggggtaagtcatgaaagacccctctgagggcgacctaccctgaagaatgggaaggaacaagctatgcagagaatctaggaaaagttaatccaggcagaagcagcagcgagcacaaaggtgctgagaccaaatactcaaacatcaggtggaaggcaagttctggccactctactcctacacctccccacactgtccttagactcattccccacctggtcgcagcttggacttctctcatctgcatccctgccccagcttcctccctgttcccccagcctgcagcccccctctctggtcccacactgcagcccacactgcagtgaaaatgcgtgaatctgatccctctccttactctgcctaaaacctgtcccactgtcttctggataaaaacaaagatctttgaggccaggtgcagtgagtggctcacacatgtaatcccaacactttgggagactgaagcagaaggatcagaggacaggtgttggagaccaggctaggcgatatagcaagaactcatctctacaaaaaacaaacaaacaaacaaacaaacaaaaagcttttttttttttttaactgattatctgtaacttccacccactaatcaaatctcctgccagcttttccagctcccttcactcttgtcactccaatgtggttatagttgcctgaaggccccagcttgtctcaccctgagcctccctgtgtgctgtttcttctacctgaaggtctgtagcccctccttgcctacctaattccctttttacccttaaaaactcagttcaagaccaggtggggtggctcacacctgtaatcccagcactttgggaggccgaggtgagcggatcatctaaggtcaggagttcgagaccagcctggccaacatggtgaaaccccgactctactaaaaatacaaaaattggctgggcatggtgggtgtgtgcctgtagtcccagctactcagcagaagaatcacttgaacccgggaggtggaggttgcagtgagcagagattgtgccactgcactccatcctgggctacagagtgagactccgtctcaaaaaacaaaaaacaaataacaaaaaacaaaaactcagttcaagcatttcgtcctcttggaagctgcctatttctcatcttggccactctggctaaatgtgagacctctccttaggtgctctcatggcacgctgtgactacacaacaggccccctctgcaatactcctcatcagcaattccaaacctttagcatcatgccttatcccccaattaatctgtaagcaatttgactgaagggattgtcttttttttttttttttttttttttttctgagactgagtctcgctctatcgcccaggctggagtgcagtggcgcaatctcggctcactggaacctccacctccccgatttaagagattctcatgactcagcttccagagtagctgggattacaggcgcccaccaccatgcccagctaatttttgtatttttagtagagacagggtttcaccttgttggcaaggctggtctcgaactcctggcctcaagtgatccgcccacctccgcctcccaaagtgctgggattacaggaatgagccactgcacccagccaggattgtctcatttaatcttagtgtcttcagggccagcagaagccccaacaaatggtacatgcccagtaaatatcgtttgcagttgtgagctgtaaattgctccatttctttttattgaaatttatacaaagtccactctttttggcatacagttctatgagttttgacaattaagatatagagtgttccattgccccccaaaatccctcttcatagcagccctccccccaagtccagccattggcaactactgctttgttttctgtctccatcgttttacctttgacacagtgtcatataagtagaatcatacatgtttgtccttttaaatctgacttctttcacttagcataatgcagtagaaactcatccatgttgtaggtatcattatagtttgttcatttttattgctgcgtagtattccatcatatggttgtacaatcatttatccattcaatagctgaagagcatttgggtggtttccagtttttgacaactatgaatatagccactgtaaacattcatgtacaggtttttgaaggaatgtcactttttatttctttctttattttattttatcttttgagaaaagatttctctctgttgcccaggctggagtacggtggtacaaacacagctcactgcagctttgaactcctgggctcaagcgatcctctttcttcagtctcctgagtagctgggatcacaggcatacaccaccatgcctggccaattttttccttttttgtagagacagggcctcaccatattgcttaggctggtcttaaactcctaggctcaagcaatcctcccactttggcctcccaaagtgcttggattataggcatcagctactgcacccagccactttttctttgaagagtggaactgctgaatattatagtgagtatgttcaaatttattataagaaacttccacattgttttccaaagtgtctgtaccattttgcatttccactagcagtgtatgagagttctagtccctctccatctttgccgaaaccatttgttgaaaacaacaactgaatttcctttgtgccttcgttgaaaatcaattgaccacctatgtgcaggtctatttctgaattcccagttctgttccattgatataggtgtctattctttcaccactgccacactgtcttgattactgtagctttctagtaagtcttcagaccagatagtagagtccttcaactttgttcttctttataaaaattgcttggctattctagattttttacctttctatataaatttggaatcagtttctctatgtctttaaaagaaaatcctacagaggtcttgatttgtattgtattgaatctactgtcactttgaggaagattgacataacaatattgaatcttcttagctgtgaacatggtatagctctcagtttatttgggcctatttgatttctttcatcagtactttttacttttcagcatagagattgtgcacatattttgttaggtttgtatctgagtatttcagtttcgggtgctgttataaatggcatcatcttttaaatttctatttcagttgttgcatgttactctacagaagtacagtggatttttgtgtgttaatcatgtttcctgcaatctatctaaactcagttattatttctagtagctatttttttgcagatttcttaggatttttaatgtagataatcaagatgtctgtgaatagaaaccattttcattttctttttttagagacgggggtctctctttgttgccaggctgcaatgcagtggtgcaatcatagctcactgccacctctaactcttgggcttgagggatcctcccacctcagcctcccaagtagctagaattacaggcatgcaccacggtgcctgactaatttttaaatgtttttgtagtgatggggtcttgccatcttgcccaggttggtctcaaactcctgggctgaagtgatcctcctgccttggcttcccaaagtgctgggattacagttatttagcctctgtgcctggccttattttatttcttctttataatcagtaggccttttctccctttttcttgtcttattgcactggctaggacgtctagtataatgtcaaataggagtggtgagagtagtcatccttgccttgttcccaattttagaggaaacgtattaagtctctcaccataaactatgttagtagatgtaggtttttttgtagatgctctttatcaggttaagaaagttttctaagagcggtttgcttttttaaatcatgaacagatgttgaattttgtcaagtgcctttctgcatctgttgagataagcactgcttttgctcaaaccccaaaatttagatatttgtttttattttcatttcacttcataaatttccttgtgatttcttctttggcccatttagaaattgcttaagtttcaaatatttgcaaattttccagataattttctgttattctagtttaattctgctgtgaccaaagaatgtacttactaaattcttttaaatttggccaggtgtggtggctcacgcctgtaatcccagcactttacaaggctgaggcaggaggattgcttgagcccaggagttcaaaaccaggctgggcaacatggtgagaccctgtctcaataaagaaaaataaaaaaatttaaaataaaaaatatataaattatttaaaatttgttaaggttgtttttcccagaaaatagttcttggggaatgttccatgtacacttgaaaaaaaatgcatagtcaattgttttgagatgaaatattccatagtgtctattaggtcaaactgatatcgttgttcaggtcttctatatccttactaatattctgtcttcttgttccatcaattactgagggaggaatgttgtggatttgtatatttctccctttgattctattacattttgctttgtgtatctggaaacaccatgatcagatgcacacacatttagggttgttatgttttcttggtaaattgacactttcattattacttatgtccctttttatccctggtaacatttgttgttctgaagtctattttgtttggtattaatatagccatttcagctttatttttattattgtttgcatggtatatcttcattcttttcataaagacatgcctatctatgtctttatatttaaagtaggtttctttatatttaaagtatgtttgtggacagcatataattggatcttgttttttaatccaatctagcaacctctatcttttaattgttatgtagagatcatttacatttagtgtagttattgatatggttgtatttaggtctaccacttttatttttctgtttgtacccctattttttattcctttgttccaactttcctgtcttcttttggaatacttggatatttttaatatgtcattaaaatttttttttactattgtgatttatctatatgttcggctctattttagttgttgctctagggaccacaatatacatatataacccttcacaatctacttagggttaacactgtaccatttcaccatttcaaatgtaatatagaagccttaaaaacaaataggtttaccgggtgcggtgactcacgcctgtaatcccagcactttgggaggctgaagtaggaggatcatttgaggtcaggagcttgagaccagcctggccaacatggtaaaaccctgtctctactaaaaatacaaaaattagccggccatggtggcaggcgcctgtaatccgagctactcggaaggctgagacaggagaatcgcttcaacgcgggaggcggaggttgcagtgagccgagatcatgccattgcactccagcctggggaacaagagctagactttgtctcaaaagaaacaaaaacaaaaacagaaaacaaataggtttctctccctccactgacctttccattatagttgttatatgtatttcatctatttatcaacattggtaaacctatcagacaatgttataaatcttttttcaacagtaataagccaggtgcagtagctcatgcctgtattcgcagcactttgggaagctgagacaagagaatcgcttgagctcaggagttcaagaccagctgggcaacatagcaaggccctgtctctacaacaaaaataaagaaaatttgttgagtgtggtggtgcatgccagtagttccagctacacaagaggctgaggtgggaggatcacttgaacccaggagttcaaggtggcagtgagctatgatcacaccactacactccagcctgtccagcctggatgaccaagcgagaccctgtcaaaaagcaaacaaacaaaaaataaacaaacaaacaaaaaacgccaataataagtactttaaagaacttaagaagattaggggataaatgataaatatagccttttaaatttatccagataattaccatttctgttgctcttaatttctaaacatctgggtttatctctggcattgttttaaactaaataattttgtttagctttttttttttttaagagtaagtctgctggtgacagattctcttggttttccttcatctgataatctattttgcacccttcttgaaggatgttttcactggatatagatttctgggttgacaactcttttagtgctgtaaagatgttgtactcctttcttctggcctccatgtcttctattgagaaatccacgttctgatagtcatcctttgtatggaagaaaatacaagaatgtgtccttttctctagctgctttcaagatttttaaatttgtctttggttttcataagtttggatattttgtatgtttatgtgtgattttctttgagtttaacctgtttgagatttgcacaccttcttgaatctataaatttatgtcttttaccaaatttggggtgttagtggccattattttctcaactattttttctccatcagtctctttctcctctcttctgggagtccagtgacatggaatcttaggccttgtgatattgttccacaggtccctgagactgttaatttctttcaacctattttctctgttttttcagatagaataatttctattgatctatattcaagttcactggctctttcttctgtcaaccccccattctgctatgaacttatccaatcaatttttaatttcagatattgtatttttcagttctaaaatttccatttggttcttttttaattgtttctatatctctgttgagaactatttcaatccatttcaagttataacagccacttcaaaatcttttataattccaacatctaagtcatcttagagttggcacctgttgattgtatttttccttgaggattggtcacatttttatgggttgtcaccccactcccccatctttagttttactttccctggtttcagttatttgcactcaatgacagttgaaaatattaaatggaaaattccagaaataaaaaatattaaatggaaaattccagaaataattcataagttttaaattgcacaccattctgaatagtgtgattaaatctcacagtgacccattctctcctgcctgggacgtaaatcatcgctttgtctggtgtacctcggctgtgtatgctatctacccattagtcgcttagtagccatcttggttatcagatcaactgttgcaatatcacagtgtttgtgtttaagtaactcttattttacttaacattggccccaaagtgcaaagtagtgatgctggcatttgttataattgttctattttattattagctattgtcgttaatctcttactgtacctaatgtataaattaagctttataataggtatgtatgtatagaacaaaacatagtatataaaaggtttggtactatttgcagtttcaggtgtccagtggggatcttggagcttatcccccatagataaggggggactaccatatttgtatgttgagtaatttcagattgtgtcctggacattgtgaatgttatattgtatagactctgggtcctgctataatcctctatagaatgttgatcgtgttgttattgttgtttcaggaggcaatgaaccaacttaagttcacattctaagctctgtctcactttctgtggatggtggttctaatcttagtgaaaagccacgagaaaagagaaaaatgggaaaatcatcctatggagatgacttctctaaattttaactcacctgtatcatttgccttcttttgtctaactttcacagagttgttatttaattgtgttttgtatttttgtccagcgtttttcggtgtaatcagtaggagagataagctataatgaatttactccatgttggccagaatttgaacctcctgctcagtttcttttgatttgctggagtttaaaaaagctaggagaaatgaagctccaaagcacagtgaagacagtgatagtggcattaaggttgaaagctatgagaaaacagcaaatatctctcccttgtttggaatcctgttcagatgtcaaagcattccttccaaattgtggtaaccaggccaacataactacttctactttttggatgagaacactaaggaagagcttgccatttgcctgtttgatctcagatcaaatcccttgaccttctcttgctctgtattgtcaggccctgaccattgcaaactacattttcatatttcttgaaaatcagcttttaattagattctgccaataggaggctctggcttaaatttggaggacaggaggagagaagaagccagagcatgtctccagtctctctgctttgggcagcattcccagcaagggtgatgtttcctctgtgcttctggctttcgtagataccctcttccccaatgttcctgctaggctgccctggttcctcagctcctctccttgtccctccaccctaggggtagtaatggtctcctattgtcccacatctttgggtggtctcaaaccccatttgcactttcatctcatccaacattttaataaacatttccccaattaaatttctttctttttttttttattttaaaaaatttgagatgaagtctcgctgtgttgtccaggctggccttaaactcctgggctcaagcaagcctcccaaagagtgagtcactgcacctggcttttttttttttaagtgacagtttctcactctgccacccaggctggagtgcaatggtataatcatagttcactgcagccttgaactcctgggttcaagggatcctcctgcctcagcctcccaagtagttgggactacaggcatgcactactactctcagttgttttttctctctctttttttttttttttttttgagagatcggggggtctccctatgttgtcctagctggttttgaactcctggcctcaagagattctcctgccttagcctcccaaagtgctgggattacaggcatgagccactgcatctggcccaattaaattcctgctgcagggatagactgcttatctggactcagactgacacagtccatatgcgagggcagctgaacaaaagctgtagctcaagtctcctgattcaaatgtcagtgtcttcccactgccctactctggctggaagggaacatcagaggaaaagactcctttctgggcaaccaggagggcaatgttctgatctacattgcacagtattttacaggaatgttaaaaaatatattgttcacctggagttcaagaccagcctggccaacatggcaaaaccccatctctacaaaaaatacaaaaatgagatgaacgtgttggcacatgcttgtaatcccagctactagggaggctgagacatgagaatcgcttaaacccgggaggcggaggttgcagtgagccgagatcgcgccactgctctccagcctgggtgacagagcaaaattctatctcaaaaaatatatatatagaccgggcacggtggctcacgcctgtaatcccagcactttgggaagccgaggcgggcggatcacgaagtccggagatcaaaaccatcctggctaacacggtgaaaccctgtccctactaaaaatacaaaaaattagctgggtgtggtggcgggcgcctgtagtcccagctactcaggaggctgaggcaggagaatggtgtgaacccgggaggtggagcttgcagtgagccgagatcgcgccgctgcactccaacctgggcaacagagccagacgctgtctcaaaaaataaataaataaataaataaataaataaataaataaataatatatatatatatatttcatatataattaattttctaggaaagtcatcttatatgcatgggcgtcttccttttgtgttaatacagtacattatctattagaacatcgactcttcctcactgatatccttactcctcccatatgttctgttagaccaggtggcacataagtctttgaaaactgaagtgacttcaggaagacccagcagggcaggagataagaagtgaacaagaaccagggctggggctggggtgaggactcccactgatgtggtcagtggtgccaaagatagaagataggatggcttcaccccaggagcaaaccatgggtcacaaaatcctgtggtatctgagagggatgagaggtatgccagcttcccaaggccataaggctgaaaagtggcagaagagggacaggagaaaagtttttggcagtctccagaagttggtacaaggaccaggctggagctggggccacagacaagggaagagagcacctcacccagtcatgagccccatctgccagtccagggcagcagggaggcatttcttggtctttgacctgccatgggcttatgagacagaaatgaaagcacagccagcatcctctgccacaaaagacctttaatggcctcctatttattgttcttttgttcatttgttagagttgaatgaactataataacttgtctgacataataagaatgccacaggtataacagataaacctggcaggtggtccaggaatgagagtgtcacaaaataatcactcaacacaagggccacagacctggagattcttcccagccatccctcactcctgccccaggacacaacccatgcaggcccccattccataggaagaggcaggtcccacagtgtctgtggctagaccttaacactgagcagagatgcccgggaagatggcacttcctatgctcgttcccaagtgctctgctcatctgccatgcaggtcaggaccataccccgagtttgtgaggcacccacctctcatactcaccacctcatatgaccacctatcatacccacctctcctatgacccttgcaattgtcccagtgaggtgggaagagcctggactagccccattttgcacacagggaaactaaggacacactcggaccgaatgtaatacacccgtgtcatgcgcttgctgtgccctgagcttcacattttcacctagaattccctggggggtgggagtgggggacagggcaggcagggttttgtgccaagggctggtccagttctcactaaagtgtccaggattcctgggggaatcctgccctcaaaggagggacttttgtcataaaatcctccctgagtctgtcttttatgtgagccaagatttccatccatccggcgctgtgtaaagatgaatttaaccctagcctctctcctatcacactgcttctcctgctgtgtcccttgggcctaggccaggaaagtggggtgccagataggggtgcagacacaagtcctcagtgggggattgagcctgtttccttgctccagagctccccatgcttcatgggccaatatcagggtcacgacccatccccactgagcaccaggtccctgtccaaatcaaaccttggccagagcttcagggtgggttggctagaaaaaccatcaactatgtacgtgtgtgtgtgtgtgtgtgtgtgtgtgtgtgtgtgtgtgtataaatgcttgtgcctgggtctgtgacccaagttccaacacaaagacactttgtactggaacgctggagccattccaacatgaacagcaagaatagaacctgtgctggctggtctaagatcaaacctcgagatggtggtttgaagttcttcttcaaagaaagcttgaaaatgaaatctcagtaggcaagacagataaaagcagagttattctggtggcggcggaaatgggaggagggctggaaacctatcctttgcctccactcccatcttcccactttagcatcccctgacaaagctctgtggaatatcaggggttccgcagcacctggtttgaaaaccactgtgtcagtgtctacaaaccataggccccacggacctgtgctttgacttcccttttggggtgacgagttggagtgtgatggggggaggatgtttccccttcaacagggcgtgtctttgaagccgctgtgcagtgaccctgtggggaagtggtagaggtggggtcctgccactttcgtccaggaggaatggcagaagagatggagctgcctgggccaggaggaaacaccaagcccagtgcaggccgtatagatgagggttcaggagtgttttggtccttttgagtttaaaaaattatagatatcagaacaggcataggcctatgtccatgagaccctataagagtgtaagactgggacctaaccccttcctcctggatgggtggagagcaaccagtccccagtgacaggcaggagagaagctgccgctctgggatgctgacgccactgcatccgctgtggctcggctctcaggacaaaaggcttgggtttttcctgggcccgaagccctcccaatgtcactgagaagctgtggtggctccagttgctcctggaagaggccttacactttgaagggaaggaacagacaatttctatttctccttgcccttagatttctgcggatgggtggtttcagctccctgagcctgggggctggtggctctctttaacctgggtcagagccaaggccccttggcctctgtggggtctgagagatgggagatgtgacaccaggcctaggagggtccaagatgtccccctccaccaatcactgacaatatccaggtcttccctctgtgtcctggttgctgggaccactatttttgggcatgatattcctgaattgtatctaaatttccctctcagctgggtcatcaaagccaaattggctgtatctcattctggttgacatctgcctaagtgagaagcagggcaagcgatgaagactggtggggagggctcctcctgcagcaaactttctgtgtgaccttgggccatccctgcagtggcagggccacacacatccagccattttcaacttacagagccctgaccgctgactttcatctcatctgggcctcataacaattcctgcgtcaggcagggaagggattacaatcccattttacagttagggaaattgagccccagaggttgagtagcttgcccaagccccccaggtggttggtgacaggcaggactgagaggcggcattggggacttccaggacagagttcctttcactgcaccatgtaggaaccagcttgtcaggaactctcccacagaaccaacagccaggtgaacccactctagcaggtctgagctttgaggctgaggagaggtgcagccaaataactcagtccttatcttcatggggactgaactcttcccctgggtggaatgctgaggaggtcccgctggctctctgctcggtgggttttcaccggggcatgcttttccttcctgcccggaccggtgtccacacgccacccacagggcacactgcaaagtcccagtgacggatggcttggccagtgcaggccccaaacacttggcagagaaaccgccagtactgtgggatggtgcctggggcctagtgaggctcccccacccctagtttcacttcaaggtatcacctgggcaggctgactccagaaaggaaaggggccctgcagagaagcactggctcggccatgtttgggggctgggaggtggtgcctggagttgaccagaagcttggaaacatgacctgcggcttcctctccaggaagaggctgaaggaaacactttggcctgtgtgtccctcgaggctgcagcgtatggccgtgcagcagggcacctctggccaaggggcaaggggtgctaaaatccaacctgtgtgtcactcccaaagctgtgcgttctagtgtaggtctgaatccacctggaaagggcaccgtcttctaattcacatcaaggcaccatagggaccagcagccaccaggagccctgaaggcaactgccctctattacttatccctacaacgtttccctgaccatgggcttcctgaggacaggggctgggactgacccatctctgtggctccagtacttggcatagagctgagtcatcagcaaaggatggtaggctgaattcaactaaatttggccattgccttgtgcagtcctggctccaggagaaaaaaaaaaaaaaaagatagtgctctgatccttccctgcagctggagaaatttgctaaataacactgggctaaacccaaaagggtgagcgtgatgttgaggtgcaggaggctcgggaaaccagcctgacaaacgttttccatgcatgagttagggataggggaagaagtctgcaggaaagaggtcatcccaaacactaaaggatcttgtgtcagccccaaaggtttcagaagacactggagggcatatgtttgccatgcattgctccagcatttcatcagctctgcgcctgcccagatgaggtgcagcctgcccagcaagctctaggaggggctggatgcctgggggacctgcaactaggccctcaagactggacagggtagtacgacagcccccagctgacttggttctggtctggggaggggtcccttgggttgagtggtcatgagactcagaagtcgcgctgccaggcttgtgaaacaggtgatttcaccacaggaaataagtcacactgcctgccccaggaggtgctggactggaaaggattgagatgccacttgtataagattttttgtctcccttttcagacaagtatgggagagagatggaagggagcagaaactgaggagagagcccttgtcctgctaatcaatatatttgcctgggtaaacctcagggtgtctgtgcccacagggggctgtgaggtactgcaagccctatcataagcccctcagccaagcctcagcaaagatatgctctgtccctccttgggcaactcatgctacctatggccacagcctgacatcaatcccttcccagtcttgggcacagggtggggttgagggcagttggtgctccatagggccctgccacctctgaggtccaataaatcccctctggaggcagagagaccagtcagcagctctggctctacccaccagaccaggagctctaatgttcacaaattcttggtggccagagctaggaaggcccattgtgatcatctggtcaaactccttgctttcccaagtgagaaactgaggcccagagtggggaaggaacttgcccaaagtcacacagtaagttattctcaaaggccaggcaaagaggataactcctaacactttctatctcatctcccatctggcttcttgccccaggaactgccccaggtctcaatcaacccaacaccagctaatgcgtactgggtacccatgacactgggagctattggaggtcatcaactcaccaagaaaagaaggggcttatttgctacccagcagcctccttcccttcgggtgaggatatctcagtggatgctgccaccttctgagataggaccccctttgactgtggcatggtggcctcaggcactctctcccagtccatagggtcagtccagccctggagaatggcagggggaagcaggaggatactagtggcctcggcccccgctggacacccatcctcacttcctgcatgaccatgtgaagtccacaaggaagggacataaggcagactctcctctccccgccccctgcccccatctctgagcgccccccttcgggaaccctcctcaggagcttcagctcactctgctgggggctggtgcttgctgaagaccccctccctccctccctctgcttttctctctgtgcatatctctagacagggccatgcacttgaaatacaaggtagctaagatgtcacagcctgacagtactgaaatatacttgggtgagtccacacagcttgcctcagtctaggtaactgctggtaagaaagtcagtccagttgcttttctctactcctggggtctacgaactttcaccaacatcactatcagacacagagggacatcaggtggggaggagggtgaaggcagaaggtctttggtgggtcagaacttcaaaaaggcattgagaatctgtccacagttctgcccctcccagccagaaggaggtggccttcaacgcggtcatcttttagctgccagaactttgttaaccacctgggaccgtggacatcttctctcgtgtcttgagccctcatccccacccctccaagccctcatgcccaccacaccgtgtcccacattccccatcctcccctgtctgctccccatctcaagtccaattccaaggccagagccctggcagcttttctgggagacagcatgaaaaggaggggagtggagatggcagagatggggtggagccagtgcgctgtggtcctgttggcgtggtgatgtggggccaatcctgaggccagaggttcatcaccgtgatctggaagcccacggggccccctggtagaaactggaagaacaaaggggaaaagaaaccagaacaggaagaagacgagtaagcatccgagtgcacgagagtggagccggagccacgtggaggcagggccggcccgtctatctgttgttgagctgtggagagccggtaccatcctcctcttcctccttgtcatccttcatgcctttcagtctctggcgagcaaagtcctcaaatacaatgtcgtcatcactggtgggagagacaaggaaaatgtggtgtgtttgcaggggcagggagagtaggcttatccagaggcccggccagatgtgactcagagtatggctctggggccggggagaaccaccctctctgaggtctctggcctctggggctgaccatgagcagaaaggcctgtctggctggcacatgtggatgccacctgtggcagtggggacagtcacatcaggactcgggccagtcatgaaaggggcagagaggggcatgaatttgactcttgtgcctgagggctagaaaagtaacctggttctttaggaggtggggggagcagtgtggctctgtagccagaggaaggacttattcccactgtgagaggccaggccaccagtagtttcacagcatgttctgaatcccccaagaataggcccggcaaaccccaccccaccacccagaaaactacccttaggaagcattcccgtttctggacagcaaggagtagtttggcttaatgaaagagaagaccatgaagaacctttctcccagaagtgtcagctcagattctaccttgggggatcccagacagaagaaggctggggtaggaggatgtgaatctaaataggggggcagaggacctgttcgtgaggaaaggggaggcttgagtggggtttcaggactagactgcctttaagaacagcgagttcccttctaccatgaaacatgtccatttaggaccatgcaggtgtccacctgggtcccctgcccaacagggttcagccagtgcatggggcatcctcatggggtgacctgagacccccacaccccagatttctcctgggggacaagggaagattggctttggagctggagcaagaaagccacttggacctggaggcggtccgcgcagtcggcccaggtcctccccctctggccactgtccggtgactcgatggcctttgactgcagggaaatccacatcggttggtcctcaggagtcagaagcaacaagatccccagtcccctgcccaccccacagcctgattccactggttggcgtgggcaggacaggagagccgagcccagggccatggaccagccctgtgtgagccgagcaggcgctgtggatggacgaacggactgacggacggacgtgcaaggacgagggaggaagacagaccccaccaaggcaggaggaagaggaacaggcacggagggtccttcaagtcacatgcaggcaagcgggttgctgaagaggcgagcagaggtggctctcagcagacggggttagaccagcggctcctcaggagttaataagcatatatgcaaatgaccccctccaccccgcccacccgcggcccacccccggatgtctgcaggcagggttcagcttactttgtgtcaagttctatgagattggtatctactggcgtctcgttctctggaactaaacacagggtgggtgggcagggtgtccagggattagtgagtggatgagcacggggcgagtaagcacaggcccccaccctgggacaaccagactaacatgagaagggcaaaggataaaggggaatggagatgggggaggactcattcctggtactgaaacaccccaaatcatctgaaaggcagggaggatggcaccaggagggccccggatccccactgcagccccagaagaacagaaaatcctctaaacttctgtttcttttgacaggtctccaacatgaattacattaattccttgcatgcatgccattcaccaattctaagacaatcttttttatattttccttcacattttaacatctccaaatttggagtgtgtcttaccgtcgatggcactgcacagtttaaccatggaagttttttcctaattgtacctactattatgttgtctctctccactgaaagtctcagattcaatgaaatatgaccaatctgctatcacttgaaaaacaggccaggccaggcatggtagctcatgcctgtaatcccagcactttgggaggttgaggcgggaagatcacctgaggtcaggagtttgagaccagcctggccaacatggtgaaaccccgtctctactaaaaatacaaaaatcagccaggtgtggcggcagccgcctgtaatctcagctactcgggaggctgaggcaggagaatctcttgagcctgggaggcggaggttgcagtgagctaagatcacgtcactgcactccagcctgggcaacagagtgagactgtgtctcaaaaccaaaaaaaaaaaaaaaaaaaaaaaaaagaagaagaaaaacatgacaatagcgtgtccaacggtcatcttatccaagcagccccttcccctacttccaaacgggatccagcccatgcctgggtgcaagatagaggctcaaagcatggccaatgagttcccttctccactcctggcctccctctcccatggggaacaggagccacgcctcactgtctcctggtggggtcagaagcaaatcgagttctggaccccacaaaagatctggggacccgagaaaagggtgactgggctgagggcgaacccggggcggggtgggttacagggtcacgtggcagctgctagagaacccctaccccagagacctacagattctgctcaccttcccgatgcgggggttcctctttgggcttggggtgcattagggtgaagggcagttccacggccacgtcgctgaaacagagacccagacccagtgagccttgagcggactcacaggctgtgagacttgatgtcgatgccctgtcagtccgaggactgcagagggttttgccgtcagaggaggtagatccaaaagatgccctccagccccagttctgccactcggagcctcggtctgcctgggagctggacgaggagacttcctctggtcccaaaaagaaatggaagcctcctctttcctgagaaggctctctgggttcccacgggctgggaagaggcccaggggtgggaaaggattgcccggggcagcatgcaccgtggtcactgcggggctccagaggtgccctgggacccccccccacctcaaatcgccacagccaccctcgcctcccctgacactgcccttcccaacttccaggtcggagctcctcccaccctcacgccatcccatctcccaacacctccagggtgctcttgtaaaagtgctcaggtgaccctagcacccctgcaatctggatgaagcactgttgaggtcagtttagtcaggtttaggatggccccagggcccaaggctgattacactgtggggatgcaggggaaagcggccgggaagacccagccaccagccagtgcttctgatggggctttctctgtacttggccctgatggacagaataagagaaggtattcacatggtactgaccctgtgccaaggattactgtaagccccttccatagagtaactcatttaatcctcgcaacaaccatattattatccccaatgtacagactgggacattgaggcatgaggagattaaaatatcttgcccaaggccacacagctattaatggttattattagattctggctccataaccacacccttgatcactgtgtgacagtagcagaattgagactaacaaaagcaaccctgaaggctcctctcggcttggggtgacatcaccctaggagaccacccaactgcgagtgcctacaggcacaagccacatcccactgatcttgttgtccagagcccagttgggaaagaggaagggacagggaatggagtggtcagaggcacaagccgtgcaattagaaaggtctgttccaccagcctcgccacccgctggtgcagcactttctagctttgagtctcactgagctcaacttggaacaaagcctgtcttctagaaccacgggaacttctgggagatgaggcagctaaagagctgagttaaactgtgaagcttgaccaggcgcagtggctcacgcctgtgatcctagcactttgggaggccaaggcgggcagatcccttgagctcaggagttcgagaccagcctgggcaacctggtgagacactgccaccaccacccatctctactaaaaatacaaaaattaggctgggcgcggtggctcacgcctgtaatcccagcactttgggaggccgaggcgggtggatcatgaggtcaggagtttaagaccagcctggccaagatagtgaaatcctgcctctactaaaaatacaaaaattagccgggtgtggtggcgggtgcctataatcccagctacttgggaggctgaggcagagaactgcttgaacctgggaggcagaggttgcagtgagccaagatcgtgccactgcactccagcctacccgacagagtgagattctgtctcaaaaaaaaaaaaaaaaattagctgggcatagtagagcacacctgtagtcccagctactcaggaggctgagttgggaggatggcttccacccaggaggcagagaaggttacagtgaaccaagtttgtgccactgcactccagtctgggcaatagaatcagaccttgtctcagaataaaaaataaaaataaaaatgtgaagcttgtgcctgccagaatcgttacttaagtcccctcattgggaacctgggggttttataaggctgtcagagctatttggcctttttttccttctcttttttttttccttttgctttggggattgcttcagaatggagctggtggaagactgggtttgccaacattttagtggaagaatctggatcttaaccttctaccgggccaggaacgataaggtcagggaccacatctgattcctctctgggactctggcactcagcaccagcctggacgcaagcctgggttgaggaaatctttgctgaatgatatggaactgaattgaattgaatgaatttcacctgtcaaattagtttaagatttcttaggatgagccacactgccatcttgtgacagaaggaggccaaactgctgtgtttggggtacatgcatttttggaatataagtgcatccagctggctgcaaggagaccttgtttacaaaataggatctcctgaggacctctccttagcaacacttggccagcagttccctcctcactagtgtagaagtttgaaagccatgaagtctgcatttctccaaaagctcctataattcaggtgatcagtaattcagacagctctcttgggggccactccctgtatcagtgtaatcaggctttgctctctgtaaagatccctgtcactcaggtgggatggaagagcaaggtgaggtttgttaaggagaaattgtgtctcccagctcacacctgaacctggctatctgaaatgaccactaagattccttccaacccagtgccctgtgattctggtcagtcaagccaatgggctccaggccctccaggaaggtgggtgaaccaggtggaagggaggaatttacctggatgcaagatctcccaacaggctgggtgggtcagaggaggcaggagaagtggtcaggagagagttcagagaggaagaaaacaaaaagcacattcattcaccacttctgctgtcccccggatagagaagacccacgggacacactcccacccacccccctgcacagccctgactgctctttcagggatacaccgaaatggcattagccctgccccgagggactgggatccagacccagctcagcaaacccctgagccccaggatcctcatctgtcaaggcagtgtaaaaattaaccccagtgctgcctgtcccaagggaggccggactatctaaaggcagagggaaggactccggggttgccaagaatgtttgagggactgtgggtcctgaaaggtcaccagacacaggatttgggatttgtaattttgagatgtcctattatataaggtcaggattacatactgccacctgccaagaggcattcttctaataatcaaggagacccaatgtctaatgggatttagcttttcaatcttttcatagaaatttatgaattaagttacaaaaaagaaacacagtagtttgtttgtttgtttttctccctgagcttccaccaaactatgctccagggcagggcagtctggtccaccactatgacctgagttaggagaggagatttcaggcaatgtttggggcactgtctgggcctctgtttcaccatctgtaaaatgggaaagctgactagcaaatccccaatccagctctgggttctgagcccttttagctgtttcctcagaaaatcagcttgggcatgcatgggggtgggtgctatgcccaaagtgtgataaggagatggcacccctggggaccccacagcaaagactctgaggacgccgtcccctgggcatggccaatcctcagtgcgagcccagacctaggatagaggaggaggagagagagaaagagatgggtgggggtaagagaggggctgagggccaaggaaggaagagagggaaagcgggcgggggagaaagaggaacagaagggaggaaaagaagggacaggaggttcctcctccaaggtggatgcagctaaaagggctgcaaacaggcagaatggggcaggggcctgtgggcacctgggacgctcccctctgcactccggggtcttgggcttggctggagcactcacccgccccgagacaccaccagcttcactttcactttgtaggaaacaatgatccccaggatctcacggttggcaccttccctcaacctgcaaagtgacacaggggagccagttcaggggccttgccaggtgggcgagacacctcaggggtgggtatgctggggggcagtggccgtccatcccccatctggctagccactcagctaccatgtccaatagagcccagtggagatgaggaaggcgagcagtgcccttaggtagcagggacccagagccccggttccaagtctgactgtgagactcgctcactgtgtggccctgctgagcccctctccctgcccaggccagcgtccccgccatgagggccaggctcctcctcccctcagatggattctgcttctctcagcaacccatgggcagaaagggccacacggggagttcacagagggcgaggcagctggggtggggtggggtgggggccatcagagaaggacttctccgcagaggtggtgcttcagctgggtcttgaagatgggtagggtgtgagccagggtggagacagggcaaaaagcttcaggtaagtgggaggctgtgcaggggctgctgaagagagctgagtctgtgctgggagtggcggctgctctagacgtaggccaaagccccactgaaggaccacactggcaagagggcaagatggcatccccatagccagggctctgctggagcagagtagcctagaggcgtccacgatgactgtgcagcaggagtgaccagatgccctgggacccctgacttggaggggcaccccatgttgggtctaacccagctcaccaccctggtctctcctcagggacaccccatctgactgaaggcattacgtcagaagctgccacctcttgcaggaagccttcccaggttgccctcccccaggcatggtagcagagcccagcactgcctgagtgagctggcctagtggtccatcttattctctcagtcacccctgggtagggttgggagtaaggaggcagcttccctgacaagtcaagcacctgaggacaggccctgacaaggctatggagagggtagcctgagccttgtctttgaactggggggaccaaggagggtgtggccccatcaggcaagatgcactaggagcccagggctaggagggcaggtcctcacagggtgctagaggccaagttcgtgtcttcgtgcttgagcttcccgtccaaggcgaggccccgcttctctcggttattggctaggaagggggtcagtgtgtagaccttgcagaacgtcgagctgggtgccacagtgtcactgggaagaaaggaagcagctgtggagatggccctccccagagccaaccccagccctgatctccagcccagcagaatatctagtctgagcctgctccaagtctccctctcccaacctctgtcccccagacacacggaccacttgggccagcccagctcgggcaaggagaccactgccactcaaaagaggcacatctacattctacgcacaaacaggactgaatctcggatattctaaaagattatcctagtcaagcagcacagtgctaaaaagcacatttatttaaagaattacagccagccgggtgcagtggctcacgcctgtaatcccagcattttgggaggccgaggcgggtagatcacgaggtcaggagttggagaccatcctggctaacaaggtgaaaccccgtctctactaaaaatacaaaaaaattagccgggcatggtggtggacgcctgtagttccagctactcaggaggctgagccaggagaatggcatgaacctgggaggtggagcttacagtgagccgagattgctccactgcactccagcctgggtgacagagcaagactccatctcaaaaaaaaaaaaaaaaaaagtacagccacagcaggcacagttgctcatgcctgtaatcccagcaacttgagaggctgacaggaggattgcttgaggctaggagtttgagaccagcctgggcaacatagcaagaccccatcgctacaaaaaattttaaacattagcctgatatggtggtgcacacctgtagtcctagctacttgggaggctgaggcaggaggatcacttgagcccaggagttcgaggctggctgtagtgagccatgatcataccactgcactccagcctgggcaacagagtgaaactctgtctctaaacaaatttaatttaaatttattttattttattttattttattttattttatttttttgagacagagtcttgctctgtcgcccaggctagagtacagtagtgcgatcctggctcactggaacctccacctcccaggttgaagcagttctcctacctcagcctcccaagtagctgggatcacaggggcgcgccaccatgcccgactaatttttgtatttttagtagagatgaggttttgccatgttggccaggatggtctcaaactcctgacctcaagtgatctgcctgcctcagcctccccaagtgctgggattataggcgtgagcaccagccctgtctctaaacacattttaaaaagaaaaaattatagctacacataaaccataaatgaagctatttgggcacccatatacccaccatctaggctcaacaattaaaactttacttgcttgatcacatccatcatatatagggtgttttgattgtccaatttttacttgcttttgctctatcccccatcctttccaatgagagagctgtcatgcagcagatagtgaacaagccttggagtcggacgaccgtgttccagccccagctttgctgcttgctaacttgcaagtcacatctctctgagccacttcctcctctacatactggggcagcagcaaccccagccccacagcgcttcctgagaagtaaacaagtctgtgagtgcaaatgcctccccagccatccctgctggtattcgttatgcagacgctggcaccatctgcagtggttgggattttctactctttagggattatatgttactctggttctagatcacttcactttaccatcaggaatctatgcctcatagctctgatttttttgaaaaaatcaacagtggatatgaaaaatatccagtaaccagagaaagcttgatctaatcatagcatgttcacctataggacattaaaaactatttcaaaggccatgtagtaacattttaaaaatattttcagttgcaagaaatactgattggaattatacataaacaaatacacatatacatgtaaaattatatcaggtataattgccccaagaaattacttgcagggccaggaaaaaaaaatgtgtatgtctttgaatgggagcatttacttcctttaggtaagtaaagatgtttcacttcagatctctccacttgccttagctgccaacaagcctgggacaaagttcgatccatgctcaaccatagcagttctcctcaaacctagatgatttttttgtgtgtaattattctctgcactcccacacacaacccctttttcccaatgagttggattacccctttatcagacaagagctgtgtacctagtgccttacccactttgccctggctaccaggaagccaagaacaaagtatttcccttcaacctaggtttcttgtacaacgtaattatttcttctcacaaccccaatccccttacattcattagctattgttttgtcactctagttttagtgggtctcttccttgactgtagcatgcattttcttgaagctaaatcaggtggatggtttctaaaaggctcttcgggatcatctactctgagtggcaaggaagtctgaggcccagccctctgccaggtggagaagagccacctggacctgtaacaggacacctagagcttctctttttcccacccaatcccatacgcccaaggccagacttgtgcccacttactcagcctcttccatggcaacagggcacttgtactgagctgtgttgaaaaggcagatgtctgcatactggcgcactagggagggagaggaatcaaggtggagtgagtcgggaatgtagctcccatggagtctcacaggcgtccccgggttggggatattcagccccaggcaatggccagaggccaccagtggggacttctgcataagaccacccctgtcttacatccaaagggtagccccaaacacacccatttccttccataaccaaagccttcccctcaaggacagctttgtccagaacccaagaaactgaagaggtggcttaaagagcaaactcattacctagccaataagcagcctgccttacccaactcaaaagctttgccctgtggctcagagcaggccctgggcttcagtggctattttttatacaaggctgttaacaaggggagatacttcagccacccccagcccttgggaagattgcctctcgctgtcccctaagctgaccctctgtctgggatacctgagatcttgatcttcttcaccgtcttgttggtgttgttggtgacgtggacgttgacgctgatgggttctccatggtaatagatctggggggcataagaagggacggggttggctgggaggacagcaaggttctagggaaaggggagggagaaaagcccccacgcgatcttctggggttccccagaccttgcgcagaccttcagaagggtctgctgctcccatctgaagtccatcacatccctcaggttcatgccccctctgccactcctttaggcccaagaggcttctccgaatcccccaaggcattgtgacatttgccccaagttcatcagccacttcccactgctgctaaggtggcatgaaagccaccaagcacattagccttcagttccctggtgggacccttgaaagataacggaattggaaggtgatagtcctgggctccagccctggcttggccagcagtaattgtgacaacaataacaacaataacattgacgatgatgaaagcagtgtgaccgtgggtaggttatctaagcctcagggtctccctctgtgcaacgaaggggttggactaggtgatgtctgaagtccctgccagctctaaattctgtccacagaaggatctggaagaagcagggaaaggtgaggatgggctcaccagctcactgagggagccagctctgaatccctacaaaaagacctcaacttgcatcttgccccaaggcacttcccttcagccatgccccgagagagagggggtgcccacaccttgaggaggggccagcctaagctcacagcagtcagctgggtttgattcagagtttgaggggaggcccttccttctgcagggcttgtcgccctgacgctcagtgtttggcaggaaggtcacggccccccaccgtgccccctctgcaatgctggttgaccttcagcactcggcctgaggcaggcagctggtggaggtgtgggggagatgtccaggaccttcaggaaggtctgctcctcacttcggaagtccatcacatctctcaagttcatgccccctttgccactcctttaggcccaagaggcttctccaaatcccccatgagaggtctcagattccctgacccctgtggtccttgggctggggatagaagctcctacctgaggcatccttgcaggccaggagagagctgggatctgaggcccaggccctggtggagcagcccccaccccctgccaagtccgagcctcctacctccttatccagagaggcttctaggtgcaagggcttgtccgacatgaggaactgcctggtggtctcggctgtgggctgggggccaggcctctctggggcatactgaaccttccggatgaccagacgcacagaattcctaatggagatgggcggagtgaaagaggaccagggtcacctgccttcatcccctctccttgcgagcctcacatcattctcctgctcaagagactggcatggctctccatcaccttagaatccagccaaactgcagagatcagcataggggtctgtcaccatctggctccattccatcctcccctgttctgtcccagaagtgccctgtggctgcacttcatttggtcctggtacccagcaggatgctgaaacagggactacatttttcacctcctgcttccctatgtcaccaaataggtaacattgtcacttcctgactccctatgtcaccatacacaaatagtgtccctctgtcatctattttggtgacataggacactatttgtgtaagttctttaaggacagaaatttgtgtctaaggtgttcacagctgtactctcagcacctatgactgtgcctgccatataataaacaactgccagatatctattatgtaaaactatgcagaggggacagcggtctcaagaagaaatggggcttggggaggcgttggggttcagggaggaggcgtggattcagtcagggggatgcaagccagtgaaggggacaagcccagggaggggagaaggcccatggatgagactggctccatgaagattacaggggatcagggagcaaatgaggatctggtgagggagggggacttggtgaggccgtctctgtggcatgctgggaatgccggcatctccgttgctcagataagctgcctccattgcctgtaaccagggagccagggtcaaactcccagctctcctcttactaactatgtggccctgggtacattaacctctctctgcctctgttccctaatctgtaaagggtgatgacagaaggacctacctctttttctcctttttaaatttttattaatttatttattttgagatggagtctcactctgttgcccaggctggagtgcagtggcgcaatctcagctcactacaacctctgcctcccagcttcaagcaattctcctgcctcggccttctgagtagctggggttacaggcatatgccaccacacctgcctaatttttgtattttcaatagagatggggtttcaccatgttggccaggctggtctggaactcctggcctcaagtaatatgcctgccttcggccttccagagctctgggattacaggtgtgagccaccacgcccagcaaggacgtacttcttagagctgctgtgaggattaaattagttcatacagcccagcactgtaaatggtgtctggcacctaatcagcccttgataaatgatagcttctatatcattattattagtaactccttggtgtggattttaaatgtcccattggtggtagggtgagaggggtggctctcgatgtcacctcctctttcttgtgcttaccaagcctcctcccacatcccacagcacccttcctcttccctggtctcaggtcttaagaggaaaagggagacagagaagcaagggagaaaagtcccatctcctcacacacagctgccagggctgcagatgcaaatgcatgcaatacaccctatagccaccaggtggcaaactcagcccacgccctaaaaaggctgctgtgccctcagccaacctcctctgggaccagtgcctctggatgcaggcacatcagcgtcgagggcccaccagctattccaggaggcagacagagcacagcccgacccaggaggggcaggcatgagacatccgggccagctgtttctggctgccagcctgggctctctgtctgcccgggctgttcttctccagagaacgcttcccatctcttagatgtgggccgacctccctgtcactctcccctggatgggttcactatctccacttcctcctcacttagaagctgccattgacacacactccactcctgctgaacgcctcccaggaggaaaactggaaaatgagaatggtcaggaaacagcctgctcactgtttaacacaatctgaatttagggtttttccaaaacaaattaaaaagacatgcagtctggaggggatgaaatgagaggcagggagatgagggaggaagctgccacaatggtgcaaaggagaagatgctgcagcctgaacccaggcagtcgaagccacctccccaaggaagccctccgtgacctcccagcttccagagtgcccttccaaggctggaatgtgcgcccctcctcacacacttccaggtattgttacttatctcctcttggactttgcccatcctgtctccctccctcacccagcaggcggcccacaccctggcatcctactcaccgcttgtggatcttctcctccaaattctccgcgcagaaggctttgacttcatagtccacaccgcaagcctgtggggaaggggtcactgaccacagggccttggagaagcagggtccccagtacacagccagcccacctctcattttacaaacgaggacactggacaggaacaccaagctcccacagcccagccttccttggtctggaagaagcgggggaacgcccttgtgctcagccccaatgctgtgctgcctcctccatctgacatgggacatctcgaaccacccaaacggggctctgctctttggattcctgcctcagtctgggtggccgtcctcatccaggcagctgcccagaaatagcaacaggcacctgagcagactgggggcgcctactactgtgtgcacacccggccctgggtggcttatccggtattcctctaacaagacaaggaggcacgtgctgttatctccatcttgcagatgaggaagctgggctcaaagctctggagctagtggtgtcacttctctccaaccctcagtttccccatctgtgaaatggggatgatcgcactttgattccaggttgccaggggttacatgaggccaggtgtaggtcctcagaacactttggtcctgttgcagccaacgccacccaggagagcctccagacccatcactgaatgggagagtgaggctgaccccgtacctgctgccctgtctgaagagagactggttgtccaaggtgggaccagcttagcctagacacaaagactgttcaacagggagagtggtcctgtgtgtccagcacctcccagggagaaagccagggacctggggacatgagactcctggagccagagagatggtccccttggggtgacctaccttccccgtgtcttcgggccccggctgcagtgtcacagaacatggaaggtttggagggatctgtcaagaagaggacagaacgagccacctgtcacatccaccactgtcctgtctcatgtattgcagcccagacactcccatacacccatcagaccaagggccccaggggacaggccatgtctatcccatcagaccatgccaagccatgccccatctaaaactctttagataaagagctttctttatctaaagggtttggcccagcccagtcctcgcagcaatggtttaaatagatctttctatgatgtctactgtggttggcagaataatgttccccaaagatgtccacaccctaatcgcccaaacctgggaccttaatgacaaaagtgactttgcagatccaattaaggccttgagatggggaccgtatcctggatgattttggtgggcctagtataatcacaagagtccttagaagtggaagcagggggcagaaatgtctgagccacagtgatgggatgtacaaaagactcaacggccactgctggctttgacaatggaggaaggcactgtgagccaaggaaagcaatgctggaaaaggtggacgctccccgagggcctccagaggagccagccctgccacgcctccatggtagcccactgagacctgttttgggacttctgacctccagagctgtaagctcatacatctgtgttgttttaattgctgccgagtttgtggcaatctgtttcagcagccatagggagctaacatgtctacgtagaaaaggtgactccatgaccctctccactctctcagcctccaagaaagggagagaccacactgaatctcagaatcagagagcctaagaaacttgagattttgaaatccagcatcttaaagtctctgatttgaaaggtggtggggcagacagatcacctacttgccatccctctcttgcgagctgggttgctgccgggcaagtggggagctgatctgagcgggaaaccccttgcagtgatgcagggtccagaaagggctctttctttctctgaagccccttagcaccccctttctcccaccaatgacctggcctcagaagggtctgaggagtagcccaaaggtacaggtgacaaaccccagcaggggctggagaagagacacttaccaggtaacacaggtgacagtgccccaggtcccagcatacactgggaaactgggtggcagggagcagctgaccctcaccgccctcttatgcccaccccagagggcttcctagaggtggcatttctggaatggggccccagggatggcagttcctgacctcaaaggtgaaagggtaagcgtgctcgcccagcttcttgatgaggcgttcctgcagccgcgtcaggggcttcttgtcctcgggggccggtgggaacgactgtacgttggccacaaacaggtccttgcgaaaggtcaggcccaggacatccaggtcctcccggccatagcggaaggcgcaggtcagcgtcacatagactgtggggagcgaggagcactgaggaggggcctgggagagcagcaagcgagccccccagagtgccggcagcagccctgggacgggccccactggaggccccaagcctgtcccaagctctgtggggatggctgcactgtctccaccaggagggctggtagtgagtaccggaaggatgccatggcctggcccctgggaggaggagggggctgcctgctgagccagctctgtccttccccctcccacctctccccagggcatatgtggaggggtatggaaacggtctgacaggcttggcgggggctggagtagtctggcaggcctggggtgggggtaggggacctggggaaggagcagggagttgtgggggcagggcaagtgctgggtggtatctggacggcaagcgtcttgtcacagctcagtctgcactcttgtcttcctgcgcattgatactgccccggtatcaatgttctgttctgttaaagaagaacctactcctaccctgctggcatccccagccttgccacagtcatgacatattgatgtgaaagtgctcagggcatggggaaaccttctcccaaagtaagcttggggcagggccgtcccaggctggaggaggcaacggcatctgtagaggtatttgttggggctttcaggggaaccagtggggatgggcagggagttcctatgctagaggtccggggggaagaggaggcggcccttgacaggctggggatgggggccacagcctacctctccgctctttgagatactcaggatccaccaggaccacaccatctggggaaaggacagagagtaagcggcctctcccaacctggtctcccaaacctctgtgccccaaacaccagcccaagcccagatccaaccatctgttcatctaaaatcatcctgagaaaaatggaaaggcgggcacctagagggtggcactgcccacctccaccacgctccacccttcccccatcccaggccagtataacagacccagctggtgactttaggcaggttagagaccatttctgtttcttcatctgctagtaagaataataacctaggtccgaaactcctagaaccaggtattctttggaatttagaaattgcgaagtatagagaggcaaaatgggccgggcgtggtgggtcatgcacataatcccaacactttgggaggctgaggtgggcggatcacttgaggccaagagttcaagaccagcctggccaacatggtgaaacatcaactctactataaatacaaaaatagctgggcatggtggcgggcccctgtagttccagctactcgggagactgaagcaagagaatcacctgaacctgggaggcagaggctgcagtgagctgagatcatcccactgcactccagcctgggcaacagagcgagactctgtctcaaaataaaataaaataaaataaaataggcaaaatggtacatgttccatatattctgtaatgacctctgcaagatctgtaccttattattaaagccattaatacctctgtaggaaaacacaaatattctcaccaagaggctaaataaggcataaatagcctcgcatcagtttgggtcaggtttgccaataaatgaattctgcattaaacttggaagcaatgttaggttttcagagcttgggcttggcacatgtggattgggggttgtgatctgcagtgcctccctcatggggctcccgtgacgactgaatgggtacatgtgtgaatgtgcatatgtgtacagcgcttagacagtgccaagcactcgagagcactctgcagattgtggaaggcgcctcagtgccctgaggcctgcccttgggggcagagtccagctggacacaaaggacatctctgctcagcaccccaggaggccagaaacactggctcagggtcacccccttggctgacatcccctgtctatctttggccaaacctttctttcctctctctctccccctaccctctaacccattgtcacttcactgctggtggaagaggagggccaggatggatcatcaatgtcctgttgggcaggccagtgggcttggacttgtgtgcaggtttggtggggaaccggtaagcatagggagggtgtgatcagatcaagccaaatggcagcgtcactatgggagaagaatctctcacagtgagtccctgatcagctctgcacagtgccccagagttctcggggataccagggctcacaaggggcctggcacaaagggggtgctctgtgaacacctgctgaacagctctcagggtgcctgcgtgtgttgggggctggtttcctgcccctgtcctctcccagtctctgggccacctctgctgctgtccttagtaggccaatggacatggacaaccctggcctcagagggcccactggaaatgacaacatgaagcagccacagatgaacaccaggatgcctgctcccggcctctgagaggccacctcagggagaagatgccaatggcaaagggacactgagcttcagaagacaccaaacagcatcccaggcagggctggaggggagaattgggggtgttctgctctaggccatgaagggctctgctgacagccccctggccctgggagcccagggtccccaggtcttcctcctggtgagctgaagcctgcagccgggctcgcttccttggctcaggaaccacacaaatcactcctgccctggacccaggacagcccacagggacatgatgggaaaggccatactaggcctcactttgatttgctcatcttttttttttttttttttttttttttttttctgagccagagtcttgctctgtcacccaggctggagtgcggtggcatgatctcgctaactgcaactctgcctcctgggttcaagcgattctcatgcctcacccaccccagtagcagggaatacaggtgcatgccaccatgctcggctattttttttttctgtattttttagtagagatgatatttcaccatgtgggccaggctggtctcaaactcctgaccttgggtgatccacctcccaaagtgctgggattacaggcgtgagccaccgcacttggcctaaagacatttttagttggcctaactggagcgtgaggtactctgggcatcgaatgagtagagaccagggatgtggctatccagcctataacacacaggacaggccacactaacaaagaactatccaatccaaaatgtcaagcatgcagaaattgcaaaaccctgaacttgaacaagaacttggaaggtgccttcagccacagcccagcttctagcaggaaccccatgtacatgaggacagcccccatttcacaagtcctaagaagggttctccctctgtctcccactctttgccatcacaaggaagcagaacaaagagttttgcagactctgccaggtttgaaccgggctcctctatctactcactctatgacctggagtaagtcactgagccactctgtgcctcattctccttgtctggaaagcagggatagtcatcatagccacccccactgtctgctacatgacacgccttatagtaagtggcggtgtctgtcgtcatcaccctcacccttcttaccatcatcaggacgccttccctgattgtcacctcagtccttcccacagtctcttcttgcagtcctcacttgagtgggaaagtagctgctcagtaaatgcttgctgcctgaagcaggaagccattcacccccgttcttggcaccgggcccctctggagagctgagagctatttctgggaggcttggccagccacatcttcccccagccctcctctcgccctccagggactcacccacagggtccacgaggtcgatgtggtccacaaagtcccgctttcccaggtagacggtgagctgaggaggagaggcatagggggcgttagcagctgcaggcccagaggacacaggaccctgtcttggaggaaaccctgcgggcagcctctgaaactccagacccatccctaacccttatcaaaatcctaagtggacttgggccttcaccccagccctaataccaagattcgcaaacccctgtaaaatcttaaaagcaccacttcctcccaaaacccttgaaggagtcattattgttcctgttttacagatgaggacactgaggcccggagagatcttcatgccaagcaccactgccagtggagcagcagcggcagagaagctgggtgagtgggagtgtgggcatctcagagggtgagagcccccaggcaggcgggagcgctgagccctcagaggctctgaacgcgggccgcgctgtgttcttcagttgctccttctcccatgcagccaggcggggatccactgatacgaggactcgtttcctttttcttaaataatttttttttcgagatggaattttgctcttgttgcccggcctggagtgcaatggcgcgatctcagatccctgcaacctccgcctcccaggttcaggcgattctcctgcctcagcctcctaagtagctgggattacaggcatgcaccaccacacgcagctaatttttgcatttatagtagagatggggtttcaccatgttggtcaggctggtctcaaattcctgacctcaggtgatcagcctgcctcagcctcccaaagtgctgggattacaggcgtgagccaccgtgcccggcctaattaattttttaaattgagttaaaagtatatgttatttatcatgtacaacacaatgttttaaaatagatatacattgtggaaaggtgacatccagctaatgaacaaatgcaccacctcacacagttagcagttctgtgtgtgaggacttgccttctgaggcactgagggtttgggggctcacgccccactccatagccagccgggagggaaaaacccccgagacagaattccagcggctaaaccagatccagagcgtcatcctgatgtgtgctgttcctcaacaacccttcaatccttgtgactcgatcgccatcattatttctcaagtccgtacctctccatccccacagccactcctgcctagaccaccacaccagccccttgctgctcactcgctgagagcctgctctcctccttagctagactagtcaccctaaaatgcaaatctttctttttttttttttttttgagatggagtctccctctgtcgcccaggctggagtgcagtggtgcaatttcagctcactgcaacctctacctcccgggttaaagtgatcctcacacctcagcctcccaaatagctggaactacaggcatgcaccaccacgcctagctaatttttgtatttttagtagagacagggtttcaaactcctgacctcaagtgatccacccaccttggcctcccaaagtgctgggattataggcgtgagccactgtgaccagccctaaaattcaaatctaaccatgctactgccgcctgaaacccattaatggttcctcagtgtccaaaaataaggatgacaaatgggtttcattccaagtgccaagtctgatctaccggcggggagaggggacggggagctgtctcggactctgggctgagaaggaatctaagatgaaaccctggtgcagcagggaagggcaatggtgactgatgttatctactgtggacacagaagagagatgtggaagcacacgtggtgctatttgccaacccaggccagctcataagccaagccacagtgttcccgtgaccagccctgcagcctctcagcctcagcctctctcttggcactctgaactcagctgcttaagattcccacagttcctatgcttttatgtcctgcctacaatgctgttttcaccttgccttgctggaaatgcatccctcctagaagctgccgctgcccaccaggctgggtcctgcagccccaatggccccgtatctcccctctgccacttcatgttgaaatgatggatttctgtgtctgcctctgccatctggctgtgagaggcacagactgtgcctcattcatctgagtacaccctgcccctgtccccgccggctcagcccagacctggtgtggaatggtgtcagtaatgtctacctgctaaactgagggggaagcaggatggcatctggacctgcaaggagaaagcaaggaagccaggccctgggagctgccctggctaaggaggtgacgctagggtcctctcacagcaggggactcactcccccacggccctcggcgcttactggttggcttgtcctccactgtcacatacttactgaagtctctctatgacaggccgtctctccctacaccagagctcaggggagctgtgcttccccactctgaaagtttcctgagtgtgtccctcccccttcaactgacagctccaagagagagagctgtgtcacccctaagacggggagcagcacctgccccctcccacagaggtgtgcatttcaggggacatgccgtttcctctgcttcccaagagaaaatgaccagagtgtgaggtcagggaggcgctgggcgcagctgttacagactcacctttccatttggactggccttcttgaacactctgtggagagaaagagaggtcaggccagggttcgcgtatcctgcccaggggcaagctcctgcgggccaccttgaggcaggactggggaccagggctggagtgactgacaggcaccatgcaggcttgagatccgaacagtgcccatgtaatccgctcttaccatctccactggtaagcctccacgatagccattagagctctcctgggctacgcaacagccgccttgcagtcaggtctttgcagggcaggctgcgggagtctccaagtgcaagttttctgagctcaagtgaggaaaagcctggcatgctgtaaggtctgtgtgatctaccctcacctcccggtgtcacctcctactactctccctcacccatctccagccacatctacccccggctggtcctcaagcacaccagggcgattcccacctcggggacagttctcttctgggaggctctccccgagacatctgcatgctcagccccactgtgcctccggggcctgaagtccctctcttgctctacttcttctttttccatagcactcatcactctcttttttgagacaaggtttcactctgtcactcaggctggagtgcagtggcgtgatctcagctcactgcttcaatctctgcctcctgggctcaaacgatcctcctgctcagcctctcaagtcactgggaccacaggcacacgccaccaccctgggctaatttttattttttgttttcttgttttgttttgttttttgttagaaatggggtttcaccaaattgctcagctgctctcagactcctggactcaagcgatctgcccacctcgacttcccaaagtgctgagattacaggcgtgagccaccacgcccaaccaacacttaccactttcgaatgtacacatattttgcttgtttattatgtgtctactctgctaatatgtcactccacgagggcagggatctttgtctctcttatccacagatgcatctatcccaagcacccagaacagcactgcaatcattgtttaataaatgatgggaccaggaacggtggctcatgcctgtaatcccagcattttgggaggccgaggaggtcaggagttcaagaccagcctaactaatgtggtgaaaccccatctctactaaaaatgcaaaaattagctgggcatggtggtgggtgcttgtaatcccagctacttgggaggctgaggtagaattgcctgaacccagaagacggagcttgcagtgagccaagatcacgccactgcactccagcctgggcgacagagcaagactcagtctcaaaaacaaacaaacaaaaaatgatgaatggcaggtagcaaacactcaataaacattagttgaacaggtgaatgaatgaatgaatgagtgaaggaatcaactgccttacttcacagaaactgaagcccaggaaaggcagagaataagccatggtcacccagctggataaggaatcaggttgagatgtagtccatgactcccaaaaagtggaactcacttgccttccgtatctcctcctgccctctcccccgagctgggtcttggagcctgagacccccttccctagctgccaacaggtagctccaggatctctcaaagtaattgttgggagggagagaagaaaattgaaagatagagacagagaccgcgagataagagagggggttggggaagagaggggaggatagggacacaggccctggacgggcgaaaataaaagatggaataagagaggctaaaacagccatggacagaggagtagggcaggaacacatgaggctgagagggcttcctgccacccagtcctcccccaggagcacagggtccagtaggcaccagggtgggcaggacagtgaggcccgccatggcacatggacagccactcctgcctccttccagaagagaaggcgagtgggtggtggctctgcgctgcattgatggccctggccctgcccaccctcacctctcacttctgggctggcaggaaccactgatgagtgtgagcatggcttactaagaagcctggcacatcccgccccacctcccctgggagccctgggcttttctcctgctcataaatatttatttatttatttatatttttttgagatggagtctcgctctgttgcccaggctggagtgcagtggcgtgatctcagctcactgcaacctccatcccccaggttcaagcgattcttgtgcctcagcctcccctgtagctaggattacaggcatgcaccaccaggccaggctaatttttgtatttttagtagagatggggtttctccatgttggccaggctggtctcaaactcctgacctcaagtgatcctcccacctccagcctcccaaagtgctgggattacaggcgtgagccaccgcgtccagcttccttctcataaatatttattagtgttcagagtgtgaagatgccacagtcagctggggtgtgataattgctaaagtgaggaaaaatacagatcacaaggtttgaagcagcagctcccaagctggggctggacgtgcagagaagaccagagaagtggcaccggccacaagggactccacctgcttccagaagcctcgggagcccatggtctgaaggaaaggagaggccacaggtgcctgaggccacaaacaactgagtcagggaaaaccattccagggactgctggaaggagcgagacaccctggtcaggctggaagaggcaacttaagaagggagggagggaagacagaactttgttgagtggctaattatttctcataatagctctgtgaaatggggattatcatcctcattttacaggtaattagctcaaggctcagagagacgcagtaatttccccaagaacacacagcaagccaggggctcggtcaggattcagacccaattctatctgcttgcctccagaagctgggtgcttcatatccaacccggctgttttcctaaaccgggtgttttcatcaacatcgggaataacaataaagaggagaaatgaggagaggagaggggcaaggggcacagtgagggtggccagggtaggaagtgtggccagcagtggggaatgacctgctgctaaccttgtcagcaccaggaccacctccttcaggaagcaggactctgatggcttcctcaaacaacagcagcagccaccacattccccaagagcatgccatgctctagacatgactttaggtatttttcctagaacactgctgatccttacaataccatttcagagatgaggaaattgagtctcaccaaggtgaagcatggtctgcctgtctcccgagcccatgtcctttccactctgtgacactgccaagccctctgtgataaaactcctctgacttcctgaccctaacactatcagaaaagaggcccctgtgaggatgcttcgtttcctgggacctccacctatgcagcgtcacacagatggctctgcctgtcaactttgaagagcaagcacacacgtccaagactggtcaaagccaaatttccaggatgccagaggcagggtctgcctcatccccagccccatctatgccccacagcctgattcacagagctgggtgcctataagagaaataccagcagtgttccagctgattaaggctcagtggagacaaggaacagaaccagcccccaccacacccaaccccaccgcccagggtagctcaagaaaagggggagggcatgttataagaaggcaaaattctcacgggatgcaggcaggatgcatgggggctggcgcaggatctgggaagccatctgaatctcaggcagtctcactctctctgcacctctcctcccggggcttcattttcccccggttgcactgctttctgggcggctgccccattgcctctgtggaccagctatctctacttactcaaggcttttctcctcctccatccttttggcttggatgtgactcccactctgacactgtttccactctgattctcactcagcttcccactgctaactggttgaatggcccacttccaaattcccagtagaggaatttgattggtcagcactggtcatgtgttctacacctgggccaatcagctatacctaggtgtgtcacacatctaggtctgtcatgtagtcaaggaggcccgggcagaagagggtctgtagagtaatgttttccaaacagggggtcacaacatactagttgataataaaaccaacttatggctgggcatggtggttcatgcctgtaatcccagcactttgggatcatgcctgtaatcccagccgaggtgggaggatcacttgaggtcaggagttcaagaccagcctggtcaacatggtgaaacccagtctctactaaaaatacaaaaattagccggacatggtggcatgcacctgtaatcccagctattcgggaggctgaggcagaagaatcgcttcaaccagggaggcggaagttgcagtgagctgagatcatgtgacttcactccagcctgggcaacagagcaagactccgtctcaaaaataaataaataaataaataaataaataaataaataaataaataaataacttaaaatatttttttaatgaaatggaatggaatagactagaaaatataagcatgcactgcaggtagcaaggtataatagacattactatattcaccaaaattcagtttccttctaagcctgggggtatgggagtatcagatttctctggtcctatgaagttaggcatgtccatgtggcttgctctggccagtgaaatatgagtagaagtgccagatgtcagtgccaggtagatttaagtgctggtgcttgattccccatgccctctgtattcattttctatggctgctgtaacaaattaccacacacttagtggcctaaaccaacacaaacaggccaggtgtggtggctcatgcctgtaatcccagcactttgggaggccgacatgggaggatcacttgagttcaggaattcaagaccaatgtgggcaacatggtgaaaccccatctctacaaaaatacaaaaattagccaggcacagtggtgtgtgcctgtagtaccagctactcgaacgctgagatgggaggatcacttgaacctaggaggtggaggttgcagtgagtcaagattgtgccactgcacttgagcctgggtgacagagtgaaaccctgtctcaaaaaaaaaaaaaaaaaaaaaaaaacacacacacccaacatattatcttatagtttggtagttcagaaacactaaatgggcctcactggactaaaatcaaggtacccacagggctgcattcatttctggaggctcaagggatgaatctgtttcccagcccttcccagcttctaggggctgcccacattccttggctcatggcccctgcttctatcttcaaaggcagcaagagcaggttcagttcttatcacattgcctcactttgacctcctcttctgcctctctcttccatttataaagacccctgggactatgttgaacccatctggataatccagaacaatctccctattttaaggtcagttaattagcaaccttaactccatctgcaaccgtcattaccctctgccatgtgacatatcctattcacaggttccaaggattatgatgtagacatctttgggaagagcattctttggcctgccatgctctctttcctttgccactgaaaccagcaatgatctggatgagaaagcctccatcaacctaaatcccagggctgtcccactacatgacagatgtgtagcataagggagaatgaaagctcttgagccactaagatttgggggttcttaccggccacaggctagcttctcctggctgatacaaaaagtgagtattggctgggcacagtggctcatgcctgtaatcccaacactttgggaggctgaggcgggcggatcacttgaggccaggagtttgagaccagcccggtgaacacagtgaaaccttgtctctactaaaaatacaaaaaattagccaggtgtggtggcacatgcctgtaatcccagctactcaggaggctgaggcatgagaattacttgaacccgggaggcagaggttacagtaagctgagatcgcaccactgcactctagcctgggcgacagagtaagactttgtctcaaaaaaaaaaaaaaaaaaaaaagagtattatttagcaaaatgtttgtttcaggtgaatgtgtgtgtactgaattacaatgtaaaatgaatttcatgctgcaaatttaaaaatgtttcagatccgctgttctagaaaaacatgcctaaaccaaacatgccctatccgtgtctgtgcagactgctggatgctgtcttctgattccattccatcaaggtggtgccgccaggaagacaggtaggtcaactctccatgaaccagaatgtcagtttctccagtgagcctcattccccacctgcagcatagggtacctgtggaccaactttgacactaatatttcactgctcttctgtgagccatcagtcctcccagtgtccctttgtgcctgtcagggagagggctacacaacaaggaacccaaatgaagtaccttccaagactgattacaccaaaacaagattttctaattctatatgatcagctaaacaaggaattttttttccttttttttttgagatggagtctcactctgtcacccaggctggagtacagcggcaccagcgaggctcactgcaacctccatctcccaggctcaagcgattctcctgcctcagcctcccaagtagctgggattactggtgcatgccaccatgcccagctaattttttgtattttagtagagatggggtttcaccatgttgtccagggtggtctcgaacttctaagctctgcctcccagagtgctgggattacaggtgtgagccactgtgcccagccaacaatggaatattatacagcactgaaattaggtttccatctttgataacacaaggaaatgcctatcatagaatattaagcagagtaagtcaggaatcagaatagtacgtttggcatgagctgaactttacactcaataaatacccaaaagaaataaatgagaagacttgatgttaagatgcctacgctcccctaattgattcaatgtaatctttatcaaatcgtagctagcttttttgcagaaactgagaagctcatcctaaaattcataaggaaatgccagggatccagaatagccaaactatcttgaaaaaaaaaaaaaatagaaccaagttagaagactcacacttcccattttcaaaacttaccacaaagctacagtaatcaagactatattgtgctggcataaaaacagacatatagatcaatgggatataattgagagtctagaaatgaactcatatatttatggtcaatagatttttttacaaaggagccaaggcaagtcaatggggaaagaacattgttttcaacaaatgatgctaggacaactggatagtcgcacaaaaaaaaacaaagttagatcccgacctcacatcacgtacaaaaattaactcaaatggggccgggcgctgtgtctcacatctgtaatcccagcactttgggaggctgaggcgggcagatcacctgaggtcaggagtccgagaccagcctggccaacatggtgaaaccctgcctctactaaaaatacaaacattagccaggtgtggtggcaggcacctgtaatcccagctacttgggaggctgaggcaggagaatcgcttgaacccaggaggcggaggttgcagtgagctgagatcatgccactgcactccagcctgggtaagagagcaagactttgtctcaaaaaaaaaaaaaaaaaaaaaaaaaaaattaaatggaccaaagacctaaatgtaaaagctgcagctataaaactcttagcagaaaacgttaagtgtaagtcttcatgaccttgggttaagcaatggtttcttagatatgacaccaaaagcacaagcaactgaagaaaaaatagacaaaattttaaaacttttgtgcttcaaaagtcactgtcaagaaagagaatattggggggtgggggctgggggagggatagcattaggagaaatatctaatgtaaatgacgagttgatgggtgcagcaaaccaacatggcacatgtatacatatgtaacaaacctgcacgttgtgcacatgtaccctagaacttaaagtataattaaaaaaaaaaaaaaaagaaacccactgaatggagcaaatattttcaaatcatttatctgatcaggtcctaatagccaggatatataaagaactattacaactcaacaacaaacaggtgaatcacccatttttaaatgggcaatggatttgtttgaataggcatttgtccaaagaagatattcaagtggccactaaacacatgaaaagatgttcagcatcatcagtcatcagtcaaaactacaatgatacacttcacacccattaagatggctatactcaaaaggaaggataataagtgtggacaggagtgtggagaaactggaaacttcatacatcgctggtgggaatggaaagtggggccgtcactttgaaaaacagtttggcagttcctttaaaagttaaaccgagagttaacatatgacccagtaagtcccctcctgggtatacacccaaagtaactgaaaatgtccacacaaaaaacttatgcataaatgtttgtagcagcattattcaaaatagccaaaaagagtgaaaaaaaaaatctatcaatgaatacatgtatttttttaaaattcagtctatacatacaatggaatagtacataggcataaaatgggatgaagtactgattcatgctacaacataatgaaccttgaaaacattatgttaagtaaattaacataatgttaattatgttaatttaacataattaacataattctgttaacagaaggctgcatattatatgattccacttgcattaaatgttcagagtaggcaaattgatagagacagaaggtaaattagtggttgccaagggttgatgggagtgggaaatggggagtgactgctaattggtacagagttctttgggaggtgatgaaaatgttctggaattggatagtggtgatggttatacaaacttgtgaatatatacaaaaaccactgaattttaccctaaaagtgtgaatattatggtatattacatctcaattaaaaaaaaaaacaactaaaaaaagacagagagaatgaaaaaaaggaaatgtgcctaaatactgacaggagttgaagaagactccgcccacccacacgcttctttatacctataatttttctgttatacaatgagcataaagtactttataaagatgcttggatttccctaacaagatatgtctcaagtcttggagaaaggagaatctaggaaaaaaaaaaaaaagtaagtgaagtagggaaaatctggaccctaaactctgaatgctttgatgtaagagtctctggttctgtgattttacaatccaggatccatgtttctgtgaatcctgagatccctccccaggcctaatgtatcgtatactcagctatcctttttccaggaagccttccctgactaccctctaagtctgggttaggagcccctcagctccacatccagtgtgtccccattcatagcacttaccatactttgtaatggtctgataacaccctctgcttcacttttatagcaacaatgaaagtagagatattatttgtgttatattcactgtatttctggggcatagcatggtacctaggatatagtaggtgctcaataaataaatataggatgactatggttaaatgaatgccctaagagaattattcaagtatgaggatggatgaagtttaaaaagatggtggtaggacaggcgcagtggctgacgcctgtaatcccagcactttaggaggccgaggggggcagatcacgaggtcaggagtttgagaccagcctggccaacatggtgaaaccctgtctctactaaaaatacaaaaattagccgggtgtggtggcacgtgcctgtaatcccaactactcaggaggctgaggcaggagaaacactgaacccaggaggcgaggttgcagtgagctgagattgcaccactgcactccagcctgggcaacacagtgagactctgtctcaaaaaaaaaaaaaaaaaaaagaaagaaagaaagaaaagaaagcttatccaggttatccaggagagaaaccaggtccagttactgctgtaagtgagttacaaatattaactcacttatttctccaacaactctataataagtgttactatcatcccatttcacagatgagaaaactgaggcacagggaggttaagtaatttgcctagggtcacacagcaagtaagcaacagagctagatatcagagcccagatactccagctccagagaccacacttttaatcactcacaatactgcctgagaggtgggattatgtggttctgtctggggagtcaaaaaagccttcagggctggccgctgtggttcacacctttaatcccagcactttgggaggccgaggtgggcggatcatgtggtcaagagattgagaccatcctggccaatatggtgaaaccccatctcgactaaaaatacaaaaattagggccgggcgcggtggctcacgcctgtaatcccagcactttgggaggccgaggcgggcggatcacgaggtcaggagatcgagaccatcctggctaacacagtgaaaccccgtctctactaaaaaacacaaaaaaattagccgggcgtggtggcgggcgcctgtagtcccagctgcgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaatacaaaaattagctaggcatggtcgtgggcgcctgtagtcccagctactctggaggctgagacaggagaatcgcttgaacccaggaggaggaagtggcagtgagccaatatcatgccactgcactccagcctggcaacagagcgagactccatctcaaaaaaaaaaaaaaagccttcaagggaggaggtagcaatgaggaagatcttgaaggacacacaaggtgcagaaggtgaccacactgcaggcagaggcctggagagggcaactgaatccaccaggtgctcaggagacagcgagcctctggtgtggctggagtgtgccccaagtgcctgggaggagccccaggggaagaggctgggctggagaatggtccgtttgctccacagagaatcacggagcacctctatgtgagggccttcggctaggagggtagggctgtgaagggccttgagtgccgggctaaggaacttggaccttatccagaaggcaatagggagccatgcacatttgaggggagggagaatgactggccagggccatattttggacccagagatgccctcaatcccatacgttcccccatccctgtccaatagcagccatggctcagctgggtagggtggggagacgcaagggggcattcactcagacgcagccaccctacattctgacccactttcctcagtgtgagagcagccatcagggagcagggaggtgcggggagcaggtggcagcggctgcagagaggttcctaggcccttatcgcattctccctggtagcagagttatttgtgtaccggctcgtctgctctgccagaatttcccagccctccctgtgtcagagtgtggcccttctgtttacccaccatcagtgcacctgcttctcaggacagcccaggagggggaaggaggcaggaaggcaagaaatgtcaccccatttcagagatttccggagcctgagggagcacagtcccacctgcttcatttcccagagggagaaatcaaagcccgagtgagagaagagtctcacaccagggccaggaagcttgggctcagggagactcgctagtgtgcccagagtcagactgggatggggaccgccggcttctgtggttcccgtctcctgtcacatccctgctcaaatctgccatagctcccagggcacagggcagtgcctggcaggccagaggggtcaggggtggtggctggggagtgaggggttctggccaagtcagactcctgggctgcagacttcccacagacttctaggccgacagcaattccccaagcctcctgccgcattcacgggttcacttctttggccatgaagcatatttttgaaaattctcaggtggtgcagagtgaggaaagagggggccatggacagaggggagagtttcttaaaagagcttggcttattttctgttaacccatgaagctggagatctgaaaatcaagggctaatcaaaatttccccaggcgggctggcagctggataccaaagagcccacagactgcgcctgagcgctgcccagccttcctggggctgagatgcaggaagagaaggttgctggcagccaaaagggcccagaggctgaagcagacagtccctgcctgagtctctgcttgagcccagtgtgacctcaggcccatttcctatcctctggaaggctcagcttccttcgcctagagaatggggataatatccaccccataggctggggataggtgtaaaaacttgatccccagtagtgactcaacacagggaagctgacattgtgctatgatactatgaaattgtcatcatcattatcctggccagtgtcctgcccccaccccctgctcagggagagttctcccccaagtgtccctcaggtgagaaagccttgcgggtgggaggagatggtcatgttactcctgctgggacagggaaatgtttaaactgtctgtctccctacagtcttgggtagaaaacacaatttatgatgtttttcccccagattattattatcattattattattattatttggagatggagtctcgctctgtcacccaggctggagtggagtggcatgatcttggctcactgcaacctccgcctcctgggctcaagcaattctcctgcctcagcctccagagtagctgggattacaggtgcacaccaccacacccggctaattattgtgtttttagtagagacagggtttcaccatgttggccaggctggtctcaaactcctgacctcaagtgatccgcccatctcagcctcccaaagtgttgggattacaggtgtgagccactgtgccccactttttcccagtgtagacatccacattccagaaatttccaggtgcgtgccctgctcttccctcttcctgtactatcctttgcatcagttctaccaactgcagccccttcccatccttcacacagtcccagcgtcacctcacccaagaagccctccttgactgccttggcttaaagtgctcttgccctgactcctctgcccttgctccctcctttgcttccttccattcgtctttcttatttccctcctttcttttcttccctttatttttcaaatctctgggcctggggctgtttttacctgcagaaggtacaggccccggtgtcggtgttgtttccccagagcacctacagggcagcggaaggcagacactcagtgaacaagcaagccctccctcaaaagcacagtgggagggtgggaggaggtgcatgtgtgatgtgcccagttccgttccaggcaccaccaggcacccagcacacatgtgcatctttccctccctctcctgctggcccctgagcatccaaacagggcctgcacatggctgctcctgagtggatgccacggaactgaaatgatggcaaaccccagggaacagaaactgcgacttcagtcacttatgttccttggtacatagtaggtgcttaataaagattttgaatgaataaacaagagccaagccctgagcttgaggctgggaaaaaataggacctgggccaagaagcggcagccttgccatctggatgagcaccatggatgcgcagtcttggcgggaacccattagctatagggcactcctgacacaagacaggccattattttcccagcggaaagattttatttaaagggggtttttgtttggtttgtttgttttgccaatttcaacatgcaaacttttaaggatatagaataacatatgttaaaataagatattaattcaaaaacatcattaatttcttcctattctcacatttcataaaatgtcacaacagatccactatggcagcatatctctgactctgtgtccactgctctgtggatcagtcagtaagccgagagggttctctgtggtcagggactccatacagactgaaatctaaggcctaaggtgccagctttttccagggaaatagttgtgggggaaaaaaactgccttatatttatctggatggggtgcccacggtgtgctgagctggcttgtacaggctcataagagccaagtgtcacatttttaagaattttgtgaggtagttgttaaacacagccagtaccgttggttctcagccgggggcgaatttgcaccccaggggacacctggcaatgtctggagacattgtgggctgtcatgatttggggaagaggtgctactaacatctagtaggtagaggccaaggatgctgcctgcataatgcacatgtcagtccccccaaaccccccgcaaaggatctccagaccaaaatgttatggtgctgatgctgagaaaccctgcttggagcagtggctcatgcctgcaatcccagcactctgggaggctgaagtgggaggatcgcttgaacccaggagtttgagaccaggctgggcaacaacctgtctttaaaaagagagaggaaaaaaaaaagtttaaaaaaaagaaaaatagaaatcctaatgtgaacttacaattaaataaactctattaaaagcaaagggaatgcattttcttttcttttcttttctttctttcttttttttttttttttttttttgagacaagagtcttgctctgttgcccaggctagaatgtggaatgcagtgacatgatctcggctcactgcaacctccacctcctgggttcatgcaattctcgtgactcagcctcccaagtagctgggattacaggtaatgtgccaccacgcccacccagctaatttttgtattttttttttttttggtagagacggagtttcaccatgttggccaggctggtcttgaactcctgacctcaagtgatcctccagcttctgcctcccagagtgctggaattacaggcataagaaaccatgcctggcccaggaatgcattttcaaaactgattacatactaattattttactgttgttactatcataccctcaagggtatttatgcctactatacctgtatggtggaaatgctatacaatggtgtctactgttcatctcttcccaactgcacattcagtgacttcacactggtagagtgaaatctgaagtcagagtatttacatcacagaaattggcagatgctaaaatcccccacccttctttttttctggagggccagttgttaccagcacactgttgggtgtaaccctaagtagagaagataaattcacaagcttgatgaatccttcccagtttccagcctaggcagacgactcagcaccagcctgctgtatggatcaaggatctgaatgtggtcgtgtgcacgcactctacacaccatgcacagaaagacatacacaaatactaaacagtaacacacctgcatcacactccacacacacatcttgtctacaaacccccacatatacaacatgcacacagcatataaccgactaaacatgcaccccacagtagcccttcagtcagcaggggaataatttgaataatgacaaacacaagcaaaagaatgacaacctgactgaccaaattccttgatatctgagcaccttcacctttactccctcctcatcctctgtgatccacccttccccgcacaccccgacaccacactgcaaaggcaaaggtctcaaccctcacaagaagcaccaaacccactgaccccatttcagtcccgctggaggccctggccacctgactccccatccctgctctgtgcccagctctcaggagactccagagctgagtctgaccttggccccttcccagagcccatgaaaaggagttccctgggcaactccacccacctgaccacttcagctgccaccgatgccagtaagtccaaacctcgtctccagccagaccctctctgacccccacccatcagccttcagacatttctactcgatgtcccccaactccttagacaagtcccaaacagccttcccccatctccaccccgcactgttcctccctgtgttctccatccccacctatgccagaggctggtgcgcaggaagcactcaatgcacatctcatggagagaggaagaaatcatgtaaatcccagaaagagaggaaaagcaaacttcctggtgagtcagatagaaagtcttaccccattttacagatgagagcccaaagattcagtggagtgaagaggccagcccagaagcagcgccaaagcagtggactgtgaggtggagggagcctgagctgggggctgcaggcagcagcagccaggccagggccagccccgcaggctcagctctccccagccccaagtgaggggttagttacaaagaaaaggaaaaggcgttcctgatacgcgtcctgtttcctctcctcctccgggcttctcgggccatggagggcggatgtccctgggctggcagcactctgcctgtacacagacgggcagggggtgagggtctccccaaggatggtgacggtctccctagaccactttccattccagcagtccagcctgcatggagacaggggctcaccagagtgacccctcaagtttcccttccagcctgggggagcccttaccccttatccccagtgggtacttgtcacagccaggcacctcctgtccatcagaggatcccatacagacaccttcaccaggaaggcttctatgtcaccctcacttgctgcagagggccttcttgcagtctcctgtaaggagtctcctgtcttcccttcctccctgccccacagcagccaagtttataagtgcccatctccgtccgtagctgctgcctgtgggacctgagctccccatgaatcagggagcggaaggggtcaaagtgaaggggtcaaaggtgaaggccataaatggggtttcttgagtgagaggacaagatgagcctccatcagacaggggtccttcctgaggacagaggtcagggctcctctctcaaatagggaatctctctgagggaagtggccatggatcccccatcagattggaggctcctgcaggatggaggccatgcttcattcctcaggcacacagctcctacagaacaagaggactgtgtcccctctgttacacagagagtcccaggaaacagaagtcatggtgccccatcagacaggagtgtcctggaggacagggccatgcctcctccatcacaccaggagctcccagagggcacgatccccatctgctccctctccccagaagctcccaggacagacttcagctcagtctaacacacggggaaggtcttccctctggagcagaactgacagggagtcttgctcacaccctcccctgcccagggtcccactccaactccccatttatgctctccattgaactgaagccaccatgccatatttatgtcagctgtgtgtctgggcagaggccagcaacctctggagagatggcagggggcaacagggggatccctgacaagaggatcccaggacaggccatggctccagctctggctggatgtgacccagatgggtatccacacctggctctgccagtaactgagcaagcctcttcccccgtggccatggatagcaccatccccatcatcaaactttatcagcacccactcctggctaaagtggaataaagcatcagggacaggggatagcaggcccttccttagtcccactgtgaggacaacactggccctccctgggtgccagccctgagcccggcccaagcaacttccacagtcatctttcctactcacggcagctccagggaactgctattagttagcatcgatccacaaagtactttgccgacactttatgagctcagtctcaccagaggccccaggggccataagcaagaggcagaaaccaaggcccaggagctcaggccactgagtagagccagggagtcgctgagccagcatttgaaaccaggccccatgaccaaggcccaagcgagcccagagacagcactaagtaaatgtttactgaatgcctgttcactgaaaagcaatctgactggattttggtaacaatctgggcatattttcttattaagaaatttggcctggcacagtagctcacgcctataatcccagcactttgggaagccaaggcgggtggatcacgaggtcaggaattcaagaccagcctggccaacatggtgaaaccctgtctctactaaaaataaaaaaaattagctgggtgtgatggcacacacctataatgccagctattcgggaggctgaggcaggagaattgcttgaacctgggagacggaggttgcagtgagccaagatagcaccactgcactccagccttggcgacagagtgagaatccatctcaaaaaaaaaaaaatagccctacagtaatatttttttctggagaaagggtctcactatattgccctagctggtcttgatctcctgggcgcaagtgagcctcccacctcggcgtcctgagtagctgcaattacaggtacatgccatcatgcccagtgattattttaagacataccatttgttaatttgtcatgtgctaggtactttaaatatttatgtttaatctcaaggataactcaaggagaaaaagccagtatcctcattttacagaattggaaactggaggctagggaggggaagagaaaagttacccagttcaggggaggcaacgcccgcctggcggccccaaagcccctgctccttttctggcccacacagctccctgtgctctcagaaggtggcctggggaggccagaggcccacaaatgggcgcagccagcatcaaagtgctcaggcagcctgcctggtgggcctgaccccacattgcagggatccctggaggagagggcccaagccctgctccctcagggagctttgccaggcctctctgagggcacctatttcacacccctgccttggtgggaatcattcatttgagaacttgccccccaggatgggagctcctccagggcaaggcctgtgcttggcacagagaaggtgcatcataaaggagttaagggcacaggcttagggtcaggcaggcctgtagcctcatcaccctgcaacgcagccgtcttgagtgaaatgaggccctggcacagagttggagctctgtgaatggtgagaatactaacccctaccacagcaagcggacccactggtggccttgggcaggtccttgtccatcttggcttcagctggcttacgtgctgtcactgggggtcacattacctcacaggaggctaggtaggtgggaggaaataatgggtatatgaggagtcctggggagaccagagtgctgagcagagacaaaggcctgatattaggacaaggctgaattattgagcattttaaataaatgcatttccattacttccaagaatacacaggccttgcagataaggtgggcacagcaaagccaaccaagagcagctgtgcctcagtgaggcagggagcaggggaggagcattctagagcatctccagaccattccccagacatacactgggacttggtaatatgcaacccccaaaccttccacttgctcctcaaaacagttcccttttatggcttcaggaggggtagtaagaagcccgcaggaggaacggtgctggccctcttagccaccaacctatctggagtgaccttcccagaaccagctctgcctgccacaacctagaagctcaagccatctgatcccaaacctcggggagaactgcgcaaatggaaatcgatgtggggagcaatggggaatggggtctcgctctctcccctggtatttaatggctatgtttggacatggcatcttacctttcctgtcctcacctggataatagggcaacacagcctgctccagggtgttgagggggatgaaaggccaacgtctgtatgcgcctggcatgtaacctgggttcaacataggtaggtgagtgcactgagaggcactgggaacaccaaggggaacaaggccatccagggccctgcctctgtggggcttaaagtctagcaggggggaaaaggtataaggaatcgcatgtaagaacacctgcaggaagcggaggagcctttggtcaccatgctacattgtttccaacatttattttatactctctgtgtatccaaccggcaccaggcagtgggacacaggcttcccacggggtttggagtgtggtggatgagcttacggaatgtgcttccttaagacctagatggcctttccttcagcaccttcctttggctcacatttcaccctcatgaggaaacctcatgagcaactcagcccctgtgctgtctgattatcagcaggaggcagtgggcatgggcattcatgccacagagagagaaggacctgaatgatttggttgcctgcttttagctcaggttcatgtgaatctgattgagtcagtcatgtggtctgctcaattctaagggctggactgacatgtggcaactttgtacaggccagaccccaggaggccggctccccaattgcctttgccacactgcctctgtcccaccacaaccacagtgaccttaaggagcagaagggtctgttacaaatgtactgcccacatagggtaggggagacagatgtccaaaccaatacccagcctaccaaaggcaccctatgagagggttataaagagaccacagggccaggcgcggtggctcatgcctgtaatcccagcactttgaaagatcaaggcaggcagatcatctgaggtcaggaattcgagaccagcctgaccaacatggtgaaaccccgtctctactaaaaatacaaaattagcctggcgtggtggcacatgcctgtaatcccagctacttgggaagctggggcaggagaatcacttgaacccgggaggcacaggttgcagtgagctgagatggtgccgttgcactccagcctgggcaacaagagtgaaactctgtctcaagaaaatataaaaattaaaaaaattaagaggccacagcaattccgagaaaggagcagctccattctttctgggatgggcagggggctgttgagaaagttgcagagagcaggtgacatctgagctggacttgaagcacaatgaagagtttgtcagattgtcaaattgcagaagagaacgttaaaggaacaggctatgcatggaatgcacatccttacatagcagactgcacatttcaaaaatcagttcaaaatcacaatctcgtttcaccctctcaaatcccataatggtgttattaactgcctctcccacggccctccacctgccacacacaggcaaacaaaaaaagtaaggtccagtgaaggcagatggtgagccccagggcaaacaaacggtgactgatttctgagtagagggaagtgaggggtggactctggctgaaatggtcctcttctcactgaagtgggggattcctgaattcctgtccggcggcagcaccccacttcggcccctgctggcctgtgacaccctcctctcatccccagcatacacacacactcctccggccaccagggcctgtcagaaggggctggctgagaggggacggccggcagaggaaccaagcagcagggcctgggccgaggggctgggaaaaagctgaccgttctcgaaggcccagatcggaggccctgcccagcctcttcccctcctctaagtgctgatcacctcagcctctcccgctgcaagtctccttccatggcctctcctctcccatctcttgcagtggctgctgctggcctctcccttctccttcctccaccctcgccctccccggggagtggtgagctcagcctttcccagcagccgtccctaggaatgatgggaaatgcaccgccaggaactgagaacaggcctgcccctgggaaggagtgggagaagaggcgtcagggacagggctcaagtctgccacttcctaggacccctgaccgccgaagggacagtctgcctgtgtgtactgcacgctggaaggacatgggctcagactgtgtggactgccagggaccttgtcttacagatggggagacaaaggccccaggagaggagaaaggggactgactgcctgtcccaggcattgggagcctttcattgtctcatgtcatcctcacaactgctctgcaaggtgtgtgtggtaggctgagtaacagccccccgagatgcccacatcctaatcaccagagctgtggctgtgttgggtcatgtggtagaagagattctgcagatgtgattttgttcagggccttgagatggagagattatcctgcatgacctgggtgggcccaatgtcatcacaagggtcctgacaagagggaggcaggagggtcagagagagtaaaggcaatggggtgatggaagcattgaaagacagacgaaaatctacactgctggcttcaaagctggaggatggggctgggagccaaggcatgcagacagcttctggaagccagcagaggcaagggaatggatccccgctagagtttccagaggacacagccctgacaacccatttcaggactttggacctccagaagtgtaaagaatatatttgtgttgttttaagccactaaatatatggtaatttgtaacaggagtaataggagactaatacgacagacattcttattcccattctgcggaccaggaaactgaggctcacagaaggctcataactccctcaggccaggtgtggtggctcacacctgtaatcccagcactttgggaggccaaggcgggcagatcacttgaggtcaggagttcgaaaccaacctggccaacatggtgaaaccctgtttctgctaaaaatacaaaaattacgggcgtggtggctcttgcctgtaatcccaggtacttgggaggctgaggcaggagaattgcttaaagctggcaggtggaggttgcagtgagctgagattgagccacttcactccagcctgcgtgacagagtgagactccatctcaaaaaataataacaattataataataactccctcaggtccttcgggaatctctatgggctcttaaggttgggggcccctcagccaaggcttcaggctagggggagagtctgaggaggaggcagcggtctgccactgtaggctaaggctgaggacaagagagagaactggagaaggttaagctttgtgccttattacagctgggcccttccagatcccgtgactaagaactgccatgtcctgactgagaagcagggaggcgtgtgacacacaggaagggccctggctgtgcagctgggattggctggctgagtgtttgccggattaactgagatgaaatgaaatcccctacttagctcttggatcctgataaaacccctgtgaggaaattccttatccctctgcattactggtaaggaaaattggtcccccgggttagtgactggcccaagttctcccagctagtaagcagtggagtctgggtattcataatgagcaacagaaaaagcatcacagccaggcctgatggctattgagtgcttcttacgtgcctaacactgccttaacagttgcaggcattttctcagtcattccagatgcaaacctgatcacgtgcctcctctgcctaaaaactcttaaccgctcccaagagctcttcacaatctggcctctgtccagcctccagcctccctcccaccatgctccctgcccccacacaccctccagccacactgaccttggtcagttccctggagccaccaacttccttctcacttcggggtctcccacaggactccagtcccaccagcctggggccccactaacacagggtggagaaaccatgggtcctggccacctctgctccccattgtgtgtaaggaagggatagggccaggggtcagcccacaatggcaaggggcctgggaggctggagtcaagagggcccaagtcagccagtcatcttcttagtaaagataacagcagactggatgccgcagggcatggtggcacagctcccagggatgccccccctccagcagaaatgcagaccccaggacactggagcagagggggtttgtggaacacaaggtgtccccttaagagcatgcatggcaacatgaggcccacagaagggcaggacttgctgcaggccccagagtgtcactctgggagtcaggtcagagcaatggttaaggctttgggatctgccactcactagctgggtaactgaacctctgactctcgtctctaacaacagcacgtttttttttctttgaaaaaaaactttgttgcccaggctggagtgcagtggcaccatcacagctcactgcagccttgacctccccaggctcaggtgatcctcccacctcagcctcccaagtatctgggactacaggcatgtgccacaccaccacacccagctcatttttgtattttttgtagcgatggggtttcaccatgttgcccaggctggtctcaaactcctgacctcaggtgatccacccgcctcggcctcccaaagtgctaggattacaggcgtgagccaccacgcccagccaacagtgcctttcttcactgatgcatgtggagcacctggttcagtgcccggtgaacagagaggcccgtggtagatgacagctgctctttccattgagagagcagggcctgcactcgggacgcctgggtcccagttagtgctgcttccaccaccaccaccaccaccccacgctgcgggatgggggagatcacccgctgtagtgaattttaacaatttcatgttgcttgggcacccactctgagtatgtcagactttctcgtaccagaagcagggctcagtcacccttgacacagcttccagtgctcggcctcctcccagttcctcaatgtgatccatccaggtatctgccttatgcaacctcctcctggtgaccacctcgctatgggacagccagacagaagccacctaacttgcccattgacccccacacccacatgggctacatggatttgccgcagtgacccccctcagtcaccatgccttatgcctgcttgctctaatcccagcaattatatttacccacagaaactgcgtgggtaacatcttgcaccccaacaaagcctccagtccacaggtcctcccatctctctcttgctccaactcactggctaagcacggggtcccaggcagcttcccgctgccctcccctctgtgagtaatactctgcttctgttatttcctgggttttgctggctacttcctcagtgtctcacctgaccacgtactctcctagagagtggttttcttggtaggaataaacggacacaggtcagaaaagagccacaaggcgccttccactataagccagtttcctgtgagagagacacctggtcacggctggatacttaggcatcagaccatccaccaggataaagaagcatctcatgaaaggcacactgtggacccccacaaacacctgccctggaactccgtcagcagggctagaatttatagccattctcagagagagacctcaagaccaaattagaggaaaatacactcacgccacccctactctatgatatagctgggtgggtttaattaacccctcaggtgggacccaaacagggaggacacctggagaggtggcactcagctgtttctggagcctctgcttctgggcctcaaagctggttacaggtggggtgccgtggctcatgcctgtaatcccagcactttaggaggccgaggcagacagatcacctgagatcaggagttcaagaccaggctggccaacatggtgaaaccccgtctctacaaaaatacaaaaattagccaggcatgatggcgggtgcctgtaatcccagctacttgggaggctgaggcgggagaattgcttgaacccgggaggcagaggttgcagtgagccaagattgcaccattgcactccagcctgggtgacagagtgagactctgtcaaaaaaaaaaaaaaagtgctggttatgtccttatctcctctggtcatctatagaaaagaggtgatcggcttcgttttccttacaattaaaggaaggggccagcactgccccagcagagtgagcctaggctagaggaactcctaattcaaaactgagctccctacttgcaaaccgacagaagggaaagaggaatggactattcactgagcacttccagcgggtgggtgtcatgggaacctgccatgaaacatctcgcttaaaccccacaacagcacaacgagaggggctaggcagtagtccagtcccattttgccaggcacgatggctcacccctgtaatcccagcaactcagaagacacaggcaggagaatcatttaaggacaggaggtcaagaccagcctaggcaagacagtgagacttatctctttaaaaaaatttttttttaattaaaaaaaataataggccaggtgcagtggctcacgcctgtaatcccagcactttgggaggctgaggtgggcagatcatgaggtcaggagtttgagaccagcctgggcaatatggtgaaaccccatctctactaataatacaaaaattagccatgtgtagtggcgcgtacctgtagtcccagctactcgggagactgaggcagaagaatcgtttgaacccggtaggtggaggttgcagtcagccgagatcgagctactactgccctccagcctgggcaacagagcgagactccgtctcaaaataataataataataatcccattttgcttacatgaagctaaggttcccagaggtaaaacaacttaacttgtggcactggctggcaaagtcattctcctccactgtgtcaggtggcctctgggtaacggccccatttccattctaaatggctacagtctagggtctttttgaaggaaaggaacccagatcaggaagatgaggcccccaaagcagcctctcacccacccttagcccctatggcccatctcctccctccaggtgctctcccctcccatcagcctaccccagaggctggttattaacttctgtgaaaataacacatagcagtgctgctgcctcccccaacccccgacggcatcctcacccccacacccggttcacagccactccttctctgagttttgctcctttggcacttccaaagcctttagtgagctgcaactaggtcagatccccccatcagacaatctcctgtgcctgcacttttccctcggagcacatttcacagtgtgcatctcttgccgtctgtctacctgctccagaccataagccccattaagccaaggacatgtctgttttgctgccatggtatccccaggggtgtgcaccgcactggcacccagcctcagagtcactccacactcgcctgtgccaggccctgtgctaagagctgtgcttaggcatcacacttaacccccatcagtgctccagcagagtgagaatgatcatccggctgcacagatgaggacagcgagactctgaaaggtgaagtgacttcctagaggttaccccctagcctgggtcacggcagggaccagcaccgaggactagctacataatttgtgggccccggtgcaaactgaaaatgtgctcagatgtcaagacaaagtcctgactcgaagtcaaagccaggctccacccaccgagacgcttaggtcccctaaggcagtgggtctcacacttgagctggggtcacaatcactggaagggcttgttaaaaaacaggttgctggggcccagtcctagagttctgattcagtggatgtgatgtcggcctgggaataagcatttctaactttttttttttttttttttttttttttgagagagagagagattggatctcactctgttgcctcagctggagtacagcacaatcatagctcactgcagcctcaaactcctggactcaaacaatcctccagcttcagcctcctgagtaactgagactacaggaacatgcctggctaatttttttattattatttgtggagacaaggtctcactatgttgcccaggctagtcctgaactcctgggctcaaaagatctccccatggctgggcacggtggctcatgccgataatcccagaactttgggaggccgaggtgggcggggcacctgaggtcaggagttcgagaccagcctggccaacatggtgaaaccccatctctactaaaaatacaaaaattagctgggcatggtggcatgcacctttaatcccagctactcaggaggctgaggcaggagaattgcttgaacctggtaggcggaggtggcagtgagctgagatcacgccactgcaccctagcctgggcaacagagtgagactctgtctcaaaaaaaaaaagcaagagagatcctcccgcctcagcctcccaaagcactggcactgggattataggagtgagccactgcgcccaacataactgttgcatttctaaaggggatgctgatcctgtggcccacagacactgagaactgggctgtcagggctgaggatgtccaggatccttcaaacaatagtcaggccctcagtccaaatggccagccctactaagaaggagaggagcacatgggagtaggggcagaaggaaaggaggaaaaagaaaaactttacacaagtttccttgtttgattttcataacaatcttgccaggtaggttctattatctttattatagaaacaactgtagcacacagaagtcaataatttaccccgggtcccagccaggaaattacggagaccagaactgaacctggttctatctatgttaggtagctagaacctgcttgaaccacagctggctccaacaggttcaaaccccataacctgctcgcccaggggagcagagcccaagcctcaggagggaaggattagcacagcctcaagccctggggagccctggcaagcccccaggatcctccccttccactgcctgcgtgctctccaagcccaggcccgcagcacagagacccgggaccaggtgagggggccaatcactggtgccactccaggaggccagggtgcccatgcccagatgaaaggttcctcacacatgtcctaagtgccagatctgaccacactgtttcagactttgcacaggctgctcctgcctggaatgcccttcccaccctgcctctctgtccaactcttactcatccttcaaaatgcagttgggctctgggaagtgttccctcagcaccttgtccgtcctcactgctccatcaggtcaccctgcgatttcctggctgctcctccagccattcactgcacaaaaatttaataagcatctgccctgccccaggcacagtgcaaggtgctaaggctacaaggccgaggttgggctctgtcaggccaggatgtacgctggtttcatccctgtgaagctctgtaagccaggaggagcagacagggaaagggaccgtaagggtccccagggggaccccttggggtttgaaaaattagaagtactcaaattctacattccaggccacttgcctaggtggtggggtggagggtagcccccacccagtgcttccaggcctggagtaaagatgcttggcaaagcagcacaaaactcctaccaaacaaatacgaagcatgctatgtacctctgtgtcaagaggcccagttggctgtgaactccccaggaaaccgaagccccatcggggacagggatgagaccaaagtcccccccagagcaggaggcagccctggagtggtcctgcagcctcttctcccaggagatttgggcttcaacagaggaggaagagaagaggtgaggtgcccccatcctgaaggatttgcctacagaccctccactggtgaagagggcattaagggtgcaccctgggaagccacagcccacagaagccccaggccggagaggatggctgctgcctgcccaaggtggggagggggctggagtggagccaggctggcggaggaaacatcttgatcagcaagcaggaggaaaggaggaggaatgagaaaggaggaaagagccagacatgcaaactcctccgcctcctccttccaaccaaaacagaatccccagcagactgagacctgtggagaaggaggcgggaaagaagctgaggcctccaagggcgggtggctggatggtggccctgaggctggagcctctgaaagcttggggggctggatagccccaccagagatggggagggatcagtcatcagggcctgctcagctctgttcccgcaagggctgaaggctccaggaggaagaggccatgggctccacatggtaactccgattcctccttcgagaccccactcaagtacccaactcttcccaaagccctcagacctgacctcagctgggctggctccagcaccgcacaaactcaaaaacattgtagagtaaaattcatcctagtctctggaaagcctggaatctgctaggaaacccaaggaacccagaagaggaagtgccagcacagagatggccctggactcccagaccactgggcgctgggacacacttcatttccattcgcaaagccttcatgggggccttttcctctggtgggacaggaggctgggatgaggagacaggaggggccatgggagctgagcaatagggagacatcatctttgcccctctgccctcaacacaacacacgtgcacagacacacacatacactcactagtgggggctaagaggctcccagggacctatgtgtcttggacaaatcctttgacttctcttgttctctgttttccctcacctgcacacctgctttcctgccctccttcctttcaggagaggcacaaggtaaagtttaggcctccaggtaggtaagaacaaaggcctctggtatgacctcagcacgtggaagaaaatcccaccccacgtggaagaaaatcccaccccattcctgctcacccccccccaccaccatccccccacctcttcctcaggactctattatggcagagtgagcctgggaggcagaagctgtggtcaggaaagtaggcagccaggcttggagcccaaggggagagtgaccaccaaagtaacccatctcctgtccagggccttttctctccttcttctctccctgctggcggaaaccaccttccttacacacatgctcaccaccatttgagagaggctttatgggatgactttagtctgtgttttccttacagccctcatctgagttacttgaagctgctggaatttaggggtccttctttcattcacttttttatcctagtgaactggtctgccttggttggaaccggctagagggcatcagtcaagtgacctcccctcactcaacttgtttcttcatctgtaaaatgggatgatagcagtgcccaccccatcaggttgttctgaggattaagtgagtgtagtgtctggcacctagtaatacacattagatcttcttatgaatattcaacagaatttattgagcacctattgtgtgtcagatgctgttggccatcagacatatggtgaatagggcagatttgggcaaagggccctgtctacataaagcttcccgtctggccagggaaactgcagggctctgcactacacaactcctttggttaccatgacacagatcacagtgcaaacagaacacagagcgttcctacaagcaggtaacacagcagccctgcaagacaggcatcatacaaacaagtatatggtgactctcacaataaatgctataaagtggagggctccaagagcccaggatgggcacagaccagcctaaggagtcagggaagtcttccccaagaaagtgacatccgggctaagagttgaagaagcagcagtactaactccaaaagggacaagggctggggtgctgaactggggcaaaacaaaaccaaacctaccagccagacgcctgttatcccagcactttgggaggttgaggcagatggatcacctgaggtcaggagttcgagaccagtctggccaacatggcaaaaccctgtctttactaaaaatacaaaaactagccaggcatggtggcacatgcctgtaatcccagctacttgggattctgaggcaggagaatcgcttgtacccaggaggcagaggttgcaatgagccaagatcatgccactgcactccagcctgggcaacagagcaagactccatctcaaaaaacaaaacaacaacaacaaaaaacaccaaacctactatgggagggttctaggggaagacaggggaatcactgaaggtacaaggccagcagggacatgggggcagggcctggtcaccagaaggccagatcagaagtgtggatattactctgtcaccgtgataagatgttggtggggtttcagcagataattgacacaatgcagtcatgctttagtacgttcactttggctgctgggaggcgaatggaagggcagagagactggagtggaagcagagagaccagttaggaggcagattcaactagactgctctgggttcaaatcctagatctgccgtttattagatgggaaacctctcagggtctcagttttcccttctgtaaaatggagattacaacagtgtctacttcctgggttgttgtgaggattaaatgagcaactttacgcatgtaaagaacttggaacaatacctggaccacaggaagtgctgtatgttttgctgatattattcatctgggtcagaaatgagggtggcccagattagggaggtagcaatgagagagaaagagaaaactggacagattcagagataaaatcaataggtcttgctccaagcaaccagctgctccagcccaccttgtgccacctgcagccatcagagagaccctaagccagaactgcccagcggagctcttcccaaactcctgacctacagaaaccacagtccataacaaaatgaatgttgttgttttgagccactaagtttttgggtgatttgttatgtagcaaaagataaatggaacaaccctcattgaaatgtacctagaggggccgggcgtggtggctcacgcctgtaatcccagcactttgggaggccgaggcgggtggatcacttgcggtcaggagctggagaccaacctgtccaacatggtaaaatcctcatctctactaaaaatacaaaaattagccaggcgtggtggtgcatgcctgtagtcccagctactcgggaggctgaggcatgagaattgcttgaacccaggagacgaagattgcagtgagcccagatcacgccactgcactccagcctgggcaacaagagcaagactccgtctcaaaacaaaaaagaaaaaaataagtgtacctggagaggaaaccttctctccccccatgagcaagaagggaagcagctgagcaggaaggaagcggaaaggtgtgcagggaagatgggaggggctgagagccaagcctgggacctctgagccacccagggtccaggctctgccttcaggaagtgacgggatagctccaaagctaatcatttcagcactatttacaaaaccaaacacctggaaataatgtaaataccaaagaaggggctggttaaactgtagggcacccacatgaggaacaatcattaacgaatcgagatactacgagttaatagcataggagatactgaagaaaaaaaaacgtattcaaaattttacatacagtttaatcacaatggagcttgaatacacaaacacatgcatgcacacacacacagcaagaagcacaaacaccaaaaagtgttagaaatgttgtttctaaatgatgaaattctggatgattgctctcttctccttgtctaatgtggagggttttgttgttgcttaaataattactgaaagataactgttagttctttcaagccctcagaactcaggctgtgtgcccgcgccctccccccaggtctaggggaacatagcaccagcatcagttgctccatgagggcagggattcttgcctgcttcctttactgctgggacagcgcctagcacacagcaggctggctgagcacttcctggtgaatgaatgaatgaatggtctttatctgcccgtgcgaagctcctctgagtccacagcagccgccctcgtcagcctcaggtagggatgaggtctggccccactccatgtcctcagggttcagaacagggcctggcaccgaggaggcactagcaagggccgtgaatgaacgaagggctgaataaatgaacatcctacccaaagaagccctccctgatcaccgttgccgagccctggaggcctggggagtgtgcgtgtgggtgtgggtgtggaatagggggcagcaagaatggaaacatacctgggtcttctgagaacccagagagcctgtgcacctgactccaactccacctgcctcctcgggccccttccctttctgctgcgactttgcctgtttggtccccttctgagaccacagaaaagttctggaaggttctaactgctacgtctacactcaaagtgtagctgtttttaaaaggagaagagagcaaggcccttcctagacttttctgcctctctaaccacccccacccctgtccctgggagaaacctctgggagggaagccagcacatggggacccagggctggtggctggcgtgaggtgaggcagggagggatgcaggtgtcagagactcaggcagggctgggcgggagggccttggggtagagacctgaagaaaaccctgtggaaggaaatggcagagaacgtatgctggttgtcagggttggagaaaggactacatggtgcaggggtgacaactgaggctggcagtgggggaggtgccaacatggagagattgaccgtaaggaggaccagcagtggaatcagattgtttttgtccaggagaagtgaggtcagactgagcctgaatggctaccagaggggtggggcaggaatcccccgaccctcaccccagcccctactctggctgcccagaatgccagcccaaaaaaggcagtttactttgtttttgtttttgtttttcaacagggtctctcgttctgtcacccaggctggagtgcagtggcacaatctcagctcactgcaacctccgcctcctgggttcaagcgattctcgtgcctcagcctcctgagtagctgggattacaggcatgtaccaccacatccagctaacttttgtatttttagtagagacaggagtttcaccatgttggccaggctggtctcaaactcctgacctcaagtgatctacctgcctcagcctcccaaagtgttgggattataggcgtgagccaccatgcctggcccagtttactttttataaaataaatctcaacaggcatgacactttaagcccatccaaaatatagactagtgaactctgcggctcatgctaagaacaggtaggggctgaggccaccaaagccgctccccaaaccaggcttggccattaccttccaggcacccccaggcatgccccagcctctctctggacctcactaaccttgtgcgtaaagggacctctgagatcccttctggacctcacgcccagggctctctggtctgaccctgccagtgctcaaagcaaaagccccaggcccaactcgggccggctgactcagaggcttggaggttagaaaacagaagaatctcagagctcagccaggctgacctctcccatgacaggtagggaaactaaggcctaggatctttcctaaggtcccctcaaacctagggcaccagctcccaagcctagggcattttctaatgccttgaaggagctctgcagggtcccaggggaggtggtgcctgctcaggcagctctggagaagcaggaggtgatgaagaattttcattaacagccaaggctccaggctgggaggaggagggtgctgccggaggatgtgcgagagctcctgagagaggcactgagtcatgcttgcagctgcgtccccagaaagcagcccagggcctggcacagcgtgggtgtgcagtaaatgaacaaataaataaaaatgtgaatgagtgataacaacagcagctaacacgtagtacttactttgtgccaagcactttacaaatattaactcatttaatcctaatggaaacattaagattcccataacaaaagatgaagattctcataataaaaattttgttattcctcttttatagacagggaaactgaaacagagagaggttaaataacctgcccaaggccacacagcttgggcagtgtgggaagtctggcagtcaaccttggtcttaaccactctgcctcccactcagcacccttacctgccacagcctctctcccacacaccgtctccagcagtctcaccctaacgcccatgtctcatcgcaaccccatcccctcttactacacactgcctttttaaaattactgtctttttttttttttttttttgagacagggtgtcactccagcccaggctagagtgcagggctgcaatcatggctcactacagcttcaacctcctacctcagcctctcgagtagctgggactacaggcatgccccaccacacccatgcctaatttttgtatttttagtagagatagagttttgccatgttgcccaggctcatctcaaaggcctgagctcaagtgatctgcccatcttggcctcacaaaatgctgggattacaggcatgagccaccatgcccagactcttgttatttttaagaataattttgtgctgggcgtggtggctcacgcctgtaatcccaacactttgggaggccgaggcgggcgggtcacgaggtcaggagatcaagaccacggtgaaaccctgtctctactaaaaatacaaaaaattagctgggcgcagtggcgggtgcctgtagtcccagctactcgggaggctgaggcaggagaatggcgtgaacccaaaaggcggagcttgcagtgagccgagatggcgccactgcactccagcctgggtgacagagcgaaactccatctcaaaaaaaaaaaaaaaaaaaaaagaataattgtataaaatgtatttttttgaaacagagtctcactaggttgccgaggatgatctctaactcctggactcaagcaatcctcctgtctcagccttccaaagtgctgggattacaggtgcgaaccacatcaaccagcagaaaaaataatttattgaggtgggtgcagtggttcatgcctgtaatcccagcattttaggaggccaagacaggaggatcacttgagctcaggagtttgtttatttttttgttttgttttgttttttgtttttgttttttttttttgagtcttgctcttgtcgcccaggctagagtgcagtggcgtgatctcggcttactgcaacctctgcctcctgggttcaagcgattctcctgcctcagcctcctaagtagctgggattacaggcgttcaccaccacaccatactaattgttgtaattttagtagagacggggtttcgccatgttggccaggctggtctcgaactcctgacctcaggtgatctgcccaccttggcctcccagtgctgggattacaagcatgagccattgcgcctgggtgagctcaggagtttgacagcagcctgggcaatgcagcaagaccctgtctctacaaataaataaataaaaataaaataaatacataaagtgaacaattcagtggcatttagtccattcacaacgttgtgcaaaaccgccacttctatctagatccaacgcatttccatcactccaaagtaaaaccccttactcactatgtagtctctccccattctttcctctctccaacccctggcaactaccagtgtctgctttctgtctctatggatttctctattctggatatttcatacaagttgactcatactataggtgacctcttgtgtctggcttttttcatttcacgtaaggtttgcaaggttcgtccactttatagcatggatcagtatttcattccttctcatgggtgaataatgttgtacagcatggatataccaccatttgtttatccattcatctgcagatgggcatttaggctgtctgttcccactttttggctattgtgaatagtcagttgctgcctgttcctcctccctaaaaccctgtgaatgaggacagttgttcatccccattccccagaagacaacattgaggttcatttgtgatacagatggtgacttgaactgaagcccctgccgcccaaatgaaagtgcccttcttacatccttgtctcccaccagccattcacccatcccaagtgtcatgccttccctgggcatctgttaccacattctgggctctgtgccaactgctggccacctggtgtggacagctcaggccaagtcccagactctactatagtctgaagctgcagaggcctggaggctgcagtctcaccctctgggatgggctcctgtccagccaaggagtcccaggatccagggccaggggccaggcataccacatccaagatgcgtatagacaggagtgccctgctcctgccctccctggatcccagtattcctcaatgcacagaggaagatggcccccagcagatggctccagagatctgcacagcaaaaccattgagtggaacgggaacggctgggctgagagggccgtcagaaaacactgaactcagagccctgaagagagtggggcagccagtaagggtttcccatgcaaattggtcactgcacctctcaaatgtaaacacactagaaacagcacttcgctgggaccattccttcctgctgtgtaactttttttttttttttttttttttgagacaagttcttgctctgtcacccaggctgacatgcagtaacaattacggctcacagggctcactgcagcctcaacatcctgtgttcaactgatcctcccacctcagccgcctgagtagctggaactataggcacgcaccaccatgtctagctaattttttgtattttttatagagatggagggtctcaccatgttgctcaggctggcctggaactcctgggctcaagtgatcctcctgccttggcctcccaaagtgctggaattacaggtgtgagccactgaaccttgctgctgtgtaaccttgagccaaaccttctctgagccatctctgcctaaaagcagggttcagggatctagaattccagattctagggtgggaggagtgggttgtccttgcagagcccctcctgttaaagactacatccactcaagctgtctctttgtgtaagatggtgtgactatgaccactacgcggaccactgccttcctggcctttcacgaaaccaccttctgccacacattagcctgttaatgggaccatcctcagagggtttctgacattccatgtggggacgaacagtcacaataatcactactggctgggcactgtggtgcatgcctgtaatcccagtgctttgggagatcaaggtgggaggattgcttgagcccaagagtttgagaccagcctgggcaacatagtaagactccatctctacaaaaaattttaaaatctacccaggcatggtagcacatacctgtgctacaagtctcagctacttgaaaagctgatgcaggaggatcacttgaccccaggagttcgaggctgcagtgagatgtgattgcaccactgcactctagcctgaatgacaagactgagaccctgtctctaaaaaaaaaaaaagtcactactgcctctcagactccctttcacacatgacagaggcctgacaaatttgcactgaatgaataaatgaacgaacgaacaatctgtcactcatttcccaacttctagcctctctcttctagtctatttacctacacagctgccacgtgaaccttcagatcctgctgctcctgcaagctgtgtgttcagacaaattgctgaacttagctgagccttcaattcctcaactacaaacagggactctacttgggtaattaggaagattgaaagaaagcataagcacagcatctcaagggctaaggaggagtccaggaaaagctgttgaaggaaagctgtttctccccaccccaccccataacaccccacaccaccctgatcctctaatctctctgttccaaaggctgcaggaaagagcccagcccctgggctggcccctggctatatgtaaatgtttatgccaagcccagcctcctaaggacaagttatttgctttgcttgtaattaattgcagaaggcctgcctgggtaataaactctgccgaagaaatataaacagtttgcacagagcttcaaatccattgtgaggccaagagaaagggtctgctaggaatggaatgttctccccagtcttcctctaagctggaggcagagagatcactgaaggtcagaactgagaggacccttggaaatcatttgaaaaatagcacctggcatcatgaccttgttccaggcccggctgagcacttgctttatatggtacagctattttcccattctaaagatgaagaaactgaagctgaatgaaagtggcagggaactttccccaactagaaggcagctgggctgaaagttgaatctggctggactttagagaaaaagaaagacagccattcattcaacaaaaatatcccgtgtcccccgtgccagacactggtacctggtgacacagctcctgcagcacttgcattccagcagggagaggcatatttcagatgttgaggactaaaatctgatttttattttttgaggcggagtctcgctctgtcgcccagtggcgcgatctcggcttaccgcaacctccgcctcccaggttcaagcaattctgcctcagcctcccaagtagctgggattacaagcgcctgccaccacgcctggctaattttttggtatttttagtagagacagggtttcaccatgttggccaggctggttttgaactcttgacctcaagtgatccgtccgcctaggcctcccaaagtgctgggattacaggggtgacccaccatgcctggccatgtctgatttttttttttaccttgcccaaattcctgtctaaggggtctggggagtcatcttctacaaaccatgaattctcattgtcaggcctctgagcccaagctaagacatcacagcccccgtgacctgcacgtatacatccagatggcctgaagtaactgaagaatgacaaaagaagtgaaaatggcctgttcctgccttaactgatgcctttatcttgtgaaattccttctcctggctcatcctggctcaaaagctcccccgctgaacaccttgtgacccccacccctgcccgccagagaacaacccccttttgactgtaattttcctttacctacgcaaatcttataaaacggccccacccctatccccctccactgactctcttttcggactcagcccgcctgcacccaggtgaaataaacagccttgttgctcacacaaagcctgtttggtggtctcttcacacggactcgagtgaaactcatcagttgggttttatgtaaccctacatgtcgtgacttactttccagtctgactctggcataacattactgtaaggcttctgagctcaagcccgcaggtatacatccggatggcctgaggcaactgaagaaccacaaaagaagtgaaaatggccggttcctgccttaactgatgacattaccttgtgacattccttctcctggacaataagtctccggagctccccactgagcaccttttgacccccgcccctacccgcaagagaacaaccccctttaactgtaattttccactacctacccaaaatcctgtaaaactgccccacccctatctctctctctttgctgattcctttttcagactcagtctacctgcacccaggtgattaaaaagctttattgttcacacaaagcctgtttggtggtctcttcacagggatgtgtgtgacaattgcgagataaggaagaaaatcagaatattttatcccaaaacgtgtttctctgccatatcttgaaatggccctgcaaagccatccttagtgggggaaaatctgcgtctgtaaacatagctagatctttttcttcgaggccctcccaatcctgatgagaatgactaaaagtctagcaccttttaaaggtctgaataggaaacatttgtcatctattttctctaagggcagccaccattagacttcaaaagaactttcgtctccacaatcttttatcttaacctgaacatttcctttctaaggatcccaagtctttagacaaactcaaccacctgtcaaccagaaaatgtttaagtttacctatagctggccaggcgcggtggctcacgcctgtaatcccagcactttgggaggccgaggcaggctgatcatgaggtcaggagttcgagaccagcctggccaatatggtgaaaccccgtctcaactaaaaatacaaaaattagccaggtgtggtcaggcgcacctgtagtcccagctactcaggaggctgaggcaggagaatcacttgaacccgggaggcggaggttgcagtaagctgagatcgcgccactgcactctggcctgggcgacagagtgagactccatctcaaaaaaaaaaatgtacctatagcctggaagctccccccaacccctgcccaccgctttgagttgtcccacctttctgaaccaaaccaatgtattccttaaatgtatttgattgatgtctcatgcctcctaaaatatataaaaccaagttgtaccccgaccaccttgggcacatgttctcaagacctcctgagggctgtgtcacaggccacggtcactcatatttggctcagaataaatatcttcaaatattttacagagtttgactcaacaacgctcaccaaattgattacagcaggtgctaagtgctctgaagaaaaaaacaaagccacttgtcaagaagggcagagccacagttgtgggtggccattcaagctctgcagggcagaaaccatacagtaagtgctctggcaggagcacacagtaggtgtgttgtaagcaggtttccagctaaaacttaacactgttttctttgggcccagtgcagcttcttgccaaccagttcagggtgtattgaaggcattgtgccagggctggggaatagaatgattggtgaacaaaaatcagtccttgccaccacggagcccacacccaactgggggcacagacaaacggggaagtgtaaaagagaagttgatgagggtcatggggcaggagagggacaatcagcatgtattgagcacctactgtgtaccaggcactgtgttaagccatgcattatctcatttaagccttaccacaaccctatgggggtgaggagaggattttattacccccattttaaagatgacaaaaccaaggttcagaaagattatgtaaccgtctctaggtcacaggcataacaagcagtaggggtgggatctgaaacctagccggacatcatgtttgttcttcgaagccctccccacagccacctgtcttagggaagcacagaaggcaagacattgctgccaacaaactccgcttccctgactctgcagagggatgcaccgcaccctgccagcctggcttcctttctgagcaggaaaggtcagctcggcctgccctggcagctcccctcaggcaccagaccagccagactcctgacccagtcccaggagcaggaaaggcctgtccagacttctactctgccccactcccacagaaggtcccatcccaggccgggcgcggtggctcacgcttgtaatcccagcactttgggaggcccaggtgggcagaccacaaggtcagaagttcaagaccagcctgaccaacatggtgaaacctcatctatactaaaaatacaaaaattagctgggcgtggtggcatgtgcctattatcccagctactcaaggcaggagagttgcttgaacccgggctgagatagcaccactgcactccagcctgggtgacagggcaagactccgtctcaaacaaaaaaaaaaaaaaaaaaaaggccccatcccggttacaacagccccttcccaggcaagccgtgctccacagtttataaccactttcaccctcttgattcgtctgaccacctcaccccagcagcttgtatcccagagcctaataccaggcctggcacacagcaggttaatttgacagacagcaggacagactatcccaatgaaaggcatgggctcccctgagccatctccatccagctttcatcagcatttcctgagctcccaggacaagcctggggctagaccaggcagtttcacctatggttcattattttaacctttccaggaaggtcttatctccattttgcagaagaggaagattgaagtcagagaagcctttccagtctctaatttacatggcaagtgaagctgcaggttcagcctgccccagaactggctcccctggatgcctttcaggtgttgcttctgtagggagggctctaacctatgacagatctctgctgtgggatgagagccccctgaggacatgcagcagatgtggcaccaacatcctagcccaaacgaaaacttgccacagcagggcagagctgggcttgggcgcctaaagcttacagagcttggaaggttttttttttgtttgtttgtttgttttaaaaaaaaaagagtacaaaaataatttccttttgcaaatttcacaaaacccctgagcacatggacacattgctaggccttggaaagggccctggagcgtgaagggctggaagctgaagctgcatcagcctcatggtgaatccgcctcggggctggaggaagggcccagaggcgatctgagcaccacccgccttcacaaaggccctgcctccagcccaacagacagatgaggctccggaagacattccttcttcttgatgggagtcccgctgctacttaaccctccctgcagtaggtccaagtctgtctgtctttctcttgccatggtttcagaagaagcagatcttggccggacgtggtagctcacacctgtaatcccagcactttgggaggctgagacgggaggattgctcgagcccaggagttcaagaccagcctgggcaatgtagcaaaaccacatctgtacaaaaaatttaaaaattagcctgggatggtggcgaacacctgtggtcccagctactcaggaggctgaggaggaaagattgtgtgagcccaggaagtcaaggctatagtgagctatgatcacactactgcactccaggctgggcaacagagccaggccctgtccctgtctcaaaaaaaaaagaagcagagctcagctgagtctcggacctgcctgcggaggtctgctgctcacaagggcagcactgccagatttctttgtgatcctggggcacaaccccaagaggagccttccatgcctgggctggaatcctgggcctggaatcctgggctggcaagggctgccctattaagaaccccatcctcaaacatttgtagggtatgatacagtttaccaaatgttcccacatcccacatccacatcccgtttggcccacacgacagtcctggaggtgagcagggcaagctttattgtcccccttttatagacggggacaaaacatgagacttgctgtgcacctattgcatactaaagatgccaaggggctttccacacgtgacaactcacagataccctgtgagaaaccaaggctcactcagtgtctggggctgggcctgagaatgagcctgcagccctgctctcccatctcgcagcccgtgcctctgccctgtctcatctcagtctggcatggacagctcagaaggcagtgggcaggcacgctgagactcagtaggttgaggaagaagaggcctccagctaccaaggcggaagagtagctgagggctcaatatatttaatagaaatcaaaaaagtgagaatcaaccgtgccctctctggatgtgtctgaggaagagcacatggcccttgggagcctgaaacctgtttgaaagcagtcaccttacagactcagggcctgatgtcctccccacaccctgccaagctgcagatggccccacccctacctcccactgtccacatgctaggccttccagacccttctgctgactcctctcagcgcccaaggcagccacccagtgcttgccctggcctgttcaagtcctactcctgtccttcactaatgcttgcttaattcgtggatatacctactctacgaatctttatgagaagatactgtagggtgacccacagtcctgatttgcccaggagtgagctgaggggtttcctgagatgcgagactgagactgtcccaggaaaattgggatggctgacgaccctcatgtactgcatgcctggtccctgggctgggtgccaaggacacatttatctaccaaacatagtcactgccctcaagaaacttccagtcggagagtggctgccactcaatgagaaaccactgtcaaaggcacctgttcagcccctcacacacatgatccatcaccaccctatgaggggaatattatcacctccgtggtatgcataagaaaactagggctcagaaaggtggcacaatgtgcccagagtcagagttacaagtgacctgctaagatttgaacttgatccaatgaaacagaaaaagggcagtttccagcatgaacattatggagatagaaaaagatagacatgttttatttaattcattttgtagctccagtgtctggcatgttctaggtattcaggaaatgcgtgaagggagagagggagatctaagccttatttaattatctccaggctaggagattccatccctcaattcaaaagccatacatttcccttttcaaagtcagtttcagaccaggcacagtggctcacacctataatcccaacactatgggaggctgaggcagaaggatctcttgagcccaggagtttgagaccagcctgagcaacacagtgagaccccatctccacaaaaaatcttcgaggctgcagtgagctatgatcgtgccactgcactccagtctggatgacacagcaagatcctatctcaaaggaaaaacagaaaaggaaaaaaaaagttttgactgttttccttcagcacgaggaccaggaaggaagtaagaagagggaaagggtgctttttctttaagtcagcagctcggggctcacttcctccagggaatcttccctgactcactccctaacccaagtctggccccacactgtgccaggccccagtcaggagctgggagtccaagagacaagagatacacatttgccctcgagcagagagggaactgacttgttagcagtcaactacaatgtaaagtgccatccgggaagcctgcacagtgctaagggagcctggaagaggccattcactctacctgggcagggagcagtcaagggagggcttcatgtctacagcaggtgccctgtgcagttgttcaatgaatttcattgaaatgtctttttttttttttttttttttttttttttttgagacggagattcactcctgttgcccaggctggagtgcaatggtgctcaagtgatccgcctgcctcggcctcccaaagtgctgggattaagggtgtgagccaccgcacccaggctaaaatgtttttaagttcaacctgaaaatataaggaatatttcaccagaggaagaagggcattccagctaaagagatcggcttgagcaaaggcacagaggcgtgaaaagtacaaagactgttgaggaagatccaaaaaagtcaatgcagccaggttgttagcagtgtggtggggacagctgggaaaggagtgtggaagggacattagagacagatcctgaagggcctccagtgccacctagagaatggggactttcccataggacatggggagcagtggatcaggccttaggctgggaagaatgaccagatgtgaatttcagaataacaggatggcttggagggttgggactgagcagaaagacagcaactagaagacaattgtaatgatccaggccaggagtggggcttgacctgagccagtggcggtagaatgaggagaacagtactttgggagccatgtctctatcaccattcagtttggatcccctgaactggggctgcccacaggaaggcatggttttctcttctccagggagctcagcacacccccatccaggtctacactcaaatggaagttgaggccagagcctcagtgtacagaaactcaggtctttctgtacactgggtcagggctcagtgtggggccaggtcatggttctttgaaagttctccctactacaaagtttactctgcaaatggtgaacatcagaggtggctgaattgtttcaagtatgcacagtgaatcactgctgtactgaatcgctgctgtggaacagtcagcgcagggagaaacgacaacgcatattaatcacttgattatgatgtgtaatcatttttgtcatttttagaatgtcaaaaaaatctgttgcaaaaaaaaatctccttattgagttttaaaacgtctgtaggtttctcccagtaccctggggcaatagagacccatcataacatcaaccagtgatgagccctgctaatgtgctgggtgctttaattagcacagctgtaaccgagaaaggatgaacacattatctccagaggctggaaaacttgcctacagacatgcaattactggtaaaggggaggggagaaccccagcctgctgcctcctctccaccactccacgtggcctcagtgtgcccaaagatagccctccaatctgtagagaccagcgcacatggcccctggctgccagccccaaagcctggagctgtttctcctaagacatagtttctcaactgtctcatgcccatgggctcctctgggaagagccatcagatctctgcagtgtctcctgggctagagggaagctttcctctccataccctcaggacagtagaccctggtttccaatggcaggtttgctgagcccagtgtctcctgatatacccaccccattttctttctccaggcagaaacacttactgtgatgccctgtggcagaactttcacttttcaccctagtttttttgtcctcaagcagtctgcattcccaagacactccttactgacagcagatgaaaccagtgcctgacactatgccggcacatagtaggtttctcaagtctgctgaaggaagtcagtcctggatgaaaacacatgtcacagagatactgccaggaagagtactacctctggctcacacaaacgcactttccaaccaggtcgtgagtccctacttctggggagctgcctctgatccttaacctctggccctgttttgtccctgctataaacagatgcccactacccctcttctggcagctgttgagatcatctatttcctctctcccaatacatctgagcagcatgagggcagagacttgtctgggtcctcttcatatttcaggtgcccagcacagggcccggggtgtggcacagagagaaagctttgttccttggaacctcctcaggagggcagcgatggcctaacagaaacgatataagctaaccctgaaaactcctagcccgaggcccggggagatagtgttccatgtcatgaggtttcttgccacccagaacctgggaaggccaggccctcaacttcggagaaagggcagcctcaggcgggaggcagagcagagctgctccataaatccccttcccactcggagagagacacaccactgggacaggcccggccacttcgggacatgccttgagtggagggagaaatgtttgtggaattgaatggaacaaactgtaaaatgctagctatttgttcctctggctgcagaggccagttgccctctgggggcagtttgcaggcaaattatctcaggacgaggcctgtttcctctaatgaggcttccccgctttgcagctctgctcccaagagagttggaggggacaatgctcagagccaaccccagaggcctgcactgaggaagcatacatggctcaccattctacacagtgtgggcggcactaccactatccaaggcagggggatgctccccacgaccttctgggtgcaggaattctgagcaatgcagcacctcctccaaggcccctctggggaaacagggaggaaaggagcagggaggcatgctcagttatgtaaccagctgccttggagtcagagtccctggcatatctcagcccagcactacgaggagaggctgtgggggctgggggtctttcttctcttttgctgcctcctccagacctggcagaccctgtagcaggcgctgctttccaagtgcctgagctccaagcaggcacctcctacttggggttgggaaccaggaaagctgttgttttctgagtgtgtgaaacagtggcctgctggctcccttggcagaaagccaggctcggggctctgcacaggggtgagggttaagaaagaggagcctggggccaggatgccaagggacttccctccacaaccgcccccagcttcctgctccccaatctctccccacttcctcctagagaatctgccgtgggtgaggggccagaggggagtggcgccagcagccccagcaccacactgctgctgctggccctgggcaatctcacttcccttcctgccttccttggagcttctccgctggccggcacagcccccactccctgtgcccccacccccgcgcactcagctgtgtacactaccctggaccatggaaaagagggatgaaagaggaggaaggggacatgggagagggaaggagctgagatccaccctcagtcttgaatgatgatggcttttttgttgttgttgttgagacagagtctcactctgtcactcaggctggagtacaatagtaagatctcagctcactgcaaccttcacctcccgggtccaagcaatcctcccacctcagcctccctggtagctgggattacaggtgtgtgccaccacacctggctaatttttgtatttttagtagagacgaggtttcaccatgttggccaggctggtttcgaactcgtgacctcaggtcatctgcccacctcagcctcccaagaggctgggattacaggcgtcagccaccatgcctggccgacaatggctttttatgaagcccttaccctctctgcccacagaaaccccattaatattattatacctatttcccaaaggagaaaactgaggccggagagtttaagacccaagctgaaggtcatggagctagcaagtgagcagtagagcagagtctgcctaactctgaattccaaactccaaacctcctgcctctagctctgggagcccctcctccacactctctgagggtgctacttgggcaattcctacacagatggaaatgacactgcccagccctggggagggagccctcggccttaaagagtccctcgctgaggactagtttgggaaccacaggacagtcccaaagacaggaccaaggctcaagggcaggacatgcttggggagccaggtgggcagactgctgctcccaactgtcttcccttcccacccagtctaggctggctcagactcctacactgtctgccacttccagaaggcagggctgccagaggccaagctgtcccgccagaatcacactgctgctcacgccctctcccctcctaacgagagaaggaaagggtcctagggaggagcctctaggccaaagcctctcctacttcctgcttgacacatagagaaactgaggcccaatgaggaaaagcagcttgcctatggcagcacagggacagtgaagaagtgagatccctgtctcccaggccagagccccttccctccattcaccccacttgggtgctctcctcagatggcacctttgggcatctgcccacttctctccctctttctcaccttccctctgcacttcctgcttccctctccgagccctgctctgcagacccatttctgagcctcccctgttacatctcctcccagcctcaccacctcaccccccttccctctgctctgggccaaggagcaatgcttgggtggtttaattagctgattatgaccgcagcctgctggatgcagtgcccagaattctgtccccagtaattaggtgggttctgagtacttgcccagtggggagccgatggggagctctgtgctctgccagccaagggaggctgtccagctgaataaagagctccttgatcaccggtgggtcatcggaaaccatggtcccctcctcaggccgggtcaaaccacactggagggactgcagccagacccagatgtccatcctaaggagggactccctactctcccatgccactgcccacacccgggaaaggctcagtacatgactgaggatgaggatgaagaatggagcgcgccctccagaggccgggagagaatggctccgtggccggggcacctatttaggaagtaggattggaccaagtagacagagaggcgcagcaggaacaaaggccctgaggcgggaatgagccgccaatccccttcccagagagctctggttgtcagaaaatacagtcttcaagcaaggtaaagctgaacatccagtgacctctgccctttaggtcacaaagaataatctaattcctatggctctgggctactttgagatattttgaaatcagcaatgatgtcctatggtcctcaccaaccacactgcccaccccctagagtatctcctcccagcgaaatgccttggctgaacaaatatttatggagctcagcggcatgccaggtctgcgcaggtgctggggacaagcagatccagggtgctcttgaaaagttcttgacctcacaagatgacatcatcacgagtgtgcaaataaccaggacctatgcagggagggagggatgagtgctgagagagagagattacaagaaggtcacaaagcgctgggaatccagtgagggcttcccagaggaagaggtgtatgtgatccaggccttgaaggatgggacagctgttgtatgtggtcaagtcagcaatcaggtactgaaagccagcaataatacaggcttgtaatgaggccttgggaggctcaaaaaaatgaatcaaacagggtccttccctgggggagctcacagctgggttagggaggcagggccggtgagacgtcatataagcgataagaaccgcataaaactgaccttgcacagggactttctttgctttatcttacttaattttaactcagtcctcatgacaacctactaccctattttacagataagggagccacagcagagaaagggttaagtaatcagggaagccacccagctggtaagtgtcagagctgggactggaaaccaggaaatctggttcttccaagagcctaaccgctatgctaatctgctaataatccatgctaatcagatcaccgaagggcctgcaggtgcccagaggaggccccagagcagcagagaaggcttcctggaggaagtgttcctgacctgagtatttttttttttttaagacagagtcttgctctgtccctctgtcgcccaggctggagtgcagtggcgtgatctcggctcactgcaagctccgcctcccgggttcatgctattctcctgcctcagcctccggagtagctgggactacaggcgcccgccaccacgcccagctaatttttcatatttttagtagagacaaggtttcaccgtgttagccaggatggtctcgaactcctgacctcaagtgatccacccgcctcggcctcccaaagtgctgtgattacaggcatgagccactgccctggacctgctacagatgctttatgtccctggaggtgaacatgactgctgttcaaggacctgataccatgggagacagcactaccctttcgagcagtagccaattccttcctggccgccagcacccaacacccatccccacccaggacacactccctggtggtctcagtcccactggcctgtagcagaggcctgagactttggccgcccagaagaaaggtcactcctggacctgctagcaaaagggcctctcacctgatttgacttcacagggaaactaggacccagagagggtgcatgtcatgcccaaggtcacacagcaataagtaagcagtagagcatgcctctgggaccattctgagatggtgagccacagcagtctactccccacccctcccctggccctatgccaaaacctgtccatgccctttgcacaaggcaggggcaagggtgaagagggaacaaacctagcagaggtttgctcaccctctgtccaaccctctgttctccaaccccctactaggactcaaaccacccctaggatggacgcatcctgcacacgggaaggcagaagagaaggtgcccaggaaccatctgagatgatacctattctaatcccagggctcatgtgggagacaaggccccaacttcaggagcccccagtgtgatgggggaagaaaggaagaaagagttcagtccagttcgacaagcctccctgcaaggctgagggaagggtgtggccgcacaaggaccaagtgagttggttgtgggctacaggcccagggccagcatgaaagggacctcctgcctcatccaggcccatacacgggctgttgaaccactgaatggttcagacattgcatcctgcctcccgctgactcgacatcagtcacagtgcttccagtgctgaaggccctttagaccagcagatccctctccaggtgcagggaggcagaagctcaactgtggcctcagccaggtgccgcccagccccaggcagaggaaaagctgttcagttcctgcggtgaccttagtcacacacaattctggggacctgtcttgtccaactcccaggggcttcatctggcaccaggtctcctgggaaggaacaagcagttcttctgaagtggggctaaagatggggccagtcccaggaaggaggaggcgcgtctcccgagagatgaccctgccagggccccttagggaaggcgggagggggctgggacaacagagtcctttgttaccctctcaaaagcagccaccctgtcctgccaaccccctctgttctccaaccccctactaggactcaagccacccctgggacaggaaccatcctgtccacataggagggaagaacacagggtgcccagggaccatctgagacgatacctgttctaatcccagggctcacatgggagacaaggccccaacctcaggagcccccggtgtgatggaggagacatccttccttcagaagcctccagtctgaggagggagacatggctcccacctgcaaaagccaatcagatgagggagccccaggcctcccgctcaggcgccccatgctaataggagtggtataaccctgtccctcaggacttcccagtctgatggaggagtcaggaccccacccctctcttttgagaacttgcctaatgtgggaaatatcgctttcagtcttacgattcactaatgggaaaggcctaatttcagcacttagggagtccctggaccgatagcagaggcaagaagggaaaaaaattttcagtccagttcagcaaacctctgccaggcatctcctggggaagcagacccagcgtgggtaaggaagcatcaactgagaaacagaaatagccctgaaccacaagctgcttaccaaatggggagctcactcagcctgaggtatgaatgaataagaaagtaccttgaaaccaccccctccagcatccaagacctgctggccaaggctgtcccttcctccacagcctcacccctcacactcccacacctgcagccagtatctgcaccttggcctaggctctttcttctgtctagaacaccttactcctgcctaagtctttctcatactccagcacccagctccggggtcacctcttcaaagaagccttcctccaagtcccccacctgagtcagaagcccctcctttctggagccagcacattacatgtcttccccaggaccagctcacacttcacaacccctcagcctgagcctgaaaggagagcacagggcagtggtcttctgcctctggacataaggcagagggagggggtggatgagataaaacccctaggttcccatacccagtcttcactgcctgccgccatactgcttgctcccagcccagggcctcacgcccttcctccaagaggctcaagccttgctccaggcatgtagaaaagcagggtcccctcccactcctctctgcccgctgtagcctagttttgccctcaccactccaccaaaacccatgccaccagctaatgccttctggctgaatctgaggggtctcgctccagctcatcctctgtgggtctgtccctgcttctttggctccaagaatatggccttccgtcagtttcctccctcttctctccatacccaggcactggtgctctccaaggccctggctgtccctaatcatcctctcttcatactctatacctcctccctatgcgatgtcattcatccacatttccaaagccctgcctcgcaccttgattcttaccccaggatccagacccttctatgcagaagccccactacgtccagcctataacagactgccctggctccctcaccaagctgctcccagccatgcaggcctcagccagatggtaggcgcgggcactctggcagtagcggagcatggctgtgtagaggccaggacctcacttggggtgtgctgactcccagcctgctgttctactgccaccaacccaaagtgtcagaagccctggaagtggcaagcccacaactcaggacctctggacccatgccaacgggaggcgtcagcctcaggcaaggaggcccaaacttggaaggaagagagcagtggagaagtctgaagcccagaggccggcctggaatcagggatcagagacagtgggccagacttgatgctaccactcccagcggccccatgagcagccctggccaaagccacaggacttccccatgttccagccaagatgggtcacacagggcttaaccaccaagagaaatgacagccaaagttcacagagagctggtgattacatgtcctcatcaccctcctttctctgaaaaaagaggagttcatctgcaggaaaggaaattccattccctaccactgcctctcaggaagtccctcctgttgtctaaatctgatccttcatgttgtctgttgagtaagtggaaacggcaaggcccagaaaggacgcacaacttgaggctgggagctgctggggaggccaactgtgagccagacaaggccccctctcttgggcaaaagcgtcgagtagcagagagggctttgtgggtcaataggcctgggttcttatgcttgctggctgaatggcagtgaacaaatacttaatctcttctagtctgtttcctcatctgcaaaatggggacaacaatgactacactactagattacagttgaattcattgagattatgcgtgtaattctaacacacaccagatacctggcaaaggtccaatcgaccagcaaggttgatggactccacctcctattcacattcatatttctcaactctatcctctctgcagcctaagttcagagctcacagccttagttctcaggtttctccccagcctcctcactggtcttcctgcttctaggcctgctcttcccatccaccctacttggcgctgccaaagacatctctctgaaatgaaaacatctgcttccagccctctgctgcctcacactcttctctgaatcaccatccacttcaggagaaaatgctctctccttagcctgacattcccagactgctggtgaccggtctgtgtttacctcttaaggctcactatcatccccagcccaggccccaggctgcacgccttgcttcctgcctccaagccactgcacattctgcacccttggccagaaatatcattcccaatcccgcccccttggcctattcatccttccagatgaagctcagtagttccaacgccacctcctttccaggagagcttcctgtaccatgctccctgcctgggcctgggttggggacttctccttaagcctcccacaacacatgtcatcctgcgttatgaccacctgctctgctctaaatccctggaggacagagtagactccttccttgctgaatccccaggccctgggcactcagaaggcactcatcaacatttgttgaatgaatatatgattgttcccagagcaccttgcagcaaccatcatactcctgccctgtgattagtcctgtccaggtattttttttttttattttttcagacagggtctcactctctcatccaggctggagtgcagtggcatgatcatggctcactgcagccttaacctccagggctcaagtgatcctcccacttcagcctccagagtagttaggactataggcatgtgccaccacactcagctaatttttgtgttttttgtagagatggtatgttgcccagactggtctcgaactcctgagctcaagcaatctgcccatctcagccttccaaagttctaggattacaggcgtgaaccaccgcgcacagccctgtccaggtatttaacacctctttcccccttgaccctgggagttcctagagggcaatgacagtttgtgataaattttcattgtcactttcacatgggggtgcaattccagatggagggatggttgcgatgattcctgatgttcagtttttgatatctgcagattcctcttctaagtcataggtactcatgccttacggaaaaagacaaggtacagcccattactgattttgcccttcttttccaaattacttagccaactgtccggaaagggacagaaaggcctcatggggctgcaggagagtctgaaggggaggtctgggccaccatcaggtggatttagccgggccttggctccaggcttcaggcagtgcctcttcccctgcccagtgaagtcagtaagtacaagggaagccctaaaatgtaagtattgatagctccagtttacagatgggaaactaacgtccggaaaagtaaaggcaattgcccaatgtcccaaaggtccaccagtgagtttgaggcagggcagggggagccatggaaaataccttggcctcagagacagggtctccaacaggtgcctggaagcccatggtgtccacatcttcctgacaatcatgtcagcaggacaacaatgacacttatcccccaagtcacagagaggtacagagagacccaagagaggctgagtcactccgatcacaaggcagcctaggaaggacaatggagtggagaatggctccgactccctgctatgccctgcaggaagaaaagcctgacctcatgggtcaagagggtcttaatttcagggcagatggatgtggctggggaaggagtcacataccttcctactgaggacagaggcctaggtcacagtgctggccagccagctgcaatggggactagccatcaaggttcatgcagacacagcatgatcttctgccgtcccccccaaagcctgggcctccagcacagagcagggctcccctccctggcccatgaggggcctggcagtgccctagggccatccacagagacatgaccaagtggactccagcctccgccctgcctctggccccttttgaccttaggcaaatcacatggcctctagccctctggttcctctgctagaaaacaggaagaggaaaattaacctcctggaagagctgtcaggaggatggctggaaagtagtttctaaacattaagagcctgagttgcctctgagcctgtttcctcctctagaaaatggaaataatctctgcaagccctttctcacactgtggagagagagtcttagatggcagtgggtgagaaatagctttgtcagtggccctgaaaggtggtgcccaccggggtggtgtctctctagtctgttagctccttcaggggaggagtgggccttgcgcatctttgatcccccacactacgcctagtatacagcaagagcttaataataaatggaaacgaggagaggggaggggaggaaaggaaggaggcagaagtcggacacaagaatagaagagaaagacagaaaacaatgagaaagagggggagcccagggagaggctgctgtgcccacttagggggtggggagggcaacggggaaaatagggtggcaacgctgagcccctgaccagcgctggtcctgtctgaagggctgcccccaggggctgtcctgctccagccccctcctccttttgtcccagtttcccctttcagaggcagagactgtttctgagtatttcaggacaggttctaggagaacgggaggggttctcccagccctaggttcaaaacagcccctggccagccactcctcaggaggtcagagggaaagggaacagagtagatggatgggatctatttggatgaaatgcgatctgttttccccaggctgggggtggcggggggcgctctaccctgtgtgatgtgtgtgtttccacttctggccatgtggggcctgaagcgtgtgtgtcagcgggccttgggctagcagctcgtgcctgtggggtgccagtctttgagggcatcagtctgattgtgtctgtgggggtcagtgttggtgtggccttgcgctccgctgtgttggtgagacatgccagcacaagtgtgtgtgccagtgagggtgatgtgtgtgccagcaagagtgtttgctacagcgagtgcaggtgacagtgtgcgtatcagtgtatgcccacacgtgtgtgccagcacgagggtgtgctagaattggtgtgtgttggattgtgagctgtgcatgccaacaaggctgtcagcaagaatgtgttgaccgaggcgtgtatgacggcgtgccactgcgtgtgatgagcgtgtgctagcggttgccagtgtgtgcgccagcatgcctgtgccacgggttagtgtgcccgtgcgtgtattgtgtgtcaacctgcccccgtgcgtctctgcggctgccggccaatgctgggtgtcagcgagctgtgtgtccgggccaggagctgcggcccacatggggcggcccggccctcgccctttgggtccccccgcccacggccctgccggggagaccacacaggagacctcgggtggaggagagctggtactagatcccgcggtggccgcgaacgcagaaccaggacgcaatcggagcccccgcccgtgtcctcgccgaggtcgcccccacgcgccccccgccgggcggccgccctgcactcaccgggtccctttgtcgcccatggtccgcgacggtcgcagggaggtccgcggcgtcagcgcccaggctggaaaatccccagccagcaggaggagcgcgggccagcccgctcccggctccctgctccgcctcctccgctctcccggccgccgccgccgcccccgcccccggtccccgcccgccgcccgccgcgtcgagcagcgcagcgcccgggccgcggccaggggcgtggaaccgcgcggggtgtgtgcgtgtgtgtatgtgtgtgtgtgtgcgcgtctgcgtgtgcgcgcgccgcccagcgaggcagggcagcgcggcgggacgcgtcagggccccaaggtcggcgtttgtggtgggggagggggtccacccgcgtgcgagtccgtgtgagagtgtgtgtgtgtgtgtgtggtggtggtggtggtggtgtggtgtatgtgagggcgcacggctgtgtgcgggccctattagggagtgtattggtgtggatggaggagtgtgcacgtctttgtgcagttgtgcgtgtgtgcgcacggccgtgggtgcgagcgcgctctcccgcgcatgccggggcagcctttgtgtgtgcgggtggttggaagccgagggtctggcgaccccgaggccgcgctccctgcggcccctcgcttagctggagaccccgggatgcctggcaaggccttcgccctgtgctccacccttccccattccacccaccccacccccttctactggagagataacacccagccacacaacagggacaggaagaaggggcggagggggcagtagacggccttgacactggggaactgagcggagacccgcggccagcaggggctgcaggaggccgcccaggaagaggaagctgtgagaagtgagaagaggcgataaaggaagagggcagagctggcccgctgctgtgaccgggtagcaccgtggaaagcgcccatgcccagctccatggctcgctgtgggtgaccctgtgcactaagcttctgagaacccatgtccggacctgtaaagtgaggatacactaatatcagcctgcagaattgttaataggttgaaagaactcgcttgtgtttgctggcctcccctgagcgcctgcatacagtaggtgcccagtagatgttagcccacttctctgcaggcttcttgatgtcctgtgaaatcttggctgggaccctgctttgtctgaggtgccttcctgctttgcaggtagtgggaaacggtaaggtctttaccacaccctcactactgagatttggctaattatcccggataggtccctgatatctaagtattaaggggaaagtaagctatcatttactctgatgctgttgtgagtatgtaaacatctcctgtaattatgctcagaagcagttacctatactgtttatatgcagtataattactataattatgtccagatttggcagaggggcagggggaggctgatgggtaggcagggtggcccacctctgggcaatgttaggagctagagagtatggatgaaagcccagaaccctcctcccagtcttggcctctgggtttcaccctctacagaggaagaagaggaagccacctgttgtttctgcagggctcagagatctggaaaggagcagactagaatcttctttgatgacaggagatccctaaccaggatggtgaagccaggtcctgccactctccacatcagtttccccacctgtaaaacaggtttgaccaaaccataagatctccaatggatctctccatgctgatgcccaaaacatctaaatatatttatttattttatttatttttgagacgaagtcttgctctgccacccaggctggagtacaatggaatgatcttggctcactgcaacctctgcctcctgggttcaagaaattctgccacctcagcctccccagtagctggaattacagccactgccatcatgcccagctaatttttgtatttttgtagagatagggattcaccatgttggccaggctggtctcgaactcctgaccttaggtgatccacccaccttggcctcccaaagtgctgggattacaggcgtgagccactgctcccggtcgatttaatttactttaaattccagtgagggagcaacgatggcagaagaagagtcaagaggacaattttgctttacctgccaggctctatgaaaaacatatatatatatatatatatatatatatttttttttttttttttttttttgagacggagtcttgctctgtcacccaggctggagtgcagtggcgcaatctcggctcactgcaagctctgcctcctgggttcgggccgttctcctgcctcagcctcccgagtagctgggactacaggcgcccaccaccacgcccagctaatttttgaaaaacatatttatgtattaataaaatggccgggcatagtggctcatgcctgtaatcctaacactttgggaggccaaggcgggtagatcacttgaggtcaggcgttcaagaccagcctggctaacatggtgaaaccctgtctctcctaaaaatacaaaaaaaaaaaaaaaaaaaaaattagccaggcatggtggcgggcgcctgtagtcctggcaacttgggagactgaggcaggagaatcacttgaacctgggaagtggagattgcagtgagccgagatcacgccactgcactccagcctgggtgacagagccagactccatctcaaaaaaaaaaaaaattaataaaatgtaaaagtgataatgttgaggagaactctttgtatatccacaatataatctcagccagtaataagttttatgaagaaaataaagcaataatgaaacagggtgatagggacaagtagacttagaaaaaggccctaggccctccgaggaggtgggctttgggctgaaacctgcggaaaagaatcagcgatgtgaggggacagtcagggaagatgctgcccaggcagaaggagcagcaactgtagaggcgcaggagcaaggacagtgctcctggtgttggtgaacaggcaaggggtggtacaggtgaggcagcagggttggggtcacacagaacttgtagttgaggatgaggagtttggggagccagtgggaggtttaagcagctgagcaccagtatctgctttacatttttaaaggtcactctaactgttggatagagatgacttggtactggacaacagcagaggcaaggcaccccattattgcagtcgtcagggtggggttttgggcaagacaggtggccacagaaatgaaggaagtaatggggttcaggatatatttgggaagcagatttttttttttttttgagacagagtcttactctgttgcccaggctggagtgcggtggcacgatctcagctcactgcaaactctgccttccaggttcaggcgattctagtgcctcagcttcctaaggtagctgtgactacaggcgcatgccatcctgcccagctaattttgtatttttagtagagacacgggatttcacctcaagtgatccacccgcctcggcctcccagagtgctgggattacgggcgtgagccaccacgcctggccgggttcaggatatatttgaaaggggagctgccagcacctactgagggactggctgtgaataatggaggatccaggatgactcagaggtttgggtcagggtctgtctgtgccaactctccatgtaattctccaagggaagtcacggtcgagaggactggtggcctccattcttcccgtcaacccatttgtgtcacatcctccacctgagcaacagagtgatttttgctcaaaggcaaatggcttctgcagctgaggctcataggagatggtcatctccaactgtgttccaactagggcgagtcacatgcctgaaatttaccactcacaatcatttcttattaaaaaatgagaaagggtggttctgggtgtggtggctcatgcctgtaatcccagcactttgggaggctgaggcaggaggattgctagagcccaggagtttgagaccagcctgggcaacatagtgagatctctacaaaaaataaaaaaacaaaaaactagctgggtttggtggtgtgtgcctgtagtcttaactactcgggagaccaaggaaggaggatacctttagaccaagagtttgaggctgccatgagctatgattataccactgcactccagcctgtgcagagacccctgtctctttaataaaaaaaaaaaagaagaagaagaaagaaagcaagaaaaaaaaaaaagaaagaaagcaagaaaaagaaaagaaagaaaaggagagatagagagagagaaaggaagtattatgtctgctttttagatgagaacacaaaactttacaagggaaactgcttaagccaagggcatagcaaatgaaaggtagagcaaggactcaaacccaaagcttctgcgtagctgggcaggtagctgagtgtcagactaaagtcagactgaagtgtaagtgagtgggtggatgagttttcagctccttgttcaacaaaggacttgagctgggtgtggtggctcacgcctgtaatcccagcaatttgggaagctgaggtgggtggatcacctgagatcaggagttcaagaccagcctggccaacaccctgtctctactaaaaatacaaaaattagccaagtgtggtggcacgcgcctgtagtcccaggtactcaggaggctgaggcaggagaatcgcttgaacctgggagatggaagttgcagtgagccgagatcatgccactgctctccagctgaggcgacggagtgagactccatctcaaaaaaaaaaggacttgagcctgactgaagccttactgatgtgctccttcaagatgttagaaattgagaaactaataaggagcttccctacctctgcccaaccagaaatctgagtgtgatccttgactcctttcttgtccacctcactccttagctacctagtcccggactacctcctaagtgtctcccaataaagttggaggggtaccaggaacgagaccatgctgggcctggagggtcatgtaaggaatttgttcttcatccaagtatcaatgaagaggctgtgcagagaggtgacatgatcagacatgcatttggagaagatgctctggtggatgtgtgaagaatggattggacatgcaccaaaagggatgcagacaggaagaccaattaggacatggtgtcagcaattcagagggaggaatgataactgcattccagagagaggacacacaacagctgcaaagccaggaaggaaggaaaaggcacaatgcttgggggaattcagatggatctgtggcgaaagcagagtagtggggaaggattggaaaggaagatggggccgtatcctgaggaagcaggctcagacaaggcatctccccagtatggctcagggcctgttttaggtttgtctaacaagatctccagtccccattttcctaagatgggattgttggtatttatcactaggtggacatttcaatgttatctttttttttttttttttttgagatggagcctcgctctgttgcccaggctggagtgcagtggtgcgatctcggctcactgcaacctctgcctcccgggttcacgccattctcctgcctcagcctccggaatagctgggactataggcacccaccaccacgcccagctaatttttggtattcttatttttagtagagacggggtttcaccgtgttagccaggatggtcttgatctcctgacctcgtagtctgcccgcctcggcctcccaaagtcctgggattacaggcgtgagccaacgtgcccagcatcaaaattctcatttgtaatcaacaaaaaccaattctggcagacttaaacatacaaaaaaattattggccatatattcaggtagctgccactgctgaacaatggacaccacagttcacatctccactttctccagcaccaaacccaaccccattgctgcccccagaaactagatatggccactgctgcctctgtcaccatgatggactctttgttggccctacatctttgagtcaaagtcccccatgcatttgattggctgagtctaggttatgtggtcccacccttgcttcaaggatgctgagaaactgtgtagatggcatttgagatttccattctgggaggtgggctttgacttactgtaagactcatgggatagagaattccccaaacatgagaatagagtttagaggctgagcagccaaaaacaattcaagtatccacttcactatgaaatgcaactgggtgagttataggaatagctcagaatgggaggcaacatgaagggatagatgtccttgctgacaggcctttgccaggatgccttagtgttgctagctttctaaaacagggagaaaatgattctgactctgttaatggtggagtattatcctccaccctcctccagataacaatataaatgttggacaaaatataaaaacaaggatttggctgggcatggtggctcaagcttgtaatcccagcacttcaggaggccaaggtgggaggatcgcttgagcccaagagttcaagaccagcctgggcaacatgcgagaccctgtctctggaaaaaaaaaaaattttcttttttttttttttgccaggtacagttgctcaagcctgtaatcctagcactttggaaggcaaggcaggtagatcagctgaggtcaggagttcaagaccagcctggccaacaaggtgaaaccccgtctctactaaaatacaaaaattagccaggcatgatggtgggtgcttgtaatcccagctacttgggaggctgagatgggagaatcgcttgaacccagaagacagtggttgcagtgagccgagatcacaccactgcactccagcctgggtggctgagtgagagtctgtctcaaaaaacaaaaatttttttttaattcaccgggcgtggtagcgtgcacctgtagtcccagctacttgggaggctgaggcaagaggatggcttgagcccaggagtttgaggctgcagtgagctgagattgcgccactgcactccagcctgagtgacagagtaaaacgctgtatttgaattaaaaaacaaaaacaaggatttgaaagcactgcagagcaaacaaaaacagtctgaaattggaggagattcacccttgttagatgggaaccacactggggaaatctcgttttctatactttcctcctgaaggcgctacccaatctgggcagtgcatggaagctaggactcaggaagaaatctctaggacgcaggaagctgcttgagatattaaagggtggaattaggggctgctaaaatggctagaaattgaaggagaaatcctggaaagaagaggggcacaaagggggtaagcccccaaataagtatttgacagaaaaagtatttgaatttcataaatttgatgaaaaacctcattagaaatccaaaaagtttagcaaaatccaagtatgataaatacgaagaaaacaatacctaaacacatcataatcaaactgttaaaaacaaaaaagaaagaaaaagtctttttttttttttgaaacagagttttgctgttgttgcccaggctggagtgcaaaggcgtgatctcaggtcaccacaacctccacttcccaggttcaagcaattctcctgcctcagcttcccgagtagctgggattacaggcatgcgccaccacgcccggctaattttgtatttttagtagggacggggtttctccatgttggtcaggctggtctcgaactcctgacctcaggtgatctgcccacctcggcctcccaaagtgctgggattacaggcgtgagccaccatgcccagcaagaaagagaaagtcttgacagtagccatagaaaaagacataatagcaaacagattacgtacagagaaacaatacaaatgaatcctgacttctcatcagaaaccatggagccagaaaacaatggaatatcatctttaaaatgctgaaaagtaaacaaaaacctgtcagtccagtgaaataaagatcttttcagataaatgaaagcatagggcattaattgccagcagacctgcagaataagaaatgttgctgggcacggtggctcactcgcagtcatctcagcaatttgggaagccaatgaaggagaatcgcttgagtccaaaatgtagcacaatgcccggctaattttgtatgtgtgtggagacaggggtctcattatgttgcccaggctggtctcaaactcctgggctcaagtgatcctcctgcctcagcctcccaaagcgctgggattacaggcatgagtcaccatgcctgccccccagaagttagatctttagaagggtatgaaagaatactagaaacagtgagtatatggacaaatacatgaacaaatttttttctctgcttttaattgactggtgaacatcaaaataatattttattgtggagtttttaatgcatgtagaagtgaaatgtgtggcaacaatagcataaaagacagataaattgaattatattgttgtaaggttcatatttttttttttttttttttttttagacagaatctccctctgtcacccaggctggagtgtgcaagggcgccatctcagctcacttcaatctccacctcctggattccagcaattctcctgccacagcctcccaagtagctgggattacaggcacctgccatcatgcccagctaatttttgtatttttgtagagacagggtttcaccatgttgtccaggctggtcttcttttttttttgagacagagtcttgctctgtcgcccaggctggagtgcagtggcgtgatctcagctcactgcaaactccgcctcccaggttcaagcgattctcccacctcagcctccccagtagctgggactacaggagtgtatcaccacacctagctactttttgtatttttagtagagatggggtttcaccatgttgaccaggctggtcttgaactcttgacctcaggtgatccacaggcctcggcctcccaaagtgctgggattacaggcgtgagccaccgcacccagcctatatcttttattctgaataaactgtgataggttatggaggtatattgtaatccctagaggaaccacttaaaaatacaggaagtaggtatatttaaatgaagtactaaaaatacttgattaacctgaaagaggacagaaaggaaaaagagaacaaaaaacagatgggacaaaaaagaaacacagcaaaatggtagatctaaatcttaccatataaaaactgcattaaggggcggggtgcggtggctcacgcctgttgtcccagcactttgggaggccaaggcaggtggatcacctgaggtcgggagttcgtgacccacctgaccaacatggagaaaccctgtctctactaaaaatacaaaattagccgggtgtggtggcacatgcctgtcatcccagctacttgggaggctgaggctggagaactgcttgaacctgggaggtggaggtcacggagagccaagatcgcgccattacactccagcctgggcaacaagagtgaaactctgtctcaaaaaaaaaaaaaaactgcagtaagtatatatggactaaacattctaattaaaagaataacaaagcaaggctcaatttatactgccttcaaaacatgtactttaggcagggcgcagtggctcacacctgtaatcccagcactttgggaggccgagttgaggtcaggagtttgagaccagcctggccaacatggtgaaaccctgtctctcctaaaaatacaaaaattagccaggcgtggtagcacatgcctgtaatcccagctactcgggaagctgaagcaggataatcacttgaacccaggaggtggaagttgcagtaagccaagatcgcgccactgcaccccagcctgggcaatgagtgagactccatattttttaaaaatttaattaattaaattaaatatatatatgaaataaaaggcacaaatattgagaagaaaaaagtagagctgtctatatgtgcagattacatgaatatttacatataaaatattaaggaatgtataaaactgctagaattaataaacaatatatgaaaatctattgtgtttctaaaaataaaaaagaaattgagatttaaatttctatttataatagcatcaaaaaacacaaagtacttaagaataaatttggctgggcacagtggctcacacctgtaatcccagcactttgggaggccaaggccaaggcagatggatcacctgaggtcaggagttcaagaccagcctggccaacatagtgaaaccctgtctctactaaaaaaaatacaaaaattagccaggtgtggtggcgcacatctgtagtcccagctactcgggtggctgagtcaggagaatcccttgaacccgggaggcagaggttgcagtgagccgagatccaacactgcactctagcctgggcaagagagtgagatgctgtatcagaaaaataaaaaataaaaaaaataaaaaataaatttaactaaagacatgtaagacctctatctttacactgaaaatcataaaacgttgttgaaagtaatcaaagagctaaacaaattaagaaacataacaaattcatggtttgtaagacacaatattaagctgttattttcccaaaattgttctataaatccaatacgataagctttgttgtagacatttatatggaaatagcaaaagcaatcttggtggtgagggggagacaaagttggaggacacatactacctgattttaaaatttattctcaagctaccattatgaagactgaatggggctgggcacagtggctcacacctataatctcagctctttgggaggctgagacaagcagatcacttgagaccaggagttcgagaccagcctggccaacatgatgtaatcctatctctactaaaaatacaaaaattagctgggcgtggtagcacatgcctataatcccagctacttgggaggctgaagtatgagaatcgtttgaacccaggagttggaagttgcagtgagccgagactgcactactgcactccagcctgggtgacagagcaagacgcacacacacacacacacacacacacacacacacacacacacacacacacaaaagactgaatagtactagtctaaggatagacaaataggttaatgggatggaaatagccccataagaatatggtcaactgtcagcatccccttttggattgtaagctttgtatctgtgtctgtatttgcctggtttctaactgcacccccagagcctagaacagagctgattacttcgtgtgtgtattgtaactgaataatcagagcctagtatagtaagtgctcaataaatatttattgaataaatgtattttaagaaatggggtggacataacaatctggtcctctcccagggccaagctatatgcttttttaaaaaaattatttacgtatttatttatttatttttgagactgagtctcactgtgtccctaggctgatgtgcaatggtgtgatcttggctcattgcaacctctgcctcccaggttcaagcaattctcctgcctcagtctcccaagtagctgggattgcaggtgcctgccaccacacccagctaatttttgtatttttcgtagagacaggggtttcaccatgttgatcaggctggtctcaactcctgacctcaggtgatccacccactttggcctccaaagtgctgggattacacgcatgagccactgtgcccagcccaaactgtatgcttttagacatgctaattctggaggatgagagatcaccctaccttactctattcccacttctcctagttccctttgctggagtcctctctttcctttcttttaaccatccagaaaatcagcactactggctccctgatctgcactgtccccaaccccccgactactgtggaccctccaaaattcagaaagcagatcatgctaggggctctagaggttctcctccagcagaaccaagatggaggaagaatgagaggctgggctggaattgcccccttggaagggtgaccaactgcacaggtttcccagatgcgggggtttcctgggacatagggctatgagtttttaaactaggacagtcctgaggaaaccagggattacacccacctcctgggaatcctccagcttccttcatcagaaagggatggactatacctctcccatggtggggactgccaaccctagggtcagcagtctttttgtaatgatggtttaaatatccagagcaaagatggctccatattctcacccccaaaacagggtctgaagcttaggaagcgctagataattgttggatgatgagcgtgcttaggagcaggagaaagggccctgccctctgggaccccctgaatccaaggtgggctgttttctacagctccaacccctccttcctgcacactttgcacctctcccaagcagggaaacggctttcttgccccatccagccccatcatatccctgcccactctgcacgttctatcaagcaccagcatgtttctgcagtcaacatttatgtacattttaattatttttataaaagcattactttttaaaaaagtttcaatatagaatgttagtaagggaaaagtcaaagccccaccccacctcatcccacgctgccctatacccctctctttttttttttgagatggagtctagctctgttgcccaggctggagtgcagtggcgtgatctcagctcactgcaagctccacctcccaggttcacgccattctcctacctcagcctcccaagtagctgagactataggcacccaacaccatgcccatgcccagataattttttgtatttttagtagagacagggtttcactttgttagccaggatggtctcaatctcctgaccttgtgattagcctgccttggcctcccaaagtgttgggattacaggcgtgagccactgcgcccagcccttaacccctctcttaaaaaaactttatttttaccttttctgcttttagctatggtagtttgtaccacaaatctgattgatatgcatatacctcaatttcttgatttatccacttgaattaacatttattgactcttctcatgaaaaaggacatttgctcatttactttaatgctcatctcccaatcctttctacgttgtgttgtagtgttagtttagtcttccattgattgataattgcttaaaacctttatttccattcctatgcactttagatagtatctgtcattttttttcttttttttgttttttataatagagatgggggctcaacatattgcccaggctggtctcgaactcctgggctcaactgatcctcctgccttgacctcccaaagtgctgggattaaggcttgagccagcgtgcctggccaagatagcatctcttgatttatactatgtaaaatgaaaaagttagcatctgtgcagtgtttgatctctcctcttctcctccagccttctgacactgatagttatactgttacattgctaagagttataatatttaaatttattctgtaactataatgaagtcttccatgctttatctagagagtaattctgctcatttaaatccaataaatagtattttcaatattacaattagaaacaaattctaatttgagactatattagattcataaaacaagaaagaactgctaataaagggatcaattagacaacatgaaagagtcctgggaaataaaaaacatgattgcccagataaaaaatataattaaaaagtctagaagtggcagggcacggtgggtcacgcctgtaatcccagcactttgggaggccgaggcaggtggatcacgaggtcaggagatcaagaccatcctggctacatggtgaaaccccgtctttactaaaaaatacaaaaaattagcagggcatggtggtgggcgcctgtagtcccagctacttgggaggctgaggcaggagaatggcacgaacccaggaggcagagcttgcagtgagccaagatcgcaccactgcactccagcctgggcaacagagtgagactccgtctcaaaaaaaaaaaaaaaaaaaaaaaaattctagaagctagtgccagaaaataaggaagcactgaaaaaaaaaaaaaaaaaaaaggaacctgaaagagctctcaatagccaaaaccggaacagtatgagcaacaaaataaataaggtcatattggattataacccaaagtataaaataaataaacatgagtccatagtggtctaaataaatggttgaataaataaatacatggcaggaaaggacagatcttccttacaggggaataccaaataatatatagatatactctcccctccagatggagttgaattagccctcttgccttgaatgtgtgctggacttagtgactcacttccaaagaacagagtatggatagggaaaaaaatagtaactttaaagtggagaaatctggcaaacacttgaagtgatcagggttacgtcaccagctgatatcatgtgatgagccagacactccactgttgtgatattctcccccaaaatacctaactccagcctaatcataagaaaaattccaaattgaggaacattctgcggaatacctgaccagccctcttaaaactgtgaaaatgattttaaaaacaaggaaagactgagaaattgtcacagaggagaccaaggagacatgaggactaaatacggtgggaaatactggagtgggtcctggaacagaaaaggacattagtaggaaaactagtgaaaatctggagtttcattaatagtaatatatgaatgttaacttcttagttttgatggaccacagttatgtaatgccacggaccctggtggactgaacaaaggagggcaaacatgggaataaaaacaaagacaaggccaggcgtggtggttcacgcctgtaatcccagcactttgggaggtcgaggcaggcagatcacgaggtcaggagatcgagaccatcctggctaacacggtgaaaccctatctctactaaaactacaaaaaattagccaggcgtggtggtgggcacctgtagtcccagctacttgacaggctgaggcaggagaatggcgtaaacccatgaggcggagcttgcagtgagccaagatcgctccaccgcactccagcctgggcaacagagcgagactccctctcaaaaaaaaaaaaaaaaaaaaaaaaaatcaaaggcaaaagagtatatttggaagaaggggttagggggctccttgcttctagtgaacaagggccctgagcttctagagccctttgtatttactaagtaaaggagataaggagaagggggtggttgtcggtcagctgcttgacttagtacatggcctgcatgactacattctttgaagactaggctccagatgtccccatagataacctcaaggagcacggcaccagggagtgactgccctcagcataccttctggtagcaggtgcaggtgcgagtttgcccacattctgtattcatgataaacagtttgctgtttgatcatatagcctccagtggaatgctgagttggtcacaacgctcaggctttcggctcccatcaatgtaagatgctcacattagaagaaagtgggtgaagggtatatgggaactttgtatattatctttgcaacttttctaaaaccctttttttttttttgagatggagtcttgctctgtcacccaggctggagggcagtggcgcaatctcggctcactgcagcctctgcctcccgagtagctgggacaacaggcgcctgacaccactcccagctaatttttgtatttttagtagagatggggtttcaccatattgacctggctagtcttgaactcctaacctcaagtgatccacccactttggcctcccaaagtgctgggattacaagcatgagccactgcacccagcatcctacaaatctaaaattactccaaaataaaaaatttatgtgaaaaagtggctgggtacagtagctcatgcctgtaatcccagcactttggaaggctgagacagacggatcacctgaggtcaggagtttgagacctgggccaacatggagaaccccatctctccactaaaaatacaaaaactagctgggtgtggtggcgcatgcctgtaatcccagctactcagaaggctgaggcaggagagaattggttgaacctgaggggggcgtggagggggcaggttgtagtgagccaagatcacaccactgcactccagcctggggcagcagaacgaggctctgactcaaaaaaaaaaaaaattcatatagttctccaaaaatatagagacaaaaaataattctttattttacctttttttttttttttttttttttaagacaaggtctcactctgttgcccaggctggaaggcagtggcacaatcatggcagccttgacacctaggctcatatgatccttccacctcaacctcccaagtagttgggactacaggtgcatgccaccatacctggctaattttttaccttttatagagacagggtctcactatgttgtccaggctggtcttgaactcctgggctcaagtaatccccctgcctcagcctcccaaagtgctggaattacaagtgtgagccaccatgcccagacacaatatttttaaataggtagaaaaaaatcaagtcataaagcatcaattcaggaggtctgatatctgtttaatgagaattccagagagaaaaaagagccagagccgggcgcagtggctcacgcctgtaatcccagcactttgggaggctgaggcgggcggatcacgaggtcaggagatggaggccatcctggctaacacggtgaaatcccgtctctactaaaaatacaaaaaaattagccgggcgtggtggcaggtgcctgtagtcccagctactcgggaagctgaggcaggagaatggtgtgaacctgggaggcagtttgcagtgagccgagatcccgccactgcactccagactgggcgagagcgagactccgtctcaaaaaaaaaaaaaaaaaaaaaaaagagccaggcatggtggcttatccctgtaatcccagcactttgggaggccgaggcaggtggatcacgaggtcaggaattcaagaccagcctgaccaacgtggtgaaaccctgtctctactaaaaatacaacaattagctgggcgtggtggcacatgcttgtaatcccagctactcgggaggctgaggcaggagaatcgctttaacccaggaggcaggggttgcagtgagccgagatcatgccattgcactccagtgacagagcaagactctgtttcaaaaaaaaaaaaaaagaaagaaagaaaaataatcagagaaatactagaagaaaatttcccagagcagtaacaacaaaaaaacgagtctttacattaaaagtgtccgttgaatgctgagcagaatcctagggattcatgaggtttcagaaagtccaagaccttctggaaatcagaaacaaacaaacattatctgcaagggaatgaagatcaaatgagcactgggcttctctgaagctagaagctataaaacaatggtctgtatagttctaaggggaaatggttttgaacagttaagccacaaaacaagcttaggggcaaaattctgagaagcaataaaatttacctcccacacattcttttcttttcttatcttttttttttttttttttttgagacttgccctgtcgcccaggctagagtgcagtgacaccatcacagttcgctgcagccttgacctcctgggctcaactgatcctcccacctcagcctcccaagtagctgggactacaggtgtacaccaccacacttggctaatatttgtattttttgtagagatggggtttctccatgttgcccaggctggtctcgaactcctgaggctcaagtgatcttcccatcccagcctcccaaagtgttgggattataggcgtgagccaccacacttggccagtcacgtgcttttgctgaaaaaattacttgagattgtaatccagaaaaaacaaaaaatcagatataatgtagtgctgtcattctcaagatatagttccagaagcagcatctgggaacatgttaaaaatgcaaatgtagggcccatcccaacctgttgagtcagaaactctggggtttgagggcagcagtctgtgtctttaccacccttccaagtgatgtggtgcatgcttaaatttgcagaccccagagttgtggatgatgccatcagtccactcaaatccccttcaccaggctgctgcacccattcccagctgctgtgagttgctgtacaaaatgccccctgtctcaaggtggcaccaggctgagactggtctccagccaagaacacttcgtagcttagctttcttcccccgccctaccctgcttccctccttcctcttctcctgagatcacttcctcagttggtcactgtcaccaaaatccctgtcccagcctctgcttcctaggaggccggacctaagtcacatagtaaccaagaaaccacagaactaacttacatgcacattgaaaaagaagtcccacaatggtaactgccaggaagtatttgatttaaattagaacatggaaacagaagactgcgataacaatgtcttttaaacgtttttgttttttttttttcaaggcagagtttcactcttgttgcccaggctggagtgcaatggcacgatctcagctcacagcaacctccacctcccgggttcaagccattctcctgcctcagcctccagagtagacgggattacaggcatgcactaccacacccagctaattttgtatttttagtagagatggggtttctccatgttggccaggctggtctcaaactccggacctcaggtgatccgcccgcctcagcctcccaaagtgctgggattacagtcgtgagccaccgcgccgggcgggtctttaaaatgtttttaagaaaaaagggaatttcagtccatagacagtacaattaagaagctagaagctcttagtcatatggtaaagaaagcacacagttcttctctcaaaaaggaataggaaaagtgtcaagaaactccagaaaaaacacaaaactataccagaaaattgtgattcaaatatgaaactgtggcatgattttaagcaattgatgatatgtaaggaaagagaagaacttgatctgaacatttggaatatttctttttttattgaccttattttattttactttgagaaaaatttcaacatatgccgaagtagaaaaaaattgcaaaatgaacttcatgtacccatcatcactcaacttcaatggttatcaagatcaggtcaatctcaaatatctagtcaattttcaaatttctctaaatatctcattttttttctttttacagttggtatgtttaaatctggacccaaagtatatttattgcatttagtttatatgtctctcttaaatctctcccaggctacagtggaacgctcccatttggacagcctcagtttagggacctggaattacatttccttctttactgatccaaacagtatccaaaatctacagtgactgttctgttcctgcttgaaggtcaaatcccttgtctttttttttttttttttttttttgagacggagtctcgctctgtcgcccaggccggagtgcagtggcacaatctcagcacactccaagttctgcctcccaggttcacgccattcttctgcctcagcctcccgagtagctgggactacaggcacccgccaccacgcccggctaattttttgtatttttagtagagacggggtttcaccatgttagccaggatggtctcgatctcctgccctcgtgatccgcccgcctcggcctcccaaagtgctgggattacaggcatgagccaccatgcctggccaaatcccttgtcttaatcactactgcctcttgaaataaccatttggattgccttcaagttcagcctgcttcaacctctctcaaatcttcaggttttttagaatcaaaagattatctacagtttctttaggtcttaaaggactttttcttgggggtccagtcaatatagaaatttgggatcccctgttcctgcataaatactgaagcaggtgtccggggtctagaaatcttctgtatttttctgtttaccaaacttcgttaagagctcccctggttacacaggctatggatacttgagtgccagatgggattaaagatagccaaacaatgctctaatttatctctgaacctctcagaaagttcaggaagtttaggttaggagccaaaaggtgtttagagctgcagccacaaaagatcctcagaaacaatcttcagccggggagcccaggttttgttgtaaagagcccttgaccatgaacataaatgaggcggctggctttgggcatagactgcctcatggaagctctgcctcctgcccagccctgagtcctggggtctggactttaccccttccttctctttattggggtggttggttatgaggggtgaggagcaggaggggcagatggggctggaagcaacgtgaagggagctttagtctcagctgcccaagacctcccagctagtaagttgtcaggccaggatttgaacccagactggtctggtttcagattttaaccccttctcctgcctcctcactcccgtggaaactggaagaccaggagggaaaagccctaatgctgacttagatattcactcactcaaggactgagaggaacgcctagaatcagaacggccaagttccttgcagttaaacagttgactcagacaaatatcaacagacacacccagatagatgaaagcaaaagtcaacaaaccagctaacaaaaacagtccttttgacagatgaggaaaaatcaaataattactcaggtcaacctcttcactcttgttatagatgcttggggaacttaaaccttaactagctaattttttgttgggggaggaaaggcgggtagacatttggaatgttccagacactgtgctgaaaactgggacagcaagatgagaagatacagtccctgccctcaagaaaactgttcctggatgctttattcctgtgagtgatgagctcccttgacagcagggacaatttttcatcctgtctccatcctcattgcctgcatggggccagtctggcacaaaattaccactcactccgtgaatgaatttcacttttgaaaattatcccattttctctgacacctgataattcttcaagtgtttggtgattttgtaaattgttagacaagagaaaactgggccaggcacagtggcacacacctgtaatcccagcacattggaaggccaaggcaggtggattacctgaggtcaggagttcgggaccagcctggccaacatggtgaaaccccgtctctactaaaaaatacaaaaattagccgggcatgctggcagtcgcctgtaattccagctactcaggaggctgaggcaggagaattgcttgaacccgggaagcagatgttgcagtgagctgagatcatgccactgcactccaatctgggtgataagagcaaaactccaccaaaaaaaataaataaataaaaagaagaaactgtagtcaaggaagggaatttagaagtgaaatgatgcatgctgcttggtatacatactttttctttctttctttttttttaagacaacgtcttgctatgttgcccaggctggtctcaaactcctgggatcatgtgatcctcctgcctcggccttccaaagtcctgagattacaggtatcagccaccatgccagccgagacataccttttttttttttttgagatggagtctggctctgtcacccaggctggagtgcagtggcgcaatctcgacttactgcaggctccgcctcccaggttcaaccaattctcctgcctcaacctcctgagtagctgggactacgggtgcacaccaccacgcctggccaatttttgtaattttagtagagatggggtctcaccatgttagccaggctggcctcgaactcctgacctcaggtgatccacccgcctcagcctcccaaagtggtgggattacaggtgtgaaccaccacaactggccaagacatacttttttaatgccttcctgagtaaagtaagggaagcagagggagaaaacagccaggccttagaatggcaccctgtatctgatgaagaaaaagcgctgtgacttctggaacaggagatgggaccatctcttgctttcaaaggtctctaaggatccacagccctgtggctgtgaaggagacagagtttgaaatggttgtcagaagtaaatcttcagacttccaggagtggggccattcattcattcaacatgggtttgtttatttatttatttattattttttgagacaaagtctcgctcttgtcccccagtctggagtgcaatggcgccatctcagctcactgcaacctccgcctcctgggttcaagtgattctcctgcctcagcgtcccgagtagctgggattacaggcacctgccaccatgcccggctaatttttgtatttttagtagagacagggtctcaccatgttggccaggctggtctcaaactcctgacctagggtgacccgcaggccttggcctcccaaagtgctgggattacaggcatgagctacagtgcctgacgttaacatgtatttattgagtacctactctgtgccatgtctttgtttgaaggactggagatacaacaatgagtacgagtttaagaatccctgccctcctatggaacttacattctattcagggagcaggaaaaaattaatacatacaattataaatgcacttattccttgacccagcaacctcatttctgaggctttagcctagagctttatcggcaccgtaaaaaatgatacaggcacaaggttattcattgcggtactgtttgaaatagcaaaagactgagcacagctttcaattttgaaccacaaaacatattatacattcaaatcaaaaggaacgtttagaaaattgtagtataggttttgttggatggcgataaatgtattatggagaaaaattaagtagggaaggagattcggtaatgatgagaggggacattgctatttgaaaatgattgttagggaaggcctagtggagaaggcccgcatgtgagtaaatatctgaaggagataaggatatactgggacatccttcaggcagagggaacagcaagggccaaggccctgaggcctttcaatggctgaagaacagcaaggaggctagagtgagctggagtggcctagtggtggggagagggtgtcccagcattgtcctccagccgctggggcctgaaggcttgcagctgggagactcatggccctaagggaccaccaccatctccagctcccctgcccacctcctagtactgcttgcagtgatggcttcctcctggaaattctcttctccgttggccacctgacgacaatcctgaggtctccctctgggtacttcttctttttttcctttttttttttgagatagggtctcgctttgttacccaggctggagcacagtagcacaaacactgctcactgcagtctcaaacttctgggctcaagcgatcctctcgcctcagccccacaaggagctgggactacaggtgcgcaagtcaccactcccagctaatttttgtattttgtaaagacggggtttcgccatgtcgcaccaggctagtctcctgggctcaagtaatcctccaagctcagcctcccaaagtgctgggactacaggcgtgcatcaccctgcccctctggcggcctcttctaagtctccctcactgccccgaagccccaagcctcccggttctgtccttgtcctcctctctcttgccggctgttaccattccaccctcctccagggcttctgcccagagtccgctcccaagcccagaccccacagttctcctggcctctggacatctgcctcggatgtctcaagcatattggactccacgtatgcccagacctgaccaaagcactcgctgatcacccctctgccccgcagaccagaaaggttcatcctctggattcccaccgtgcatgcctcccctcacagacagtgctgatggttcccccttcctgcctcctccatctgccctgagcaggacctggcttggtctgtttgtttgctgaggcctccccagcacccagcgcagtgcctggtacacagtgagtcctcaataaacaaactgaacaggccaggcacggtggctcatgcctgtaatctcagcactttgggagagaggcaggtggatcacctgagatcaggagatcgagaccagcctgaccaacatggagaaaccccatctctactaaaaatacaaataaatttagctgggcgtggtgtcgcatgcctgtaatcccagctattcagaaggctgaggcaggagaatcgcttgaacctgggaggcagaggttgcagtgagccaagattgcgccattgcactccagcctgggcaataagagtgaaactacgtctcaaaaaacaaaaaagaaaaagaaaaactgaacaaataactgcacagcttcagtcactgcctccagcttctgaatctgctcccctctgctagacccgggggcccgccctccagggtccctaagctctggttggggacagccccacggtccagcctcacagctctcccacactcagaaccgtgcttcttgcaggagattccgatttcaggaggccaccggccccttgcatctgccccctggaggctcagtgtcgctcttttggtttcagtgatttctgcctgcaggggacagagtgtgactaggtcatggacacccttgggaagaacattttgaataggaggaaagagaagcagaaccaggcattggagggccccgcctgtcgggccctaaagacccatggtgatgcctctcagtgcagcatcctgatgtgtttgtgtcccacgatgagactgtaagccctagagagcgaggatggcctcagcttctcctctatgactggtgtcctatggcaattgttctcaacacagggcagtcctccaccctcacccctaagattgccagaaaaatgcaggccaccaggtgaaatcttagaatcagataaataagtactttttcagtataagtatgttctctactcaatatgtcatttggggcatccttatactgaaaagttatttgtaggaacattcattctgttttatagaatgaggtgttgtccaattctagaaaaaaaatttgttatatgtatgaaatacaaattcaaatttaactgggtggtttgaacttttattagctaagtctggcaaccctatccctgggtgacatttggcaatgtgtggagacacttttggttgtcaaactgtaggggggtgcggggtgctactggcatttagtgagagaggggaaggatgctactaaacatcctgtagggcataggatacccccgccacaacaaagaattctccagaccaaagtatcaatgggtactagagcacccagaactctcctcctcatacccttgacgcacctgccttcctacccccaagccattgtggcaagagactcttaaacttaccacagatgttggctgggcatggtggctcatgcctgtaatcccagcactttgggaggctgaggcgggaggatcacttgaggtcaggagttcgagacaagcctggccaaaataataaaaccccatctctactaaaaaataccaaaaaaaattagctgggcatggtgaggcgtcctttctggaccagctcctacagcctggtccccgtgcccatgcagaggtagctgctgctgctgagctgatgttgagcatggcagggacagagttctatcttctgcttggaactgacactggaaaatgggatcctgtggtcatgggggcagtgtattctactagattctgctaagttgctttaaaattagctgtatcggctgggcacggtggctcacacctgtaatcccagcactttgggaggctgaggccagcggaccatgaggtcaggagttcgagaccagcctggccaatatggtgaaaccccatctctactaaaaatacaaaaattagccgggtgtggtggcgagcgcctatagtcccagctacttgggaggctaaggcagaagatcgcttgaattcaggaggtggaggttgcagtaagcctagatcacaccactgcactccagcctgggtgacagagcaagacgctgtctcaaaaaaaaaaaaaaaaaaattagctataccattatactctaccaccagcaaggtatggcaggactgacaccaggctttcaaatgctggcaatctgacaggcgaaaagtagcatcttattgttttaatttgcatttcccttacaatggtagagatcgaatatctttggatgttcatttttatttttattttattttatttatttttggtgagacagagatttactcttgttgcccaggctgaaatgcaatggcgcgatctcggcttactgcatccctggcctcccaggttcaagcgattctcctgccgcagcctcccaagtagctgggattacaggcatgtgccaccacgcccggctaattttgtattttcagtagagatggggtttcaccatgttgcccaggctgattttgaactcctgacctcaggtgatctgcccgcctcggactcccaaagtgctgggattataggcgtgagccactgtgcccggccttatttttttttttaatttttttagtatttattgatcattcttgggatttggcagggtcataggacaatagtggagggaaggtcagcagataaacatgtgaacaaaggtctctggttttcctaggcagagggccctgccgccttccacagtgtttgtgtccctgggtacttgagattagggagtggtgatgattcttaacgagcatgctgccttcaagcatctgtttaacaaagcacatcttgcaccgcccttaatccatttaaccttgagtggacacagcacatgtttcagagagcacggggttgggggtaaggttatagattaacagcatcccaaggcagaagaatttttcttagtacagaacaaaatggagtctcctatgtctacttctttctacacagacacagtaacaatctgatctctctttcttttccccacatttcccccttttctattcgacaaaaccgccagcgtcatcatggcccgttctcaatgagctgttgggtacacctcccagatggggtggcggccgggcagaagggctcctcacttcccggacggggcaactgggcagaggcgccccccacctcccagacggggcggcagccaggcggggactgccccccacctcccggacggggcattttttattttttatgtttttaaaatttattaactcatatacctgcacatcatacaacagtcaaaaatcatcagtgagccaggaacggtggttcacgcctgtaatgtcagcactttgggaggccgaggcaggaggattgcttgagctcaggagttcaagaccagcctgggcaacataataagatctcatctttactttaaaattttttttaattagccagatgtggtggcacatgcttgtagtccagctacttgggaggctgaggtgggaggatcacttgagcccaggaggtcaaggctgcagtgatctgtgattgcaccagtgcactctagcctgagcaacagagccagaccctgtctcaaaaaaaaaaaaaaaaaaaaagagtcagtaaaaagtaaatctcctttccatagatctgaagccagctcccattgaaagaccgtgtctgaaagaagtttctggtgtttccttccagagatattcaatgcatatataagcacttggatgtacaggctttccttttggtttttaaacaaattgtcaaccaggcatggtggctcatgcctgtaatcccagcattttgggaggccgaggtgggcggaccacttgaggtcaggagttcaagaccagcctggccaacatgttgaaaccccatctctgctaaaaatgcaaaaattagccaggcatggtggtgggcgcctgtaatcccagctactcaggaagctgaggcatgagaatcacttgaacccgggaggtggaagttgcagtgagccgagatcatgccactgcattccagcccaggcaacagaacaagactccaagactccgtctcaaaaaataaactaaactaaacaaattgtaacattttccacagtgttctgcacttttctttctttcttttttttttttttttatgagacagggtcttaccctgtcatccagactggaatgcagtgatcttgcctcactgcagccacaacctcctgggttcaagcaatcctcctgcctcagccccccaagtagctggaactataggcatgcaccaccacacctggctagttatttttttttctattttctgtagagatgggtttttgccacattgcccaggctggtcttgaactcctgggctcatatgatcctcccgaaagtgctagggttacaggcatgagccactgcacctggaatttttttaaatcctggaaaatggcttatcccaatacacatagaggtatctcattattgtacatgattcatagtatcccatctgatggacacagtacaattttgaacagttccctagcgttggacattttggtggcttccaatattttgctatagtgaatatttttgtgcatatacaatatctcacctataggaatgtatttgcaggataatttcctggaagcactagaagcgcaactgctgggtcaaagggcaagtgtatttaaaatgttcaaggttattaccaagttgcctttcacatcaattcactgtttatgtcattttatgatcatacagaagctttttttaaattcagagaaaaatataacacagtcattgtctttgataataagaaaccagcatttatgaagcatctactgtgtatcaggaactttacacatattgccaaaaacactcaggacccctctgaggcacaatgaattaagtattttgttcgaggcacccacaaaggaggtggcagaaccagaaaccaagccacggtctgtcaggatcctcagcttgggcctgggcttgctccttgtcatcatgcagaagctgacaccctggtatgaggaactggattccagcataactcacagtgatgtcacatgacaggtgtctgcatggaggcctgaaccaagagctggaacacagacccagagaacagggcaggtcgggtggcggtggggtagctgaaggggcttcacagaggcaagagccttgaaggtgaggcctaagggttggagggaacagattttgctggtgaaaagtagacaaggctgctcaggggaaagggatccacaaagacatagaggcctgaaaatcaactggggaaagaagagctagtgtgcacagagcagaggttggtctggggctgaggctggaaaggtggggtgcaggcagcgggtgaagaaccccttgcaggctgctctatggagcttgggccttccagcgggaggctgctcatctgggaggctggacagggcacatggcatggggtggagctcagactctggagctaatcttacctccaccccttcctggctctgtgcgctgtctcctcctctgtgaaacagagaatctaattcataacattgtgggaattaaatgtgctaagacaagtttaaaaaataaaaaacactggctgggcatggtggctcacgcttgtaatcccagcactttgggaggccgagatgggcaggacgggtgcatcacgaggtcaggagatgaagaccattctggctaacacggtgaaaccccgtctctactaaaaatacccaaaaaattagccaggcgtggtggcaggcacctgtagtcccagttactcaggaggctgaggcaggagaatggcgtgaacccgggaggcagagcttgcagtaagccgagattgcgccactgcactccagcctgggcaacagagcgagatttcgtctcaaaataagtaaataaataaataacacctgacacttcacaagcactcaagaagtggtagccatttattagccaacaattgaattgttttaaaaagttgtttttttaaatggataacctcttttttttaggttgttaaaaaaaatcttagttggcagagcattggttccatttggcaggagatgacaggaggtgatatcataacggcccagtccaagcaccactgacaagggttttgatcagagcgatgtcaggtccatctctgggcagcacagctgccgagacagctctcagtagtttatatgtgttgccaaacaataattgtcctaaagtgttgaaatgctgttacgcaaatgcagattttagaaagttagcatttatttagctcttactattataattaaagtatctaatcctcacaccaaccttattggagaagtactcttattatccccattttacagatgacaaaactgagatccaaagagagctttaggccatcttcccaaggccacacaactagggtccacaccaggctttgtgagtccagagcttgttctcatctctttttttgttttttggtttttggtttttattagagacaaagtctcaccctgtttcccaggctggagtgcagtggcatgatcttggctcactgcaacctccgcctcctgggttcaagtgattctcctgcctcagcctcccaagcagctgggattacaggcgtgcaccaccatgcctggctaatttttgtatttttagtaaagatggggtttcaccatgatggccaagctggtcttgaacccctgacctcaagtgaccctcccacctcggcctcccagagtgctgggattacaggcgtgagcacccatgcccagtgctctcacctctttttggatctgcctttccagtgggaaactgaatcaagaatccagttggtggtggtggtggtgttgccttcccaacactgtggtctttgaagttgagttgtctaaactctccaacctcctgaatcctgaatagctctgttctcagaccagaggggagcagagagacaggggtagccacacaagtttcctaatctggggcatgacaagctaagctgcatttgttattttattatatattttaatttttttgagacaggatcttgctctgttgcccaggttggagtgcagtggtgtgatcatagctcactgtaacctcaaactcctgggctcaagtgatttctctgcctcagcctccccagtaggtgggatcacaggtgctatatatatatatacacacatatatatgtatatatgtgtatatgtgtatatctatacatgtacgtatatgtgtatatctatacacgtacgtatatgtgtatatctatacatgtacgtatatgtgtatatctatactatatatgtgtatatgtgtgtatatatatatttttaaatataatttagagacaaggtgtcactatgttgcccaggcctgtctcaaaagatcccccccacctcagcctgtcaaaatgttaggatttacaggcatgagccaccaccccaggcccatgcctggctaattttaaaattgttttgtagagacaggggtctcactatgttgcataggctggtctcaaactgctaggttcaagtgatactcccacctcagcctctagagtagctgagactacagacaggagccactatgcccggctgaagttgtgttttagaaaacagctctgatgtagcaaggcggaggcctgaggggtgaagagagagacagcaagcgtccaggaagtgtgtgggggaggtgtgggctggcagggctgtgggcagggccaggagaaaccctgagcctagccatctcccagggatgctctgaaatcctcctaagcccttgtcctgcagcaggtacttacctgactaaaattatcaatagccacaagtggctactgagcccttgaaatgtgagtagtccaaattgagaagggcaagaaacaaaaaacatcagatttcaaagacttagtatcaaaaaaagaatgtaaggtgtctgaatgatttttagattaatggcatgttgaaatgagaacatttttggatatatggggttagattgaaatattattacaattcaagtcacctgttccattctttttttttgagacagagttttgctcttgttgcccaggctggagtgccatgcgccatctccgctcactgcaacctccgcctcccgggttcaagcgattctcctgcctcagcctcccgagcagctgagattacaggtgtccaccaccatgcccgtctaattcttgtatttttagcagagaaggggtttcaccatgttggtcaggctggtcttgaactcctgacctcaggtgatccaaccgcctctgcctcccaaagtgctgggattacagcgtgagccaacgcgcccggcccctgtttcattatttttttctatgattctctttttgaaatggagtctcgctctgttgcccaggctggagtgcagtggtgcgatctcggctcactgcaacctccacctcccgagttcaagctattctcctgcctcgacctcccaagtagctgggactatgggcgtgcaccaccatgcccggctaatttttgtatttttagtagaggcggagtttcaccatgttgccccggccagtctcgaactcctgacctcaagtgatccttcgcctcggcctcccaaagtgctgggataacaggcgtgagccaccgggcccagcctactttacttttttttgtttttttaagtggctactagaaaacttgaaattacgcatatggctcacgatggacagagccacacttccctcctgggaacctgtcttccttccctttcacagaagctgggtgctcaggggcgaaggctcggcatcagaggcgtcctcctgggtccaggatcttctgggttctctcctgctgcggaaccacagcgcggctcctgcaacccacgggctccgctgtgctctgccgccccctagcggcgcctcttccaatcagccctcccgctcttcagcgacatcccatcttcgttgatgtgactgggagggactctgtatcctgaagcactttggggtcccaaggcgttcattccactacctaccatcctgtgctgattttagctgaaagccacttaatacaaagaatttaaggaaaaaattagagtttaaggcatgtcctcgtcccaggtctcaatataacgaaaatgtcttaggtatctcttctccgattgtggcttctggttggtgaagagttatcgatgatgtctggaaagcaatattgcgcctactccattaaactccaggatgttaataagtaatttgatttacgggactagatgtttggtctcggaaggcagtttcctgattttggtaaaacaggttagtagtatagagatcagttaaactgtaccctgaggattatggggcaataatgtatataaagtatttacaacagtgcctagtacattatgaactctcaacaaatgtagctattgatagatgaattgattttttaatatatatataaacaaaaatcaggccagatgtggtggctcacacctatagtcacagcactttgggaagccgaggcaggcggatcacctgagctcaggagttctagaccagcctggccaacatgacaaaaccctgtctctactaaaaatacaaaaattagccaggcatggtgcacacctgtaatcccagctgctctggaggctgaggcaggagagttgcttgaacccgggaggcggaggttgcagttagccgagatcacaccactgcactctagcctgggtgacagagtgagactctgtctcaaaaataaataaataaataaatagtataaacaacaattgtaggtttggggagtgttacttgcccctgcatgcatgctagagtcctagctcagaacctttttcacaagtaaacaaagggagttgaaagaaacgaaatttcctttttttttttttttgagctggagtctcactccgttgcccaggctggagtgcagtggcacaatctcagctcactgcaacctctgcctcccaggctcaagtgattctcctgcctcagcctcctgagtagctaggattacaggtgtacaccaccacacctggctaatttttgtatttttagtagagacggggtttcaccatgttggccaggctggtctcgaactcctgacctcaggtgatccacccgccttggcctcccaaagtgctgggattacaggtgtgagtcaccgtgcctggccaggaagtaaatttcaatgggtcactgggctgggaaaacatcccgctggtcaggctcttcctggaaaattacccagtgagaccaaaccgaagtcaactcggccaccctgggcaaggggagcgagtggggaagaggtcatggatcaactccacagagaactctggattttccagagtgcacgaagacattcccagggttgtgcggaatggaaatataaattcaagaaggaaatgaaacaataaaaaatgttcaactgttcaagaaaagcttgtttgtgttcttgtgtattttttaaagtggatgattatgggtatcaaatcactatggcatttatattcccatggatacattttcataagtgactaactgctttaaagtgttgacattagaatggtgctggaaattggccgggtgcggtggctcacgcctgtaatcccagcactttgggagcctgagacgggcagatcgtgaggtcaggaggtcaagaccatcctagctaacatggtgaaaccccgcctctactaaaatacaaatattagccaggcgtggtggcgggtgcctgtagtcctagctactcgagaggctgaggcaggagaatagcatgaacccgggaggcggagcttgcagtgagccgagatcttgccactacactccagcctgggtgacagagcaagactccgtctcaaaaaaaaaaaaaaagaatagtgctggaaattatagactttgcaagtttatttaaacttacagtgaaaagttctacctatgtcaaggttctacataactttttaaaattttatttatttatttattttgagatggggtctcactttgccacccaagccagagtgcagtgctgccaactcggctcactgcaacctccggctttcaggttcaagcgattctcctgcctcagcctcctgagtagctggaattacaggcgcacgccaccacgcctggctaatttttgtacttttagtagagatggggtttcgccatgttggccaggctggtctagaactcctgacctcaagtgatccacccaccttggcctccccaagtgctggaattataggcatgagccaccacaccctgctcaaagttctgcatat

SEQ ID NO: 161 - DNA, 64292 bp, Homo sapiens
cctccttttgacttaaagcctttactatccattcttggcaactgtaatttagtatcctgctttgtattactagttcatttttcatttgtgtactttgtttttcttattagagtataaattcccatgtgtcagggactaattatttttagatcaaacataactgcttatccaatttttattaatcattatccaaattctggcttattacctaattcttcccctctattctaactggtcagtcttaatttggtcttagccctctgcctttcccagctttttatagtcatattttaccctttttttgaggtattctccaaattatttatagtattattcttctctgaccaatgttacccatggaagttttttttgaactttaaaattcttatttatatatttgttcatgtgtgtaaaccctttacatttaagactagtcaacctaataagaaagtactattattatccccattttacaaatgaggaaactgaaaacagagttttaagtagcttgtccgtgttactcagcttgtgattggtggagctgaatttgaatctaggttgtcttgttccagagttcttaactgctgtgtagtattaatactacttttctgtatgttgtcttgaaatttgtttctctaatttctatatattttctctctcttcttatgttaagtagaatcttaattatttctattcttttttttttttttttttttttgagacagagtcttgctttgttgcccaggctggagtgcagtgctgcaatctctgctcactgcagcctctacttccaggttcaagtgctcttcccacctcagcctcccgagtagctgggattacaggtgcttggcaccacacccagctaatttttgtgtttttagtagagatgaggtttcaccatgttgcccaggctggtctcaaacttctaacctcaagtgatccaccccacttggcctcccaaagtgtcgggattacaggcatcagccaccatgcctggcctttttctattctataacaaacccataaactctagtgcaataatttagatcaatattacctacttattacatgaataaaaatggaagtgatacttgttcattggctgttgtcactattgcatatgctaactttttctgtttacatttcagggcatttgaatatgaaattcgattttacactggaaatgaccctctggatgtttgggataggtgggtctttttatttcacaaggacaatagaaacattaacagataagtccttatggccatgtttctcaaattggggtatatggagtgtgtgtcagagtagacagtggtgtcctgggggcacagagatccagaataatcataatatatcttcctgaggtgtttaagattcaagaaatttcaagtttatgatgtacaactttgaactacacccttctatccctatcctcagttttccccagaagcatgtactagagatactttggagaagtttgagggatacaggcttagggtatgtcattgaggacctcaaaagaaacatactttacttctgctaaaatccagaatgggtcttggagcaagaacaaaagtacatgttcaatttaaaatgtgttcttatctttttcctcccatttaggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagtaagtctttctcaagtgccatctgagttttaaatattaaactaagagattttctctagaggtatctggtataccaaaaaaaaagtaaaacagccattttgaaccatttagtagattggaaacatttaataaatatgcaatacttcttaaattggttctacttaaaggtggacttaaatatagtataataaggtattttcgcccttttaagattgatcgcaaagtctgtagatctctcagtgagtatggattaataatttattttatattttgaaacaaggtctcactctgtcacccaggctggagtgcagtggctccatcatggctcactgcagtctaaacctcctgggctcaagcaatcctctcgcctcagcctcgtgagtagctgggactacaggtgctgtgccattacgtccagctaattttttaatttttaatagagatgacttctctctctgttacccaggctggtcttgaactcctgagctcaagccatcctcccaccttggcctcccaaagtgctgggattataggcgtgagccaacacccctagtccggattacttatttatttattctaaacataactgggtgcagtgtttcatgtctgtagtcccaacactttgagaggctgaggtgggctgatcgcttcagcccaggagttcaagactagtcagggcaaaattggtgagaccccatctcataaagtacagaaattaaccaggtgtggtggcacagcacctgtagtcccagctactcaggaggctgaggtgggagggtcgcttgagcccgggacgtccagactacagtgagctgagattgcaccactgtccgccagcccaagtgacagagcaagatcctgtctcaaaaaaacaaccaaaacagaaaaacataattgggccattcaactgtactggaggaggaggtgcaggagctaacatttggcagcagtgtggttgtttggggaaaaacttccctctgtgattctggtatccctttcactcctttatgaaagtcatcaacacaaagaagtgatattttagttttttattggtctttggacttttttcacctagtatattgctacagccaaaaatgtctgcctcagctgggcatggtggctcatgcctgtaatcccagcactactttgtactgtcttacttgacatgtaggaaaaacatattttttattaaaaaaatgaccaccgtttgttagacattaatattactgcttttattctaaaataaatttaaaaaaataaacaataaatatttggaattatttacaaccaccacaatatgatgaaatattgacattaaaactgataagatttcttactaaaataaatctcttggcattaaaactgataagatttcttaataaaataaagtaagaaataaatttcttactaaaataaagaaataaatttcttactaaaataaagtaataaagtaagaaataaatttcttactaaaagtaataaagtaagaaataaatttcttactaaaataaagtaataaagtaagaaataaatttcttactaaaataaagtaataaagtaagaaataaatttcttactaaagtcttaaggaggactgattttaaacttccaatacagttgacccttgaacaacacagggcttaggtgtgcccacccctcacccagttgaaagtctgcatataacttttggcccccaaaattattaatagcctactgttgaccagacgccttaccaataacataaagttgatgaacacatagtttgtatgccatatgtattatatctttttttttacaacaatcttagctagagaaaagaaaatgttattaagaaaattataaggaagagaatgtatatttaatagtcattaagtggatgattgtaaagatcttcatcctcgtcttcacattgagtaggctgcggaggaagaaaacgggttcgtcttgctgtctcacgggtggcagagatggaagaaaatctgtatatgtgaacctatgcagttcagacctgtgttgttcaagggtcaactgtagttacaagtatagaaaattaggtaaatcctgaagccatgaggtatcttgatttcctcaggacattcgacaaatatttttacatccttagtgaaaggttggagaaattaccctatggatattagttacagaaacttataatgaagaatggcacccaaagaatgctaaacagatttgttagcctggagtctgtggaccctggtggtgtaacaatggattttgtccttcatttgtcactagcctaaataatatctttacatgtaatttattataagattggagactgggtgtggtggctcccacctgtaatcccagcactttgggaggccaaggtaagtgtatcatctgaggttaggagttcgagaccaacctggccaacatggtgaaacctcatctctactaaaaatacaaaaaatgcaaaaattagccgcacgtggtggtgcgcacatgtaatcccagttactcgggaggctgaggcaggagaatcgcttgaacccaggagacagaggttgcatgaactgagatcatgccactgtactccagcctgggcgacagagcgagactcagtctcagaaaaaaagataaaaaaaaaaaaaaaaaaaaaagattggactagctgcacctctaaagtgacttttaatcccaggattctatgattatatttaattggagttgttaaaagtaacaattaattagaataatttatctgtttatttttgataacctggtgcttgtactgaagaagaataatatcatgaagtaaaaagcataatctagatcagtgctactgaaagaagggtttgcatactgtttgagataagttcaaaaattgaaagtgagcttttggaaactttggtaacaatttgatattgccgggacatccaagcacatcatcattctttgagtaacttctgtttttattgtactttatatcagtccataatggaacacacacatacacacaataaaactggccccttcgccacagattttttgagaagcacgggtatagacaaccatcaaattcaaatgatcagcactagaatgatcagcaataatctgaactttgtatgtggctaacgaggtacatattaaactattgctttttctttgtgggtctggtcaagaggagtaacagatgaattcttcacactactttctttcgctttgcagaaggatttctccagtcagttattttatgtgactcctacagtctagctaaggaaaaaattgtttctggaaaacttctggtatttttatttaaaggtataaaattattttagtttggcaatttaagggttaccaaaaaaaaggtttatttaacttttagatctattaatctaaccatatagtccttttatttatgttatttcttaagtgatcttattcagcactctgaataacctgatctttactggctgtcccacgcacaagaacaccagaaccattcagaaagctctcaaaatagtgaaatcaatgttaagctatatttatgtagtgacagatatcaaagactggatcttatgctggtagcacattcagagttataacttttcttgaaacaccaccacatatgagaaaacatcactaatttaaataagcaagaaaaatccatttactgaattactgcaaaattaaactataaaatactaattatttttgttaaagatataaataaaacattccatttatttagcatttgttgtactagaccatgattaagggctggcatatcatagcaatgtcttctgagtttgtagagcttagtttatctgaaagacaaatatgaagccattaattgtaactgtaacagagagaaaattacgagttctataggaacaaatacaagacggacttaacctgggctagacaattaggaacagataaataggagatatttggtaaagtaacaaatggtagcttctctagtagtaacagaactcctaactagaacattgaaatgctatttttgaccaggcatggtggctcacacctgtaatcccagcactttgggaggccgaggtgggtggatcaccaggtcaagagatggagaccatcctggccaatatggtgaaaccccatctctactaaaaatacaaaaattagccagccgtggtggcgggcgcctatagtcccagctactcgggaggctgaggcaggaggatcacttgaacctgggaggcggaagttgcagtgaggcgagatcgcgccgctgcactccagcctgggcgacagagtgagactctgtctcaaaaaaaaggaaaaaaaatgctatttttatgtgaatttagggattgtttttaatagcttctaatgctgattagagtctggtggaatgagtatttttgcgaattattaaattttagcattaacaatttttacaaccttctcagaaagcaatttgttaccttttaacatagttctaggaatttctcttaagggaataatgtaaaatgtgaaaggttgtatgcatgaagttattttttatagaattatttataattgggcaaaattagaagttgtttaaatatccagaagtagatgaacaattaaattatggaagctctattagatgaaacatgatgcattcatttaaaaataatagtgaaaagaattcgaggttgcagtgagctatgattgcgtcactgcagtccagcctgggcaacagagcaagaccttgtctgtagaaataaaaaaaaattaaaaataatggttaagtgtaagcagcagcgtggaaaagtgaatgatgcagtattatagtggaataaaagcaaattttattatgatcaaaactttataagataatacatatcctttcatccttaagggaaaaaagactgaaaaaatttatcaaaatgtttgtgatgtgaggtttttagtgatattttcctccctcttgctaatagaattatctacattgtatatggtctcataatgtcccttctaaaacacagatttgactatgtcattcctttgcttatcgctcacccaccctaacacatacaacaattactattaggcagattcaaaattgattagcttgatattcaagacctatcacagcctttttctccagacaactatctagcctggacccctacataacttttaattttctgtatctttgcttatgctattttctctggctgaaatacccttcccttcccattttccacctgataaaagtccatttctccttcagggctaagctcaaatgttaaccccttcctcccccctttttttaattttctttagagacagggtctcactctgtcacccaggctagaatgcagtggcaccatcatagttcactgcagcctcaaactcttgggctcaagtgattctcctgccccagcctcctgggtagctaggactacaggcgccttccaccatgcccagctaaagttttaaattttgttgtagagacagggtcttgttatgttgcccaggcttgtctcaaactcctaacctcaagcgatcctcctactcctacctcggcctcacaaagtgctgtaattacaggcagaagcgactgcacctggcttattactccttcttgaagcctttactctccaactcttcttacaaatcgctcagttttgcctcttttttaggtcctcccagtatggtccttatcacattgtaataatagatttttttttcaatacaggaattgcatgtagtatctccagtgattgtttggcaactaataggcattcaatacgtgagtagaaattggttaactgttaacacttctgttacaggggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccggtaaactttctttggagcttgtcttaactctaaaaataatagaaataaattatctcttttttgcatctgaataaagtgctttctggtggattggcatgttaagtttacttagttactattcaatttttttaaagatatattttaaaaattttatttatcatagagtaaaatccactctttggtatatggtactaggagtaaaaagacttgtgatcatcatcattaacaagatacagaataatttcacaccccccaaaagaattccctttgtaattagtacctatgctgaacccaaacccctggcaaacactgatttattctccagcctgtggttttgccttttccagactgccatataaatggaatcgtataatatatagccttttgagtttggcctgtttgatttagcataatgcatttgagttgtaaaagttctttatagattgtaagtataagcctttgtcagatatgtgatttgaaaatattttctctcagcttaagcctggtctgttcattttcttaactgtcttttttagaacagaagtttttaattttaaagaagtctaatttacaagtttttcttgtatggatcgtgcttttgatgttgtgtctgagaattttttgtctagccaaagattgttacagagattttcatcttcaagttttcatcttcaagttttataatttcactttttacatttagatccctgatccattttgagttaatttttgtagaggatagaggttaaggttcttttttagcatattaatgttcatttgttccaatgccaattgttgaaaagactaacctttctccattgaattgcctttataccttgatttttaaaaaatcagttgatcatattcatgtaggtttatttctattattctattttttctaccgatgtacgtgtctatccattagtgtttaccatgctatctagattactataccttttatagtaagtctagaaatcagataaaatgagtcctctaactttattcttatatttaactctggtagttcatttgactttctatataagttttagaatcagctttctgggattttgattaggattatacaggaatatggtataattctccatttatttaggcttttttttttttaagtaaactttggtagatttttgtctttcaaggaattgatccattcatccaagttaatgagtttgtgggcatagagttgttcataatattcccttattatgcttttaatgtctgtaggttatatagtgattctccctttctcctgatactggtaatttatgtcttctcagtctggcttggatatcaattttactgattgttttagaaaaccagcttttgggttcatttcattgattttttttttttttctcttaatgattttctgttcttaattttatttctgcactttatttcttcccgcttgctttggatataacttgctcttctttttgtagtttaaggtgaaagcctagatcactgattctagacctttctctttttctaatataagcatttaatgctctaaattcccttctaagcactgctttagttgtatcccacaagttgtgatatactgtattttcattttaatttagttcaaaatattttctagcttaccccgtgtcttccttttgacccatgagttacttagaagtgtattacttcagttaggaagtgtttttggatttttcagatatctctgttattgatatctagtttaattccatagtggtcagagaacataaggtatatggtttcaagtcttaaatttgttaaggtttgttttatcacccagattatggtttatcttggtgaatgcttcatgtacacttgaaaaatatgtgtattctgttttttagagtgtaatattctgtaaatataatttagggcaagttgactggtagtctgttctggtcttctgtatcattgatgactttctgtctacttgttatatcaattactaagaagggttttgaagcctctttgtgattttgtctatttcttttagtcccatcagttttgcctaatatattttgaagttcttttagatgcataaacatttagaattgacccctgtatcattatataatgtctccctttatccctgataatactccttattcagaagtctacctggtctgatattagtacagctattccagcttcctttttgtttgcatgatacatcttttccctttctttactttttaaaaaccacattaaaaaaaaaccactcttagagttgtataatcatcattacaatctaattttagaacatttttaacaccctaaaatgaaccccatgcccattagcagtcactctccattcctacttacctcgctcctaggcaaccactactctgctttttgtctctatggatttgcttattctggacattttagttaaatggaatcctacaatacatggtcttttgtgattggcttcttttacttagcatactatttcctttttttttttccagggagggaagggtggaacagggattttcagcatactgttttcaaggttcatcataaatgaacatagttgtgacatgtatcagtactttattcctgtttattgccgaatgatattccatcatatgaatattatttatccattcatcagttagtgaacatttaggttgtttgcaccttctggctattacaaaataatactgttatatttgcgtaacaggtttttgtgtcattttctttttacccttttgttaagctagttgaatttagcagtggagggttatataccaactttagtgacacttatgttaattagcttctttaacttttaacctatgtctttatattttttaagtgggtttcttatacacagcaaatagttgggtcttgttttttctgtgaactctaacaatatcttttttgttatgttgagaccatttaatagaatttttaatattgttgggtttaggtctactattttattatttgttccatgccttttgttcctcttcagcctctttcctaccttcttttggattatctgagtgttttttagtatttcattttaatttgtgttattggctttttgcctcttacaactttaagtggttgctataaggtatataatatacctaaactttcacattctacttaatgttttaccatttaaagtaaaatacagaagctttataaccataaaagttcctttatattccctacccttttggtatacttgtcataggtattacatctatatgcattgaaaaccccaccagacaatattttgttttgctttcaaaagccatatatatatatatatatatatctcttaaataacttaggaaaatagtctgttgtgtttacccttttttttgttgttgttttttcttcattcctgaagctccaagttcccttctagtatcatttcccttcagtctgaagaacttcttttagccactttcttttagagcaggtccgttgtcaattaattctcctagtttttcttcatctgagaatgtcttcatttcatcttctttcctgaaaaatatttttactggatatagaattctgggtcaacgtttcgtttcttttttttttttttttttttgagatggagtcttgctctgtcacccaggctggagtgcaatggatggcacgatttcagctcactgcaacccccacctcccaggctcaagtgattctcttgcctcagcctcccgagtagctgagtagctgggactataggcatgcgccaccacacccggctaatttttgtagttttagaagagatggggtttcatcacattggccaggctggtctcaaactcctgacctcaaatggtctgcccaccttggcctcccaaagtgctgggattacaggcatgagccactgtacccagccaacatttcttttctttcaccactttaatgatgttatcccactgtcttctggcctccttggtttcttttttctttttctttttttttttttttttttttttttgagacggagtctcgctctgtcgtccgggctacagtgcagtggcgcaatctcggctcactgcaagctccgcctcctgggattacgccattctcctgcctcagcctcccgagtagctgggactacaggtgcctgccaccacggctggctaatttttgtatttttagtagagatggggtttcaccatgttagccaggatggtctcaatctcctgatctcgtgatgagcctgcttcggcctcccaaagtgctgggattgcaggcatgagccactgcgcccggccctctctggtttctaataagaaatctgtagtcatttagtagttcctgacctatacataatgtgttgattttcctctggccttgtccaagattttttcttgtttagttttggttttcagaagtttgattgtgatgtgtctagatgtgatttttttttttttttttagacagagtctagctctgttgcctaggctggagtgcagtggcacgatctcagctcacagcaacctccacctcccgggttcaagtgatcctcctgcctcagcctcctgagtagctgggattacaggcatgcgccaccatacccagctaattttctatttttagtagagatggggtttctccatgttggtcaggctggtctccaactcccaatctcaggtgatccacccgcctcggcctcccaaagtgctgggattacaggcgtgaaccaccacgcctggcctagatgtggttttctttacatttaatctgggcttcactgggccttttgaatttgtaaatgtatgcctttcacaaaatttgacaagttttcagccgttatttttaaaatgattttttatacctattatctctttcttctttctctctctgagacttcagttgcacaaattttagaccatttcccccgactctgctaccaataatctgtccaaattaaaccttttgatatcattccataggtccctgaagctctgtttaaccatttttctttttgtttttcagattggcccatttttattgctctgtcttcaggttcacttattcttttctcttccatctccatcctgctattgaaaccattcaacataaattttttatttcagatactgtatttttcaattctaaaatttctgtttcattcttttttataatttctgtttctctgttgagaatttctgtctctccattcatttcaaatgtttttaccttcatctcatggaacatagttatattaggtactttaaaatctccaggctgggcacagtggctcacgcctgtaatcccaacacgctgggaggccaaggcgggggaatcacttgaggtcagcagtttgagaccagcctggccaatatggtgaaactctgtctctactaaaaatgcaaaaattagctgtgcatggttgtgggtgcctgcaatctcagctactcgggaggctgaagcaggagaatcgcttgaacccaggaggcagaggttgtagtgagccgagattgtgccactgtactccagcttgggtgacagaatgagactccatctcaaaaaacaaaataaaatctccatctgaaaactataccatctgggtcattttatgtttgcatttgcttattgttttttcctttgaaagttggtcacatttttctagttctttgtgtgtcaagtaattcttgtaccctggacatttatcctgaccatatgttataagactctgatcctgttggccaatattccctggagaatatctatgtttttgtcttagtagacaaccacacttcagatattacaagttctttgtcatcttgtgtggctgttggttccactgtcagttcagttttcaagacctttgctgtgttgctttgggtctgtcccatgcatgtcctgcttaagggttaatctggggcttgggcagtggtttatatcattgttcagttctcaaagccttttctgtgctgctttgaatctaccctgtgcatgcatagctcaagagggaacctaagatgtatgccaattcacatacagaattaggagatcctcttgttcagctcattcctttgcagttctcctcccatattctttggccttcagagtcctcttttcccagtcctcaggccagaaagatggggtttctctgagttttacattcacataccaccactgcaacagttcaaaaccacaagagaaaatagaagaataaaaaaacaggaaacaatcctgcgtgggttgtttcttcaagttttgacccctctccacagtctgcttgcttttgttgacttttcagagccctcagttagttgctttttttgtatatggtctatagtttttaattcctatcagtgagagaaagagaaaaggtacagtgggcatactccatcttggccaacacctgcaatttattctgggttttttggggttttttttacccttatgataatactttttaaggctagttaaatgaagcagtggtaggaatggagaatctcttctgataatacttaaaactgtggcagcagcataggaagtttacttttcaaacttctgccagctttgctaaagtacaatgtcatgtcatatgcaacttcatttcatataggtcaggagaaaccgtatatgtgtgtgcgtgcacgtgcgcgcatgcatgtgtatagaaaaagagacacagtgataaaatagatgtggcacagtgttaacaattggtgggtcaagttttctaataaaaagttagtgggaaaactctaatcttaataaactctgtgatcttagtcttaataaccctaacctgatcctcagatcaacttaatggtgattttcagaataatttaaattggtcaaacttgggcatttaaagggagagttaaataattctagccaaaacttttcatgatcttaaggtgactctctttacttctgagagaataaacatgttctttgggatatttctgcattcttcccccagcctgctcttctaatttgtttactttaacaaattggaaattttgagtctggtaaaatagtggtcacctcactaaaagttgtgcattctgctactttagacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaagggtaagtttgttaaacgttatttcggaaaactgttagtttctagtggtaaaatcatgtaagaagataatacataaatatacctgtggacacttctagtttgctgaatactgagtagcaaaaagaaggaagtcaaaggagagctaatattacagtgtgcagtaaaatcaaaatgcatcagtaattttgtgtcttaattaagaaagacctaacatttaggaagcatcaagattttctgagtttgaattgttagttgaaagaagatatgtagtaacatagcaggtgttgttaaagtgaagcttacatataccaaagcctcagagaatgatactaatatggttaagaaccctgccttcagagccctttgggaccagaaattagactctctatatacccaaagatcagcaataattttttttaattaacatggactttttttttttttgagagataggttctcgctctgttgcctgaaacgtggtagtgcaatcatagctcaccgcagcttcaaactcctaggctcaagcagttcttttgcctcagcctcccaagtagctaggattataggtgtgagccactgcatctggacaacactgactattttttagagtagttttaggttcatagcaaaattgagcagaaggtacagagaataataagcttttatttactaaatttatagcagttagacatgtaaaccaggctgtttttttaatctcttatttctttcctggtatcaatttatcaataatcagaatgttacttggtggttctagaattaggatatagggagtgtatggtcccaaaggctatttcatccagatcatgatgaagcttggttaataaccagccccacaacagagaaaacccctaataaatgggttaattttgtattctctagttccagtatatctctgctgatttccattgagagaaaatttaaaactgaagaataaaacttaggttagtttctgataaaactagataatgttataatgatgactgaaggaagatgcagaatgtcttttttggaaatttgtgaataaaagatgtggggtgactggaggagggaaaagaaggcagaatataagtaacaaagaatggataaaacgattctatttttgatttattaatttttttaaagattatttttaaaatttctttttttttttctgttgtagtggaaatactgtccttgagttgaggaagaataggtatactttatctggcatctaagttaataatgaaacattttacatgaggttttaatatttttgctcctagctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacagggtaaggactcttagatccagtgctttgctgacacaacaaagacttcacatttagggtagagaagtatttttaccatctcttttaattcctcttgaatatttagccatggtctatatatgctgtctgagaacataaaactatggtaattttagttttcttcttcatctccagcctcgtggcaatacagcttcactgatagctgtacccgctgtgcttcccagtttcactccatatgtggaagagactgcacgacagccagttatgtgagtgtggtttttggatattttgaagtgggaattattaagggtgggcagaggcacctattctacttcccaaaggcagtttcttctttatgaagatgaaagtaaccaggccaggcgcagtagctcacacctgtaatcccagcacaggctgaggcaggaggatcccttgagcctaggtgttcaagaccagcctgggcagcctagtgagaccctgtctctatttattaaaaaaaaaagtaaccagacaaaattttgtatatcctttatgtttgtattcctttgagtatgttagggttaaaagaccatttgttaatattttattaaggaataaacattaattaggtttatattttcattactgaacattgctttaggaaaatcaatggtggctattctggaagatggattgaacatacataaataagctattggaatagttcaggcaaggatattaaggggcggtatttgggcagggtagtggtaatgaaaggagaagggagcttggatgggagaggcttcagcagtagagttagaagatttgtctgatgggataatggggatgtagggaaaagataatgtgatttaaatgagacgttctcattttgtcattgatagtaatgagaaattatgatagttttccctcttatcctgctttttccttctggacatatttttcctctttcttcctaatccttagcatttctgtttttaagaaaaagtatagtagctggtggttaaataaacaagccagcctgagatttagtctaatgcttaacattgcctagttctttttttttttttttttttttttttgagatggagtctcgctgtgtcgcccaggctggagtgtggagtgcagtggtgcgatctgggctcactggaagctctgcctcccaggttcacgccattctcctgccttagcctcccaagtagctggaactacaggcatctgccaccacgcccagctaatttttttttttttttagtggacacggggtttcaccgtgttagccaggatggtctcgatctcctgacctagtgatccgcccgccttggcctcccaaagtgctggaattacaggcgtgagccactgcgcccagccctagtcctaatactaggttgaattctgtcccagtgcaagagttacctcataactaatttataactcccactacatgctaggaatgcaaaaataataattaagattttgagcaaaaattctgcctaagtgctcaggacaaggggaaggctattttttttctttttttttttttctttttaaacagagtcttgctctgttgcccagcaggctgaagtgcagtggcaccatctcagctcaccgcaacctcgacctcctggttcaacgggcatggcagcccacgtttgccatcccagcactttgggaggccaaggtaggagaatcactccaggccaggagttcgagaccagcctgggcaacatagcaaaaacctgaccctacaaaacaaatttttttttttttgagacggagtcttgctctgttgcccaggctggagtgcagtggcatgatctcagctcactgcaagctctacctcccaggttcacgccattctcctgcctcagcctcctgagtatctgggactacaggcgcctgccaccacgcctggctaattttttctattttttagtagagacgggatttcaccgtgttagccaggatggtctcgatctcctgacctcatgatccgcccacctcagcctcccaaagtgctgggattacagatgtgagccaccgcacccggtcaacaatttttttttaattagctgggtatggtggtgggtgcctgtagtcctaactactcgagtggctgaagcaggaggatcacttgagcccaagaatttgaagctacagtaagctatgatcatgccacagcactccagcctgggcaacagggcaagaacctatctctaaaaaataaatcaattataataataaagaaaaatcagcttggcatcgtggctcatgcctgtaatttcagcactttgggaggctgaggtgaaaggatcgcttgagcccaggagttcaagaccagcctgggcaacacagggagaccctgtctccacaaaaaatttaaaaattagccaagtgcagtggcttgcacctgtggtcccagctacttgggaggctagggatcacttgagcccaggagtttgtggctacggtgagctgtgactgcaccactgcactctagcctgagtacagagtgagaccttgtctcaaaaataaataacgaaaataaaaaagaaaatcctatgagcctttatagaaatggataacatacatttgtagatgtctggtttttctaatgtttcaagtcattttgtagaaacatgacttatgttaaaattaatatggtacaggaaatattaaacttattatttttgagacggagtctcactctgttgcccaggctggagtgcagtggtgcaatcttggctcactgcaacctccacctcctaagttcaagcaattctcctgcctcagcctcctgagtagctgggattacaggttcgggccaccacgcccggctgatttttgtatttttagtagagacagggtttcaccatgttggtcaggctggtctcgaactgacctcgtgatctgcctgtctcggcctcccaaagtgctgggattacaggcatgagccaccatgcccgacctaaacttatttttattttaaattcttttccatggatgttttatttgacctctccacacatttttctttaggttgcgttttgcttagtgatgtatagaagctcttcatagatgaagaaaatcagctaaaaatctataatacgagttgcaaatattttccccctactttgtccttgtcttttggcttcatgtagcagtaaccattatgcttttaattatcatacagtcaaatttaagttttctttttttttttttttttcgagacagagtcttgctctgttacccaggctggagtgcagtggcgccgtctcagctcactgtaacctccgcctcccgggttcaagcaattctcctgcctcagccacccgagtagctggcattatagacgcccgccacgacgcccagctaatttttgtatttttagtagagccatggtttcaccatattggccaggctggtctcgaactcctgacctcgagatctgcccgccttagcctcccaaagtgccgggattacaggcatgagccactgcactcagccttttaaagcttttttttctttttttttctaaacttcatcgaaatataattccgtggcttttagtatgttcacagagttgtgcaacccttaccacaatcaattttagagcatttttatcactccagaaagaaccttgtacccatacctgtaagactcgattccccaccattaccccaatccccaccctagcaaccaactgtttttttctctatagataatttaccaattctagacatctcgtgtaaataatataatatgtggtctttgtttttttttgtttgtttgttttttgtgttttagacagagtcttgctctgtcgcccaggctggagtacattggtgcaatctctgctcactgcaaccttcgcctctccagttcaagcatttctcctgtctcagccttctgagtatctgggactacaggcatgtgccaccactcctggctaacttttgtattttcagtaaagacaggctttcaccacgttggccaggctggtctcaaactcctgacctcaagtggtccgcccacctcggcttcccagaccgctgggattataggcgtgagccactgcgtccaggcagtgtatggtcttttctaactggtttctttcacttagggtagtgttttcaaggttcatccacgttgtgacatgtatcagtacttcattattttttattgccaagtagtattccgttgtgtggcttcacaacattttatttaaccattcatcagttgatacaaattttaattgttttcattttttggctattatggataatgctgctgtgaataccgtgtatacatttttgtgtggacatgtgttttcgtttttcttggctgtatacctaggagaggaattgctggatcgtgtgattaactccatgtttaatattttgaggaactgtcaaattgttttccaaaaaagctgtaccattttaccttctcacattcccctaatgtacgagtactccaattccttcccaacacttgttattatgcttttttggttattgtcattctaacagagatgtgaagtggtatttcgctggttttgatttgcattttcctggtgactaatgatgttgagcctattttcataggtttattggccttttgtatatcttctttggagaaatgactgtttaaatccttggcctatttttcctttggattacagtagtccctccttatctgtaggggatacgttccaagactccagtggatgcccgaaacttgatagtaccaaaccatttatatactatgttttatcttatacatgcactgtggccataacttttgcagtttgaggtatgacagcaaaactaactttttttccttcttcacaatttcactgatagaagattcattcttactgtaaatcttatcaacttcagcatgtgatttattttttatttttattttattttttttagtgaaagttgaggctgggcatggtggctgatgcctttaatctcagcactttggctctgggaggctggggcaggaggattgcttgagaccaggagttcaagaccagcctgagcaatatagtgagaccccatctctactaaaaataaaaatacactggctgggcatagtggcacatgcctatggtttccgttactatggaggatgaggtgggaggattgtttgtgcccaggagtctacggctgcagtgagccagggtcacgccactgtactccaccctaggcaacagattcagatcctgtctctaaaaataaaataaaacaataaaataaaagttaagaactttcacctttggcatatccaaatcatcagcatcgctactcttgtgctttggggccattattaagtataataagggttacttgaacacaagaactgcaatgctgggacagctgatctgatacgagtcagctgctaagtgactaatatgtggatgctgaacaaaaggatgattcacatcctaggtggaacaaaatgggaatatatgggatttcatcaggatagtcagaacgccttgtaatttttttttttttttttgagaccgagtctcactctgttgcccattctggagtgcagtagtgccatcgtggctcactgcaacctcagcttcccgggttcaaccgattcttgtacctcagcctcccaagtagctgagattacaggcttgtgccatcacacccaggtaatttttgtgtttttagtagagacggggtttcgccatattgcccaggctggtctcgaactcttgggctcaagtgatccacccgactcagcatcccaaaatgctgggattacaggcatgagccactgcgcctggccagaatgacttgtaatttaaaactgatgaattatttctggaatttttcacttaatatttttggaccaccattgaccatagataactgaaactgctgaaaatgaaaccatgagtaaggggaaactactctatttggttttttattgttgagtttaagagtcttttatgtattctagatacaacttcttttcggatacatgatttgcaaatattttctcccattctgggttgtcattttattttctcaatgatctcttttgaagaccaaaagttatttaaaattttgatgaaatgcaatttatctgttttttaaaattttgtccctgagctttcactgtcatatctaagaaggctctgactaatccaaagtcatgaagatttgcttttatacattttcttctaggagttttatagttttagctcttatatttaggtctgtgatccattcttagctaatttttgtgtatggtataaggaaggagtccaaattcatttttcttcatgtggatatccagtggtcccagcaccacttgttgaagactactcttttgctattgaatggtcttggcactcttgttgaaatatcagttgaccaaaatgtatgaatttatttctagactcttaattctattccattgatctttttgtctatccttatgtcaataccacacagtcttttttttttcccctacacgatctcgattactgcagatttgtagtaacttttgaaattgagaaggatgaatccaactttgttcctctttttaaagattgttttgactattctgattctcttgtaattccttatacattttaagattagcctgtcaatttctgcagaaaagccagctggaattttgatagtgattctgttgaatctgtaggttaatttaatgatattgacatcttaaaaatattaagtcttctggtccatgaacataggatgtctttccagttatgtatgtctttgaattctttcagtgttttgtaggtttcagaatacaagttttgcacttctttttctttaattaatagactttattttttagggcagtgttagctttgcagaaaaatggagtagaaagtacagagagttcccacatactccatccccacccctcaaccctgtacacagtttttcctattactaacatcatgcatgagtgtggtacatttgttataattgatgaaccaatattgatacattattattggttaaagttctttgtttacattaggattcactctaatgtgttttacagttctgtgtgttttaacaaatacataatattatctatccatcattacggtgtcattcagaattgtttcattgtcccagaaatcccctttgctccatttgttcatccctttctctctctccccaaatcccctgtaactattgatcttttcattgtctttatagttctgccctttccagaaaatcatgtagctggaatcatagtatatgtagccttttcaatctggctccttccacttaacaataaggttcctctgcatcttcttctgacacaatacctcatttatagtgctgaatgatattccattgtatagatgtgccacgatttgtttatccattcgcccacaggaggtcattttggtgacttacaagttttagcaattatgaataaggttgcggtagacattcatgtgcaggtttgtttgttttaaatagtcttgttctttcacctacgctggagtacagtagcatgatcctggctcactgcagtcctgactcctggactcaagtgatcctcccacctcatcctccctagtagctgggactacaggtgcatgccaccatggctggcttattattttttttttttaaagatggggtctcactgtgttgcccagcctggtcttgaactcctgggatcaagtgatcttcctgcgtcagcctcccagagcactgggattacaagcatgagtcaccacacccagccaggttttggtgcagacataagttttcaactcatttggctggattgtataataagactaattttagccttgtaggaaagtgccaagttatttttcaaagtagctatactgttttgcattcctaccacccatcaatgagagcttctattgttccacatccttggcagcattcagtgttgtcaatattttagattttaaccactctaataggtgtgcagcagtatcttattgttttaatttgcaattccttaatgacatctgggaagcatcttttcatatgcttactatcatctttttttttttttatatgcttattaccacttttttttttttttttttttttttcccttagagacagtgtctcactctgttgcccaggctgggctcaagcaatcctcctgccttatccatcctggtagttgggactataggtgcatgacaccatgcctggctaattttttttttgaagacagggtctcagccgggcgtggtggctcatgcttgtaatcccagtactttggaaggtgaggcaggtggatcatgaggtcaggagttcgccaacatggcaaaaccccatctctactaaaaatacaaaaattagctgggcgtggtggcaggtgcctgtaatcccagctactcgggaggcggaggcaggagaatcgcttgaacctgagaggcggaggttgcagtgaactgcgatcatgccattgcactccagcctgggtgacaagagcaagattctgtctaaaaaaaaaaaaaaaaacagggtctcactgtattgcccaggctggtcttgaactcctggcctcaagtgatcctcctgcctcagcctcccaaagtgctggaattacaggccactgtgtccaacttccatctatatgtcttctctcacttccttattttaaatttattgtgaagtattttactatttttgaagctatagtaaatagaattgttttcttaatttcattttcttttttccccttttttacatgctgccttgagatgtgatttaattttattttcagattgttcattgcaaatgggtaaaataggttgattttgtatactgatcttgtattctttgactttgatgaactcgtttgttatctaagaccatatcttctgcaaaaagagatagttttgcttcttcctttcccatctggactccttttctttgtttctcttgcctaatagccttgactagaacttctagtacagtgttgtatagaagtgacaagaatggacatccttgtcttgttcctgatcttagggggaaagcatctagccttttaccatgaagtatgatgttagtgtgggtttttcatagatgtcctctagcaggttgagcaagttggggaaactttttaagcatgtaaatgcttggaccctaccattacagtttttgattcactgagtctgggaaggaccggtatctttagttgtacaaaggtatataagaaaataaaaggtatataagttattctgatccacagggttgaaaatacctgctatatcatggttgaggtatcttatacttcattcttttaaaagctatgctgccactctgattcttccccctcagctgagcaccttggacttaatattattaggttcctaatgctatattcttaactctaattcttttggatactaaaccatgaaaaatggattgtattgcataggttaatttctttttatatactggttatgatgaggatatggtattaagatttgctttcacctataagtaatataagctacttgattatcccacttatggctaatttccttccttatcatagcagaggtggtactcagaacataattttattttccttttttttacatttcaataggttttggggaacaggtggtgtttggttacacaaataagttacttagcggttatttctgaaattttggtgcacccgtcacctgagcagtgtacactgtacccgatgtgtagtcttttaacccttactccccccatcctttcccccaaatccccaaagtccattgtatcatttttatggctttgtgtccttatagcttagctcccacttataagtgagaacatatgatgtttggttttccattcctcagttacgtcacttagaataatggtctccaattccatccaggttgcttcaaatgccatttttttgttcctttttgtggctgagtagtatttcatggtagatatataccacattttctttatccatgcattgattgatgggcatttgggctggttccatatttttgcagttgtgaattatgctgctaaaatatgcatgtgcaagtatctttttcatataatgacttcttttcctctgggtagatacccaggagtgggattgctggatcaaatggtggatctacttttagttccttaaggaatctccgtactgttttccatagtggttgtacgagtttacattccccccaacagtgtaaacgtgttcccgtttcaccacatccatgccagtgtctattattttttgatttctttattatggccattctcacaggagtaaggggttattgcgttgtggttttgatttgcatttccctgataattagtgatgctgaacattttttcatatgctcgttggccatttgtttatcttttgaaaattgtctattcatgtccttagcccactttttgataggattgtttgtttttttcttgctgatttgtttgagttcctggtagattctggatattagtcctttgtcggatgcatagatcgtgaagattttctcccactctgtgggttgtctgtttactctgctgattattccttttgctgtgcagaagctttttagtttagtttagccccatctaattatctttgtttttgttgcgtttgcttttgggttcttggtcatgaagtctttaccgaagccaatgtctaggagggtttttccagtgttatcgtctagaatttttatggtttcagatcttagatttaattaagtctttgatccaccttgagttgattttttgtataaggtgagagaggaggatctagtttcattctcctacttgtgacttgccaattatcccagcaccatttgttgaatagagtatctttccccactttacgcttttgtttgctttgtcaaagatcagttgactgtgagtatttggctttatttctgggctctctattctgttccattgatctatatgcctgtttttataccagtattatgctgttttggtgactatggccttacagcatagtttgaagtcaggtaatgtaaggcctccagatttgcagaacataattattgatggcccttgtaaattatttttagcttcttttatcaatcttattgattttttttattttgacccatatgaataatagtaattttgcttctttaggacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaaggtgtgtgtaattcaagtttgtgaagaggacttaacttagttgtgtgaaggttgagctgacctattaagtctgaagaaaactaaccttatagtttgtacctttgtatgatgtttctatggtagtactgtttctttctgtgtatcagccaaaatcccactgctgccttctatggttgtactgtttctgtgtatcagccaaactcccattgctgccttccatgaaaactccttggggtgtgggggcactgagtatgtttagaagtaaaggaagaagttctgaactgtatgaacaatttatattccccaatacaataagcaagcagctatgatccctgacatgcatatatgtacattccatgcatccctattaagtacttttcctaatgttattgcttgaaatatttcactttacctttgatactttgtctgaaatttctccaagggcttatttagattaacatagtaggtcatactgcagtgatttagattatagatattcgtattgttttttaaagacattatatttctaaattaaaggaaaaggtttaaaaattgagatatggggaatttttgggaaacaggaagcagttctgattctggagcctggagtacttgaaggcaagaggtagggcagaatgggctggaaagtagggaagtaaggcatatggggcttaaggcatgagaaggtgaaggagaataaagaagggtacagaaaatgaggtaggggagggtccacttccatttagacattttttattaggatctgtaaggagaaagtaatgtttcttttatacatccgtatccagaataacctactaatatagctcagctctcttaacaggatgtggtgtttgtggggttagctgggaaacttaaccatcacttatactttgaggagcaatcttttctgagttccaggtgacaacctggaagcaaactttggtaaagcagactgttagtaagtttgaaattgccttcatttgttacactaattagtgtcatccaagattgtcaaaagtgctctgggttcaaatggaacttgtgtgtctaggtagaagagagggatggttgcaaagcaaggtgttgagtaaggcttttaaaaaaggagaaccactccagcaaagaaataggctaggagggtggccaaatatgaaccagaaaaggaactaggtatctagataaaaactgtttcctaagggaaaagcttagtctgtaccagatatatagaaggaaaatgaaagtccattttagggccaggcacagtggctcacacctgtaatcccagcactttgggaaaaaaagaccagcctgggcaacatggtgaattctcatctctgtgggaaaaagaaaaggtacattttgttttcaactagccaaagaaggacctactctagattacatgggatttaattaggaataagaaggcattgacctctgagaattttttaatactcatttctattgtgttttttttttttttaaatagagagatgggatctccctgtgttgcccaggctggtctcaaactcctgggctcaagctatccttcccaccttggcctttcaaagtgctgggattataggcatgagccaccatgcagaccttaatgcttatttctaagctggtctctgaatctatttcatgaacttgtataaattcccatctgtgtataagtttgtacccttacataaatcctcatttcaataaatgtggtttctagttactgtcaaaaactgacttcaaagacttgccaactacttactctcagggaaaaatacaagaaaagaggaagccacaatcagggcctacacaaaggttgttttttctttgcgttgcacttccaaatcattttttccctcttctttcaaaaactttagcttctttcagatttctgtcctctaattcttttctatctcctgagcctccttagtgtactcacctcagacttttcagtcacactccatcattcattaattgactaataagcacatggcttactatctatgcctctttaccctaacctgcaaaaccctgcatggccaagcatggtagcatgtgcctgtagtcccagctactcaggagagtgaggcagaaggattgagcccacaagtttgagaccagcctgggcaatatagcaagaccccatctccaaaaacaaacaaaactccatgtggcttagcctttacctacctctccaaccccatctttttctattcaccctcttactatgctgcaactacactggacttcctttggattcttagacacagtggtcttttcctgcattggggcctttgtgccacctagtttgttagcctagaatctttccccagaactttggccccttatcatttaaattacagcttaatactgtcactttatcagaatgatcttccctgatcactggtcttaagtagccctcccttggcctccatctccctacccagtcaaacattctcacgtcacctattttattctttttcctaaactgattttcttgtgtgtgtgttgcccccaaatttgaatgttagtatcacataaccaaggactttgtattatgtaccactgaaacctaagtactcagagctgtgcttggcacatagtaggtattcaatgtttttttccttttagtagaaacctgtgttgttcaaaggtattctatttttttattgaatggataaagaatagaggcctagaccacaagttgaggaccttattccacttaaatcattttcatctgtattagtaacatatatgttgaggagatgagctccaaaggcagtttttgacagaatgagttactatgaggaataatacctcaagcaactttactgtttctagccgagctattgaccagtgcagagaagagagcagaaatgcagaaacagattgaagagatggagaagaagctaaaagaaatccaaactactcagcaagaaagaacaggtgatcaggtaatttttcttttttcatacacaaaactagaatttattgaaacaaatttaaacattataaaaatatagaaggttaaagtcctcccaacccccatttagagtttctggtagtttcttagctgttagtagccggaaagttgagcgggaaagtaatttaacaggtgacttcaaatggaatttgtggcatgtgaaataagtggtgcagtttattgacttcttagttatactccaaatcattatgttattaattctggcttaagctttttattctagctatgttccattaaaatgggattgcctaaagaaatttagtatatgcctggcactgctcagttgagtacaacagtactggtttagagtaggaataaaaattattggaaatgacttttgtggtacactcattttgtactgttagtggatgtctagggaaagagtacagtaaagctaatgttagaactagaaaatagcattttctggatgggagggacattgattttgtttatttaatgcaaacagcaagaagagacgatgcctacaaaggagacaactaaactgcaaattgcttccgagtctcagaaaataccaggaatgactctatccagttctgtttgtcaagtaaactgttgtgccaggtaagactacataggtggaagggacaatgcatataggagggcatttagaaccaacctttgactctctagtgccttgaagtctccttgacgtttacagtatcgagacatggtttttgtaagtctctgtcacaacataagctttgatgctgatgagggaggacagagcattgactattttccactgaagaaacatgtttcttatagaaacaaatacatatactgtttttaaaaaacaaaatcacccatttctaccactaagagatgattaccattaacactgttctgtctcttcttttgtgttgtatttttgttttgttttataaaaatggcagcttaccattttgtaatctgcttatactattaatgcaacttgacatctattatcaaatatatttctgcaacatttttgataaccaaagcttccatcttctttaagagaatttgaattgacagtaataatttatcttagagtaaatattatatttaatggaaaagcctcttggacttttaaaaattaaacagttctttctgtgggtattgagcacatgatttaaaacaagtttctttacagagaaacttcacttgcggagaacatttggcaggaacaacctcattctaaaggtgagttgtatttgacagccttgagaagaacttgctgataacaaatgtattatgtaataaatggtaaatatttttaattatgataaagggattgaaagacagggggactaggatactaggaatttagtataagcatatgctttatgataggaaagacatttgaaagagtatttttttaaagattcctcagtgcttcaaaatatttggtttaattgtaattttaaatttacactaaccaccaaatcttatactttagttactgtacactaaacagcaaagacactaagggaagtgtttcttttcagggaaaaaaaaatttaaagctattttatactcaaattggttttcttttcttcaaaatgtgttaaaagtggtgaaacatgaatatctacttgtaaatggtttggcaaaaataaaaataaaaaacattaaaatctaattaaacctctgtttctaaccgtcaatttattggaaatataaagcatggaggaacgttgttaaacaacacagcgggatggaattggcaaaatccagcattatggggctagcaacccagtttgttcaacaaaaattccccccaaaactctatagaataaaagagatttaagaggcatttgaacagtcacagtatacggatcttaactctgcattcccaattcaaacaaactttaaaaaaatttttttttatttattaatatttttttgagactgagtctcgctctgtcgcccaggctggagtgcggtggcgcgatctcagctcactacaagctctgcctcctgggttcatgccattctcttgcctcagcctcccgactagctgggactacaggcgcccaccaccacgcccggctaatttttttttgtatttttagtagagacggggtttcatcatgttagccaggatggtctcgatctcctgacctcgtgatccgcccaccatggcctcccaaagtgctgggattacaggtgtgagccaccacacccggccaaaacatttttttaattggtaaaatatgaaacttctcactggacatttgatattatatatatattcataaattgttcattttataggtaggtatcatgttttgggattgggatttttaaaaagcctcttttagaaatatatactgaaatatttgcagataaaatgacatgtctggaatttgctttaaaataatcctgttgggttgggtttggggagtagtgacagtggtagagaatctaaatggaacaagatcatctaagtttaggtaattggtaaattgtttaatgaccttttatatgtttgaagctttttgttattaaaaaaacaggttgccttcctgctttcaaacaacacaaaatattgattaatttatctggttgtcttgaagagtaaagcatttactcctagagtatgtatctagtctctctttctctaggtcccagtgtacctttctccatttttgatgagtttcttctttcagaaaagaagaataaaaggtacgttgtttttttgtttttttggtttttttttacttaagaattttctgttattataagtgaggataaattaggggttactgttatgaaaaaaattgctaagtgaggtatgtctttttccagtcctcctgcagatcccccacgagttttagctcaacgaagaccccttgcagttctcaaaacctcagaaagcatcacctcaaatgaagatgtgtctccagatgtttgtgtaaggagcagtatccttaagttaatgtaaatgggctagtggattgtttattcaaaaccacaaaagcttaaggttaaaattgaaaccactgacttgaattaagcacatgaaaagatgctcagcattactactcaacagggaaatgcaaatcaaaaccacagtgagatactactttatatcctctaggatagctataataaaaaattacgcacagtaacaagtgttggcaaaattgtggagaaattagaacatacattactggtgggaatgtaaaatggtgtagccactttggaaaacagtttggcagctctttaaaatgttaaacacagttaccatatgatcctgcagatctctgcccaggtatatactcaaaataattgaaaacacatgttcatacaaaaaatttgtacacaaatgttcatagccgtattactcatgatagtggaaacaaccccaaatgtccatcaactgatgaatggataaacaaaatgttatgtatccataccatgaaatattatttggcaacaaaaaggaatgaagtactaatacctgtcacaacatagatgaaccttgaaaacgttatgtcaagtgaatgaagccagatacaaagaccacatactatatgatctaattttcatgaaatatccagaataggcaaaagtgtcatggattgaggttttccaggggattagagggtggtggagagtgactgctaatgggtatagggtttctttttggagtgatgaaagtattctggaattagatagtgatgatggttgtacaaccttgtgaatttactaaaaaccactgaaatatactttaaaagggtcaattttatggtatatgaattatatctcaatttttataagtagggaaaaatcactaattttaaagccttttgtacttttaattttttaaccaacatagcaaaagacatttgttcttttttatataaaataccttttttggcaatgcaaaagttatgtgggccaatcatttttcttcagtaatgttctatattaaccgctatagactaatgacataatacttaaggtaaaaagaccctgtgtagacatttaagtcaaaataaataacctgtatcattggcattttattaaagttttaaggaggaaaaatcattctcttcaaaccagcctctggaagcttgtcatgagactgaaaagaattgagtatgtttaatctgaagacttttaaggggtgatgtgagcagtagctttagtaacttaaagcagtgttttccacatcctagggaatcatttggaggaagttttttaaaagcactttttcattttagtttcttctctgttgatgtatattttatatccagtaaactgcacaaatattgtacagctagatgaatttttccatgcaattttttcccatatcaagatacagaatatttccatcaactcagaagagactagcgagtcttttgtgactaacagtgcttaagccccattccatctaggtgccattggaatttccagggaagaagtccaagcatgtatttttgtctttttaaaaatactttctcagataattctgctacagttagtctactgactgctatgaaaagacagtgatgtaagagtaattaattacatattgtgttctggagtaaaccaccagagaacatgatgaacaggctagatttggatacagtggttctagattcagctgttcaaggatatgcttaattgttaaaggagtccaacttcatttacctttttttttttttaaccagtcttttacttgaattttgttaataagtacctaccagaattttcatcccctaaaaaaatcatatttaaaatgtctaagctaatatggccataagtagtatttgcataaaatgtatagattataaacatctattttactttaatcacatatataaatacatatatatgtatatatatatttttttctttttcttttttagacagggcctcgctctgtcacccaggctggagtacagtggcatgatctcagctcactgcagcctctgcctcctgtactcaagcattcctcccacctcagcctcccaattagctgggactacaggtgtgagccaccatgcctggctaattttttattttttggagagacagggttttgccatgttgcccaagctggtctcaaactcctgtgctcaagtgatcttcccacctcagcctgcctcccaaagtgttgggattacaggtgtgagcaaatgtacctggccaaatcttttttttttttttttttttgagactgagtttcactcttgcactcaggctggagtgaagtggcgtgatctcggctcactgcagcctccgcctcctgggttcaagcaattctcctgcctcagcctcccgagtagctgggattacaggcgcccaccaccacgcccagctaatttttgtatttttagtagggacggggttttgccatgttggccaggctggtctcgagcgcctgacctcaggtgatccacccaactcagcgtcccaaagtgctgggattacaggcgtgagccactgcacccggcctataattttttttttaactatactttgtttcttccagatgtacctcccacctttagttactaagtcagaaattcaaagtatgtgtcaaattggtaatgatctagaaaattaatctctggtatccatatgggttaaatcaaataggcactatttgtatactacaggtaaatatgtaaagtggtataatctctctgaggacagctaagtaatatagataaagaactttagtgtttataaccttttgaccttacaattctacttttaggaattaatcctaagaaaattaaaggatttataaagatttatgtataaggataaagtagttttaaactagtaaaaaacagaataacctgaaagttggttaatttcttatagacccacaatgtggccattatgtttttaaagaatttttaatagcataggaaggaagaaatacaaaaagtatgagaaagagcaatacagagtatcatgaatgctacagtttcactggttgtaaaactgcttttcaaatgcatagaatatgctatgcatatatcctaccagacatacatgaattgtctttaagaaataaataaaaattaggtatgtagcatagaggaagaagacctaaaaactaggaggatagcaaatcattagaatatttactaagtgaaagcagaagaaaaatagtatttgtgctttagttcataggtgaaatttgttgaggaacaaaaccattgcccaatatttttctttgtatggagaatcttcctggtacattttttggatgaagtatagtttactgtgttcatgatataaaaacctttttatatttgcctagatattctgatatgctatttctgtaccctgtgtcactgagctaatatgtctctctcagtaaaaaagttcttcatgtattgaaatattttagctaaactttatatggtctttatttcaggatgaatttacaggaattgaacccttgagcgaggatgccattatcacaggcttcagaaatgtaacaatttgtcctaacccagaagacacttgtgactttgccagagcagctcgttttgtatccactccttttcatgagataatgtccttgaaggatctcccttctgatcctgagagactgttaccggaagaagatctagatgtaaagacctctgaggaccagcagacagcttgtggcactatctacagtcagactctcagcatcaagaagctgaggtgattggggatttacaggttttacaaaccagattgtttactctcttattctgcatgtgcttgtcagttacagtaatcagttatcaagttcttactaactgccaggtactgtgctaagtgctttacatgagagtagggctgccccagatgaagtgtcaatgggatttagtgattgatttggatgtgagggttaaaagtaaattttgatggtagagaaactaagtggtccgagaggagtatagtaccattgaggaaactttgcaaagtgtacatgactgacgaaaaggaggcatttagtttttctttaatattgagtttaaaatagtggtaggatagcttttgttaattttatgtatttatttatttattgaaatggagtctcactctgtcgcccaggctggagtgcagtggcactatcttagctcactgaaacctccgtctcccgggttcaagcgattctcctgcctcagcctcccaagtagctgggactacaggtgcgcaccatcatgcctggcttatttttatatttttagtagagacggggtttcgccatgttggccaggctggtctcaaactcctgacctcaggtgatccacccgcctcggcctctcaaagtgctgggattacaggagtgagccactgtgcctggccagcttatgtgaattttaaataggcaactagagatgtgttttttaaaaaactatcttttgatagagaggtggaaatgaactatggaatagatatgagggaatggcttatggccagggtctgacacttgttttaggtcagctaatttaactaattccagttttaggaattctttgtaattggcaaatttttgcttttaaagctacattttgagaggccagatgcagtggctcacctctgtaatcctggcactttgggaggctgagggaggcggatcatttcaggccaggagttgaagaccagcctggtcaacatggctgtactcaaaaaaacttttttttgaaactttttccctacaggcttttaagcacatttgctagcatgtattcacattgcatgatttgggtttctcttttctttgcctaaccttttcttcttgaagaaaaaaaagtccagagaaaggataaagaggaagaaagtgtcaatgttagtgtttctcaatattatggaatatagagtagatatttactataggtaaataaagcataaatccagaaatgtatgctggacatggcttattcaccaggtttagaggaggttacctagattctgatttggggaaataatggacttgaaaaatgagactattgctgagtgcattggctcttgcctgtaatcccagcactttgggaggctaaggtgggaggatcacttgaggccaggagtttaagaccagcctgggcaacaaagtgatgccttgtgtctaataaaaataaaaaaaaaaaatagctaggcatggtagcactcacccagctatcatttcctgggctcaagtgattctcccacctcagcctcccaagtagtcccagatattagcttttttgttttacaacctttcagctacttgggaggctgaggtgggaggatcacttgagcccaggaaatcaaggctgcagtgagccatgatcgcaccactgccctccagcctgggtgacggaatgagatcctgtctcaaaaataaaatgaaaagtaaaaaaaaaaaatgaggctatcaaataaattgataacaaattataaattatttaaacctaaattttattgtgttaaaaaataaaagaataacataaaattataaaatgtgtacattaaggccaggtgcagtggctcacgcctataatcccagcactttaggaggctgagacgggtggaccatctgaagtcaggagttcaagaccagtctggctaacatggtgaaaccctgtctctactaaaaatacaaaaatcagctgggcatggtggcaggtgcctgtaatcccagctactcaggaggctgagacaggagaatcacttgaacccgggaggcagaggttgcagtgagccaagatcatgcagttgtgctccagcctgggtgacaagagcaaaactccatctcaaaaaaaagaaaaatgtatacattaagaatttatgaaattataacaaagttgatatatattattcctataagaattaacttatttttgattcttttagcccaattattgaagacagtcgtgaagccacacactcctctggcttctctggttcttctgcctcggttgcaagcacctcctccatcaaatgtcttcaaattcctgagaaactagaacttactaatgagacttcaggtaggatatacataccactatatccatgcctagtgaacacttgtttatctcagcaaactgagctgtatgtttttctttttttgagacagggtctcactctgtcacccaggatggagtgcagtggcacaatcaaactcactgggctcaggtgatcctcctacctcagcctcccgagtagctgggaccacaactgtgccaccaccaatttttgtattttttgtagaggtggggtttcgccatgttgcccaggctggtctcaaactcctggcctcaaaggatcctcccgcctcagcctcccactccctgggattataggtgtgagccaccatgcccagtctatgtgtttttccttcttaaagaagttgccggccgggtgcggtggctcacgcctgtaatcccagcactttgggaggccgaggcgggtggatcacgagggtcaggagatcgagaccatcctggctaacatggggaaaccccaactctactaaaaatacaaaaaaattagccgggcatggtggcgggtgtctgtagtcccagctactctggaggctgaggcaggagaatggcgtgaacccgggaggcggagcttgcagcagtgagccgagatggcgccactgcactccagcctgggcaacagagcgagactccgtctcaaagaagttgccataaattgtgaaatttctagagtagattagtacgaagtgaacacagtttcataaacacctgagacaggtgagtgtagttaaattaacagtgctgactgtgtaatcttgattttttttttcttctactctgttataatatccattttaagcattagggtttttttggtgatatattttcacctttccctcccactggcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaagtaccattgaactcatgtcctctggttcatgacagtatacaaataagtgattatttgtacttaagcttgatgcttgagcactgtaaatattcctagattgtattttttaaaaaagcaatatagaggatgacacatcagtaacttcatgtcctaataataggaattatgtcttctcctcttgcaatctttaacaaattatttttaaaagtattctagatactactaactggcaaatacaccagtgcctctatcccttaaaccaggaggtaaaagctacagggctgtatatgttcacagtgatttttaaatggaatcaaactttctcaacaggtaatgaggattactgcattaaacgagaatacctaatatgtgaagattacaagttattctgggtggcgccaagaaactctgcagaattaacagtaataaaggtgggactgattctttataatttcagttactttgtaaataatacggattggagcaataactgtcctcatgttaccatcaaatctttctaataatctctttcaatatgtccaaatatattaagtatcctttcagtttcattttttttaggaaatctctgctgatactttctggcctgctccaatctggacaagttatacattagctttcacacaatcaccacacacaatcaccttggaatttccatttattatcatcctaggtattcacattacctttgtcttatattggatacctagtttctttttatctttgttttttaaaggacacggtctctgtcatccaggctggagtacagtagcatgatcacggctcactgcagcctcaacctcttgagctcaagcaatcctcccacctcagcctctggaatagctgggaccgtaggtgcacgccaccactcccagctaattattttttgtagagacgggggcctctctgtgttgcctaggctggtcttgaattcatggctcaagcagtcctcccaccttggcctcccaaagaactggattacaggcatctaactttgcttttgaatttttttgccattctgagtctcaaagctttgtgtgaagttatttttccttctttctggatccttataggatcttattcttgtccccactattctgaaatgtcacaattacatgccttttcataagtttgttgtcacttatgtgctaggtactcaatggccatttcaatctgttaattccctcagttctgagaaattttcttcaatgggaaaattatttttcccctcagttttctctgttctcttattctctaattccttttattagaggtgtatatggcatctttggacagaacctctaaaaatttaactttttttctcctatattctctctttgtctttttactttactttctgagtatattatcagcttaatatttttggtctttttactaggtttttatttctatatttaattttcaagagctctttttaaaattttttacccctttgtcatctgtttcttcttgttttcttttttgtctgttttgatctctctcacactacaggctttcttcaagtctttggctctctattcgtatttaagtatgggacattgaaagctctgtgtatatggaaagaccttgacagctgtggacctcaatgtaggatgatctagtttggccattttattggaaaaccctccaatctttagatcctttctcttgacctgatcatagaagtcttctccctcagagaagacttctaattttctgcctggagcatataagcctggctgctagctttctgaaatctgagtgaggaaattggtctgaagaatagaagagcagggaggtgcatcttaactgctgcatatataacatctgatatatatactttttcctgttttctatgttatttctacccccctcagtggtgcctagtgccctctagtccagagcccttctgttttatactcactaggtaataaacttctggacttcgagaataggggagaggtagttgctgggctgggctatgggagcagaggagggaagctggggtctaccttcctgtttttttgtttttttttttcttcgagacggagttttgctcttgtcaccctggctggagtgcaatggcatgattttggctcactgcaacctctgcctcccagggtcaagcgattctcctgtctcagcctcccgcgtagctgggattacaggcacccgccaccaaaagcctagctaattttttgtatttttagcagagacggggtttcaccccttcataatcattggtcaggctggtcttgaacccctgatgtcaggtaatccacacgcctcagcctcccagagtgctgggattacaggcatgagccactgcactaggcctaccttcctcttaaatgggattcaatcactcctgtcttagctccaccctcagcctcacttccatgggtaattggtgctgccagttatatagtataggaaaatagccttgtagtgtaaatgtagctcagctttctcctctgccaaaatcagtttttattctaattggattgttacctcctgttctctttccagcttatcctctttccagaatttgttgttattgtgtcttttatagtagatttatgcctttaaaaatatctctttattatttctctatcagaagggctggaaggaatgtgtttcaacctgccagccataaccatagacttaactgaacttatttttaaaatacaatgtcttacaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggtctgtaatactaaaaacataatttaaagtcctgaagtagagagatttgtgctccatttagcaaaggaatttagtacaaaattcctgtcaatcttctagaaatagaccaattcaagtataagttagaagcattgataattttctcgttattttgaccaaagatctctttggtatttttttaactttttttggtccgttgtcaagcataaataaaagtagaattgtacaatgaactcccatgaactagtcatctatgataatcttagctcatggtcactcttgttttagctatactacccccactggatagtttttaaaacccagacacaatatgtcattttactcttcggtttgttcttaagaaggtttgctatggattttgatgataatatgaattctcaaaaatggttggaatgagggtattttaaatccatttattaagtacctattttgggccaggctcatgcttgatgcccttcatcattatgtcattaaatccttacaaacaatcttatgggagatggcagtgttattaaaactgggacatagactcagtctacagaggtgcctacgttccagtagagaacaaggaagactacaaaccatcagttttcaaggtattgagtataactacgatctgccaaacttgagaaatagtgagttttctgtccttcaatttccaggatcttctccaacacagtgaatatattacccatgaaataacagtgttgattatttataaccttttgacaatagtggagatgctacacaaagcagaaatagtccatggtgacttgagtccaaggtgtctgattctcagaaacaggttggtccttttcattcttataattctgccagctgtctcttaaaacatggatagttgccacttttttttttcttttttgaggcgagggtctcactctgtcacctaggttggagtacagtggcatgatcttggctcactgcagcctccatctcccaggttcaaacgattctcccatcttaaccttgctagtagctgggaccacaggcgcgcaccaccacacctggctaattttttgtattttttggtagagatgaggtttcaccatgttgcccaggctggtctcaaactcctggcctcaagtgatctgcccacctcagcctcccaaagtgctgggattataggcgtgagccactgcacccggccaagttgccaatttttaaagccttttgataaatgccatatcgaggaacatattatgttaagagagtatttacctaaaagtcaaaaatcattaagaatagtttaaaataattcaaagaaataaacacattgaggaaatagattaaatcagataaaagaattaatcactgagtattgtgatgatatatgtcaagatgagatataaaatatgaatattttgaggaatataaagtggattgtttagtcattctttgagtgggaccagtgccactctagcgaggatgccagcaaaatcaaggcactactcagtttcatagaccaaagcttaagtcaggcctaactgacctgttagccaagagaagtgggtaaaaccagagttcaaatacaaactatgccaaggaatggggtttagtgttcaaattaaacccagtgtgtccatcaggttcaaggggtgagcacagagcaggaaataataaatgaatactaaggactgagaaaatatagatcacgttcaggcattaactaggcaaaaacagtccaacatttttgctttgtgaaaagtactagaggactactatattcttttagtgatcattggtgttatagtatttgagtaaaagcagcctggtttaaagatgctgtgtctgcccaaccctgtgtcttgggtgaggtgttaactttgtttctgaggccactggtatacactaatagctggacttactctttacatttcttctgaatacttaatctatcagaagagattgaattagactctaaattatagttaacgtggaaattaaaagaaccctcaatgtgttcctgtgattgtaaccaaaagaaccagagaatcccaccttctcccctgagatagcagagtcaaaggctttcccagacataatgtagcagcatttctcatccagggcaccataggtattttgggtgagacaattctttgtgcaggtgtgttccaagcaatgcaggatgttttatattcctattcccccccacccacccaattaagtgcaagtaacaatcccctaagccgttgtgaccaccaaaaatccccccaaatttccaagtatgagaacccctggtatattttcactctacttaacattaaaatgacagtgctgaaattcccagggctatggaaattggaagcagaggttttttctaagccttttagaattggccatttgtggtctaatgaagtacgataacccttctctcagccactagaggctctaggaaagtccatagtattaaagaggcattgctttttactttgtcactgcttatcaaatttaatcagaaatttcacatagattcataaggaattaaaagccagaaaggggccgagcacagtggctcatgcctataatcaatcccagcacttttggaggctgaggcgggcagatcacctgaggttgggagttcaagaccagcctgaccaacatggagaaaccccatcctactaaaaatacaaaattagccaggtatggtggtgcatgcctgtaatcccagctacttgggaggctgaggaaggagaattgcttgaactcaggaggcagaggttgtggtgaactgagatcgcaccattgtactccagtctgggcaacaagagcaaaattctgtctcaaaaaaaaagccagaggccgggcgcagtagctcacgcctgtaatcccagcattttgggaggccgaggcgggcggatcacgaggtcaggagatcaagaccatcctggctaacacagtgaaaccctgtctctactaaaaatacaacaagatagccagccgtggtggcaggtgcctgtagtcccagctactcaggaggctgaggcaggagaatggcgtgaacccgggaggcagagcttgcagtgagccaagatcatgccactgcactccagcctgggtgacagagcgagactccatctcaaaacaaaacaacaacaaaagccagaaagggctggatgcagtggttcacatctgcaatcccagcactttgggaggcagaggcaggaggatctcttgaggccaggagttcaagaccagcctggtcaacatagcaagaccctgtctctacaaaaataaaataaaagccagaaagaaccttttgaaattgcttagtttagttgcttactttagtttctgcatattttttgtgaggaaaatgagatccaaaaaaatggaatgtcctacccaaagtaacagtgagtgagtagctgattagagggctaggacaccttcatgcatgcttctttttattaatctatgagacattttttccctatgcctccaaagttatataaatattttacaattacactgggcatggtgactcacatctgtaatcccagcactttgggagaccaaggcagaggatcacttgagcctaggagttcaagaccagtctgggcaatataatgagacctcatctctacaaaaaattaagaaattagccaggcatggtggcacacaccagtagtcccagctactcgggaggctgagatgggaggatcgcttgaacctaggaggcagagactgcactgagctgagatcgcaccactgtactccagcctcagtgacaagagtgtagaccttgtctaagaaaccaaacaaaacacacacatgcacacactttacatatatatataaaatacatatgtatattttatatatatcagaatccacgatccctataactatatatatactatatatatatatatatatatatatttttttttttttttaattatagtatagttttatggtggccaaaaaaggttggctcttgtgccaaggaaaaatgagagcaattatcaattttaaagtaaaatacatagatcattctgtgccgtggaggtatgtaattggagtagttaaagactgtatttaggaatattgcaccaatatcaggagtttgagggaattaattgagaaaaacagacaaaaggaacacatgaaaacccactcttttcatttataaacagttcctatgtccccttggagaatagcattattgcataggatagataaacccaaggaaaacaaaattaattgataattaattagtattataaagatttttttagtaaataactggaattacaagtaagagtaagataaaatatggtgttttacaagaaattttacaatacagataggactttataaaacagacttgcattgttttccattaaactctggaaggaagaatctaaacaatacttggaaagcctatctggaatagtaaacaagaaaggctatgacacctataaaattttaatttcctccatcataattcctgtcagtgtataaatcattgcaattgtatgtgttaatgtgtacagtacagggaagaagcctgtgctctgcttccatacttactttatataatatggaagcttgataaatgtttaatggtggccatgcaccgtgattgaaatatactttgtgtcaccaaagtggtgacattccttccgcattgggtggacactgccactgctctgtcttacaggtgcattttcaaaattaaccactggagggagttgttggcatagctaagatgtacccaaggtaccttttttttttaaagaccagctatgcagcttctttcatggcctatttttattatctccttctcttaaatctgggctcagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtaagtgtaaaacaagcctgagcaaatatggagagggtttcttaatctctttattatctagataagctataaaagctactgtttactgataccgactcctagaatagatgacctagttttcaaatatcaccaagtcaagtaaaatgtaacatttttgtgttacagcattgaagaatatacacatacatgtgcaaacacatgactaactctgtaaccgagtgccagggccactcctactgcctaccacccatgtaatcttttataagtcattttctgtgatcttctctgtaaaatagggataacagtctctgctatgtgtttatcagaattgttatgaggagtaaatgaagtaatgtatataaaaagaacattagcacaaatgtaaagtcttttgtatggtggcattatatgcagaaattccttctaactcagctttagacataagacatttgctgattgaatatgtagcacaaacctgaactaatcatgtggaccccatttagatcacagctggagttcatgcaaactcagtaggtctacaaatttgaatgtgatagtccaaatatttcatcttttgttcttaaggataattcctagaattggctctattgatcacttctttggagagcttctccctttactgtaagggtgaggaacagtctactaaaatgtatgtcataaaataaacttagttaagcactgtaatacctttcaacttcctaccgaaataagctgccatggtagaggcagagaattattttagctgatggtgctttttgtgatttcaggtagacctgtttggtatagcagatttagcacatttactattgttcaaggaacacctacaggtcttctgggatgggtccttctggaaacttagccaaaatatttctgagtaagtattgatgaatgtcagggtctctgcctgtcccaataattttctgtttctcttgggtgctatctctgctttggcagccttagttttttaatccaaatgccatggttccagtagtttcagccagttttcattagagtatcagcagagcagctagtgcaggaaaaaggaactgcttactaaaaataagattcaaaactattcagacttcaggacatcattctgaatctagctgtatcttccagactacagctatagtatggaagcttccctgtttagatatgtgaaaagaagcatttcatgagaataattttctaactaattggtgttagccttaaattcctttttctttatttatttattttttgagacggagtctcgctctgttgcccaggctggagtgcagtggcatgatctcggctcactgcaacctctgcctcccaggttcaagtgattctcctgcttcagcctcctgagtagctgggattacaggcgtgcgccaccatgcctggctcatttttgtatttttagtagagatgcggtttcactacgttggccaggctgatctcgaactcctgaccttgtgatccgcccgcctcggcctcccaaagtgctaggattacaggtgtgagccaccgtgtctggcctaaattcctttttaatagcaattattaccaaaagttaataagcatcctttgaaaagacttacatttctaaactatatgctaattttaggctattttttatttaataagtggatagaaccaaaccagataactgactctcctggagaagaagtaagtggtctcttaataagcactgcttggtctcagaaccttagtactccctcaagcctgctcataaaacttactaagtcagccgggcatggtggctcacacctgtaatcacagcactttgggaggccgaggcagattacctgaggtcaggagtttgagagcagcctgggcaacatggcgaaaccttgtctctactcaaaatacaagaaaattagctgggtgtggtggcacatgcctgtaatcctagctacttgggaagctgaggcacgggaatcacttgaacctgggaggcagaggttgcagtgagctgagatcgcgccactgcactccacccagggcaacagagtgagactccgtctcaaaaaaaactaagtatctacgttccactttagcttatcttagcaaataagttcccagcctgtcacctattgttatattctttggttaaaaaaaaaaatgagtgttgaagatttaatgccccttctctattttcatctttgaataattgaattgtacttttctcttcatttaattcagaacttggccagtgttgtctcttacatgaacttttaaaaataggcttgaaatacaatgtaagacatataggatggatataggcatgtccacttggctatggtccaggcaggtctggctaacacaagcagaaacaagtggggtcagttggggtttcctaacagccctgccttatctaataagggaagtttctctgatcaaaagaaaataataagaagcaaaggtacaaacatattaagcagtagttagtttagtcaagcttacgattatcagagaattgtaaagaagatccactactggggtaggagaaaggagctgtagcctttttaatgacctagactctaggaaagttagaggaaataaaattcctttttcttctatttgtagaagaaaagtgctatgtcttagtacacagaggaaatttatagatttagatgagagatcttctttccctttatgtgcattgtatcttggcttttcccactatggtagcccttttttgtagttcttccctgggctttcaaaggactatttgaatgatctctaaccctagagttctaggtattaccttacaccattttggtgcataaatgtaccactgagttaaactaaaaggaattataattttcatatgcctaatcttgatggaaatggttttatatatttttaggctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgttaaatttgtgcttctaacatgtcatgtagtttttgcaaactaaaataacagatggcttaactttgcagagatgaactattttgccatggaaatttatatatcctagacttcgaattgttacaatagggttgtgatgagacagagtagccaactatttctttaggtgggtctgaccttccaataagtggtctagactgaaaagtaggtaagatgatatgcataagaccaaatatccttcaatttcaagtggcatgattgtatacatggcttatgttttaatgttttcacttttttggagacagggtgtcctctgttgcccaggctatagccttgatttcccaggctctggcaattttcccacctcagcctcccaagtagttgggagcacaggcgcacaccaccacatctggctaattttttgtatttttgtagagatgggatttcgccacagtgcccaggctggtctcaaactcctgggctcaagtgatctgcccacctcggctgcccaaagtgctgagattacaggcgtgagccaccatgcccggccctaatgctttcacttttatccaccaagctccttggtctatttatataatctagtggcactgctgctggggtcttttgattaggaatgtgactgttagaaagtaaaagcaaatgtgttaaacagggtttagcaacctttcagaaatggaataatcaccattctattacatgcagaatgacttggagggggcaagggtcagtgaaggaataaaaggaaattttgcttgaaagatttgaggaagcaggaggtcagaataaaacgataactttgaagtatgaaatagtttggaagagaataggcctagataaagtattggactcccaaagggaagcgtgaattacacctggcctcagggatagggaagaaaattggtagaaaaaggcaatgaaaattatccaactatcagccgggcaccgtgactcatgcctgtaatcccagcactttgggaggccaaggagggagattcatgtgagaccaggagtttgagagctgcccgggcaacaaagtgagccccatctctacaaaaaataaaaataaacataaattagttgggtgcagtggcacttgcctatagtcctagctgcttgggaagctgaggcgaaaggattgcttgagcctgggagttcaaggtttagtgagcatgattgcgccattgcactcttgctccgggcgacagaacaagactctgcctctaacaaaaaaaggaaagaaaattatctaattatctatttcatatctaaataccaaaattatctaatgttcctccttgctagtgccttattttttttttactctagttgtcactgttactgctctaagattgctggaaagcaaaaaatcctacgtatgtctcaactaaaaatatttaagcatatatagttgaagcactgcaacatgacttggatctgaaagataatcaacttagaaatatttgctcttaaccaaaatacagctctccaaacattctcacatttgcttcttatactgatgatgtaaaatgatatatctgtatcttttacataatcaagcccctctcctctctgctctcctcatttctcagttcactgtgttgacacatgaagttattactctgagactggacagaaaatttagatttattcttaatataggcttagctactatgtagtgaatagcaaccttgacagcaggctgctgtgaagtaaagctttgtttctggagtaggctgtgaggaaagggaggggaatctgaggaaactactttgttagagaacttgcatctgttttgccacccctcccttccattccaatctcttccaaccccagccctttgtagagaggagaaaagtttacctgaccatttaggacttacaattgtcttaggttttcagtttgcctaagcataaaaccacaaagtgagatcctttacatttcccttatattttatgcttatttgtcttgggagaaggaagcctttcctttttggcagaagtttcaaatggttcttatttcttgtctcactaaggcagtaatagcatagtgatggacctggttgggtagtgggggacagctgaaaaggcaggagttttacttttgtttgaaaagagaccacatcacatatagcatctcaccattcacaaagtgtacatccaccgatactactccactgttagagccttcgtcctcctatggcagtagtataagaaaccttccaccaagtcagagtgctctaactgatgccaaacctaaacctggaaataaagattttcctggagcagtaagacttcagactgttggttgagctattatctcaaggtagataagaaagcctttcagaaggtgagcacaaggttctttgaaataactcattggtgtctttaagctgaagcctttaagcaaagacagcaaagaaattgcatctgaaaatgaggaattcttccaactgcaccagttctttctaatgtgccaaaattagcttctaatttggctcctaaaataaaggtttccctagtgaggagaatgcatttaaaaaaattttttttgtaatatggcaaacttctaccttaacggggtccttggttctaccagagacataagaagctatgaatatttaataggacaaagatggcattttaagtcagtatgtgaaaagattatttaataactggtgttaaaacaatggattaggctgggtgtggtggctcgcacctgtaatcccaacactttgggaggctgaggcgggtggattacctgagtcaggagttcgtgaccagcctggccaacatagtgaaaccccgtctcttctaaaaatacaaaattagccatgcgtggtggtgcatgcctataatcccagctacttgggaggctgaggcaggagaatcgcttgaacccaggaggtggaggttgcagttagccaagatcatgccattgtactccaacctgggcaacaagagtgaaactctgtctcaaaaaaaaaaaaaaaaagaaaaaacaacccacaatggattaaagcttgaactctatctccattgacactactagttcatatagcaccttcgtgcaaattagaaaaggccccttcctttagtggattcagtacctcccaatgcaccataccttgactgaatttcagtccccacttaccccctcagcctggtacccttgtgcagcaaatacattgtgcagtcttatgcattgatcttgcctgtttcactgcttatccccaaaataattttggagaaatcagaaattttaatcaaaatacaatgtaatagatggttttgcaatcttttgcctgtgtgacataaaagcaagatataaaccagaagattgctattactatagtagataaaaaattaaatataggatggatacctatcctcccctccaaaaaaattaaaaccataaattcaaactaggaacatttactggcaacaaatatttacatctttttttgcctcgactcagggatcttgctttgtcgcccaggctgcaatgcagtggtaagaagatcaactcctggtttcaggcctcccaagtagctgggagtctcggtgcacgccaccacacctggctaatttttttaatctttagtagagacaaagtcttgctgtgttgtccaggcttgcatccactttcatctggtctcatgactctgttgttcctacccacctccagccaaatcagaaccctccaaagactttaccatggcctataagaccccaccctatctgaccccactctctctgacctcctcccggactcccctcttcctcacccacactgctgtaggcggcctccttgttgcttctcaaatgtgccaactaatttccctctccctctctttaaagccttttggcttttaaggccagttgttttttggccttgttttccttgatcttcatgtaaattactccctttcttcctttcaggtaggtgtcttctccaatctccactctatcagagaggctgtccctgaccattctgtacactgcacagaatagcatcccatcccacacacactgctatcactttctatccctttttaccctcctttatttttctattgcacctgtcaccgcctcgtgcgtgtgtctgtgttgtgtgtgtgcgtgtatacatacacttttttttctttatctctctactagaatttaaactccttaagggtggggattttctttgtttcctgtttgactgcactgtctagaacagtgcctgaatgaataaaactgttttacctaaagtacaaaaaactcttaaaaataaaaaattgataaaagaaacaaaggacatgaacaatccactaaaacattttaatggctcatatacatgagatgttcattcctaattaaataaaatgcaaaataaatgagaaattgtcatacactctaaatggttgaaaattgtatttgtaaggatgataagaaacaggcattcatatattattaattgggatgcagattggtacattattagaagttgatttggcaaaagtcacttaaatattccctttagctgagaaattttcctaagaatttatctcacaaaagcattgacacaggagctcagagaaagcactgtttctaacacttgtcctgtctgcttccaagactcgacagtccccagagggataatccacgtgacagaccccaggaaggtagtgcttgcactagtgcagaggcgctggcaagccatctctgtaggcttcagggtgcctcaccattggcagggaacgcccttccaatttgccatgagcccttgtagatggcagaacctgagagataggcagacattttcagcctatgtagggaaaaaagccgtggggaaaaagtgattgcctttggtggggagagtgtatgggagtggagagaggaaagaatgaaggctcttacttttcaatttgtacatttataagcattttgaattttctgaccatgtacatgaattgcttttttaaaaaatgtactgggttaatctaggctaagaaattataggccatgtttttgccatcttttccctcctctatgttgtaaaaactaagccttgttaagtgttcgttttttaaaaaactgggactttggaaagctttattatctaaacatgaaagcaaggttgatatggaattcaaatgaaagtaaaaataattttaaatcattgaagataatatatctgagcttttatttttagtatatgaaaattcatgtttaaatgttttatactgttctattagagatatgctttgtaacattaccatcttcctactattacaacttcctatgtctgtgaacaaattatgtatcaaattatgtaaagtccaactcttttcaacacaaaatacattttttatggctttcatataaaaacttgagttttcacaaagtgatgtatgtttaagaaaagaacaaacagtgatgaacttaggctaaacttctatagacatgtgctttttttccatcaaaacatattacttccaataatcttgctccttagaggcttgtgcggcaaacctttgacttatgaatagtatcatcctgtaaattcatgttagcctttccataggaaattgtggttgtcctgtcaaactgctagtttttaagccccttgtgagcaggggactatgtgtctattaattttatatactcccagaaatgagctcatgggtcttaaaaataagtagtgaattaaaatattggaaaagagcagccacaagttcagaaagtagttacattggcaccttggtgagagggaaagatatctgagtgagtctctagatgtagctgaaggtgtaatctcactttcatttttagtatgccactttatacatgtttctttaacatgtaataattgactgctgaccttacattgcaatacacttcactgtcctgtttacacctttttcaattaaatgttattttcacaagtatattccactgaaatgtgtactgtatttcctattaaattgcatcagtcttgaaattaaagtgaggatggcatttcataaaaaaataccagttaaaatctgtggacaaaaagatatgcattttatttgttttcttttttaaaactttttttttttttttggcattttaaagcctagctgtcttcccacccccccgcatccccccaccaagagatggggtttcaccatgttgcccaggctggtctcgaactcctgagctcaagcagtttgcccaccttggcctcccgaaatgctgggactacaggcatgagccaccgtgcctggcccttatttgtttccttttgcattttaaacaaaattgaaaaatctgataaccctagaacaaagtgataacacaatttaaaaagatgacaagcatgaagcttcagtgatattgtctcattcaaggaaatgatagctaagggtgaatgagtgtgcagtgagtccagagtcccagcgagtccagggggtcaggctggcagaaatatgagtgaggcagagtagacaaaagctaactagcgtggccaggagagaccttttcagaccaactgtaccccatcactgaacagatataaaagccattgcttaggactcactcagaccggcatgttcaatatcctagcatatggaccagtggttgaggttccatggtataggccattgggggcagctgcatagctcctccctgtaccattcctctgctccattttattatgtattgcgttggacttgtctctatgtatggccttacctctccaactcatatgagtttgttgggggcaagttttttttttttttttttttgagatggagtttcactcttgttgcccaggctggagtgcaatggcgcaatctcggttcactgcaacctccgccttctaggttcaagtgattctcctgcctcagcctcctgagcagctgggattataggcatccaccaacatgcccaactaattttgtatttttagtagaggcagggttctccacattggtcaggctggtcttgaactcccgacctcaagtgatccacccccgtcagcctcccaaagtgctgggattacaggcgtgagccactgcacccggccagcaagttctctttttatgccctggttaggacttcagtatagtgctcacattataaggggttgactttacaggcccaaggtctgcttagaaccttctcagcattgagatggctctctgcctatggtaccaaagcaaacactagcatggtggctagaaattctgcctttagccagaatatctggacttgaatcctagctgtgtagcagtggacaagttaacctctctgagccagtgtcatctataaaatgaggataactgaagtgcctactttacggagtattgagaactgaagctttaagtacgcatacttgtagatgtttgtattgatttagttctaatgtttaatggcctaaggttctctggaaacctctcaagtaatttgagatctcagctggttgatcggagccttactatcttttgacttaatgtgcacagtgtagctaaacctgtgatataataaaggtaagtgaaacatgtagtattctgtaatttagagataagggaaaattagttgtttctatcaggataagtttcagggaaccaaatatttgtacttaaagagatagtccttaagatcagccaaataccaaggtatcaggaaagtccatccagtccccattctcattccacaaggccgtttcagcccagaggacctctggcttgcagctgggctgcttctgtgccatgttcagagtgcagagatctttaaaaggctgacttgggtcctgtttgctccaaggtaccaggcagggtcttgctgcccaccagccacttacaggtgcatctcagtcttcccctctccaaccaggagaaatggctttctagcttaggggcatggcctactgatcccatttaaggcatctagtcccttcctgagactcttgttgctagagcatctagccacacaacaatgttgcggtcaacagtgaacctcatatctgactgtggtctcataagatataataccaaaaatttactgtaccttttctatgtttaaatatgtttactttttacttttattattttttgagacaaggtctcactctgttgcaggctggagtgtggtgacatgatcagagctcacttcagctccatcttctaggcttaagcgattctcccacctaagcctcccaagtagctgggactacaggtgtgtgctaccacacctggctaactttctttttttaaaattagagacggtgtttcacaatgttgcctaggcgggtctcaaactcctgaactcaagggatcctcccacctcggcctcccaaagtgctggtattacaggtatgagcaactgcctgcagcctaaatatgtttagatacacaaatgcatacctttgtgtcacaactgcctactgtattcagtacagtaacgtgctgtgcaggttgtagcctaggggcaagaggctacaccatatagtctaggtgtgtagtaggtttagaccatctaagtttgtgtaactacactctgatgtttgcacaatgaaactacctaacaacgcatttctcagaatgtatctctctcattaagctagtatctgtcattaagcaatgcacgactgtatttctattttatgctctcctacatccctcacctgagccaatgaataaaaggcgatcacttgcttaataggaaaaaggaaaggggaaaataataggaagccctgtgaactcaattcaggaactggaaaacctgggctcaacagctgcttagattaggtcactgcctttgcttgcccatctaaactattactgatggctcctaccccaaagggttcttatgagaatgaacacaagacaggaggtgagcatggaagttccttggcttagaacaagcagtgtctgcttccccagcatccagcccagggcaaggcacatgggaggcagtaggagctggtgcaaaccactggtgaatctaagccactgttgagagagatgcctgacattcttattcactcaggcctgcagctgcaacctgttgactcctgttttactctttgttgaacacagaaatgtgttcatttttgccctccagggcagcaaataatatcttggaatgtggcaaaaaagataagcccctatatattaagttttactgtggcctccacagtgatgatggataccacgaagaatataacaaaatgtaaggcatgctcactcccttcagagagcttataatttggagaaacaggccacaacactttttttttttttttttttttttttttgagacggagtctcgctctgtcgcccaggctggagtgcagtggcgcgatctcggctcactgcaagctctgcctcccgggttcacgccattctcctgcctcagcctcccaagtagctgggactacaggcgcccgccaccacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccaggccacaacacttaaaagccaagataatatatgagagaaataagtcagtcaaaaacggacatctcgagggaagccatgagcagtagctgatggagtggagcggtgtatatgttagactgaactaagggctagtgtggcatgataggggctggagctggcttatattaggtagttttcagctgcagaaaaacccagaagaacaaccaaaatatcttaagtggtaagaatatctgttatttcacataacagcaaacctggagctcagaagttcatgcggggcccaagttgtttccacctgcctattcctccgtcctcagcatgctggcttttgtcctcgagctggttcccttgtgggtctcagttggctaccacagttccaagttcctgaacaacttggagcagcataagaaaactttctcccaaaaccctcccagctggcttcctcgcgtgtctcttggccagattgtcacatatgtgagcctacaccaatccctggcaaagggaagggcgttaccaagattggtttaaacttaagattcacccctaagggctggggctggggaggggcctttcgctgggtacacagttaggagaggagtgtacattctaataaattgggtttcttccagcaagggtggtgagatggatttagaaaggcaaccaagctgggcatggtggttcacacctgtaatcccagctactcacgaggctgaggtgggaggatcagttgatcccaggagtttgaggttactgtgagctatgatggcaccaatacactccagcctgtgtgacagagaaagacctcattttttattttattttttcttaaaaagcaagcaagtgtctgctatataggtaatgttgttgggaaggagaaaggaaggatttggtaacacaatagcatcctaaactctgaaacggatcgcctgggttcaaacccatgtcttgtcatttaatgacctgagtaagtaagttaacaccacaatgccttagttgcatcatctctgaaatgggattataatggttcctacccagattataaatttcatggggacagggtctcatcttgctcactgagttctccccagcacctagcagaaagcattgtacctagcaggtactcggtagatatttgttgaatgggttaattgtattgtgaggattaaatgagttagtgtatggcaagggttcagcacagcacataatctaaagtatgtgctcaaaaaaatagtgtttcactgcaggctttgtagagacctttggaaccctctttgagtggtccccaatctttctggcaccagggaccagtcgcatgaaagacagtttttccacagatgggggatggtgggggatggtttcggggtgaaactaaattctcaacctagatcccttgcatgcgtagttcacaatagtgttcgcatgcctatgaaaatctaatgccccttgcaggaggcagagctcaggcagtaatgcatgcttgcctgctgctcacctcctactatgcagcccggttcctatcaggccacagaccagtaccagtccacagcccaggggctggggacccctggggtgtcttctggctcctttgcactacctatgccaccaggcttagcagcagtcctagaaacaggtgtatcaagaagactctgctcctggtgggctggggctgagatggcagaggcccatcccatcatatgccagaaagaggacacacttgtgagtccaggacttgggactctacagtttgcagctctgctcagactggcttctgggcagctcctcactttgccattaactcctcagagtcaagccccagatgccccttggaccagccccactcctaaggtcatctggtcagggtctgcaggggtgacgctttcactgacaaaaggattttaattttggtcctatccctagtgtagtcccagccagtctttggtagtcacccacttttcctgctctgacagagatgggccagcccctcccataggggctgctcccgggaaaggctcatccacaggctaggcctctgccgggcctgctgccagccactgagcctttggcgattgagagctgactcccgactgaggtgtaggcctccgtccagccagcacaaagggaggcacatcccttgcagcagtacccacagcccctgtcacggcaggctgtggccagaccctgattgagtggctccctctcagccatctgttcagtcacccagaaacaagtcaagtcaaagctcccagtgagttcctgcctcagccatttggtgtcacaaggaaagccagggcgttgccacttcctgatttgggacaagatgtgtaaatgcattgagcctcagactccttatctgtagaacttggggtaatgataactacttcatggtgttttaagaattccatggaatcacagatggaaagagcctagatgtactatgcctgactcgttggagacttcacataaaagggttttcagctgctgccacccccatcttttaagt

SEQ ID NO: 162 - DNA, 397254 bp, Homo sapiens
ttttagaatgccattggttaggccttttacttttgtcgttttaaaggacactctggacatccaaccgatgcacatcccacgcccccaccccccacgtttcctgaggctgcgtctggcctggaggaaccgcccagtgaagacaggtgctcgcagatatcaccgcctagtgttccctgggcccacttgcggggaagtcttggaggtgaaaatccaggtctggaatgaatgcattccacagatgcatatggagagctactgcatgcccagcaccattcctaggctgggagcaaaacggtgagacacaaaccccaacccgctggagacagtgaccagccactagatgactgccatgtttttagtgaggcattcaggttgtggaagcctctggaaaccttctcttgctttttgtcccccctcttttcttttcggagacatcttaggcttcacatttcttcctcttggttctacattttgaagccagagcaagtggatgaatttctcactcggttcgtttctagggtggtcaggtgtgctcagctgaacaaaagccggttgtataaggttgatgccattttatgtcaggatccggcaagggctccacctgtttttgaaaattctacagtggaaacagctactagttctgacctaaataagaagcagctcaacatctacagaccttggtatgtgcccagggtgtagtaaaagttctcaataaatgccagccgatggcgctgctgctattataagcaaagttaggagagcctggggcagctgacacttaaaatagacatctgtacacaggatggatgtcacatcttttaatagtcgtgccaggcacgttgttagatgcagggacacagcatggaggaatcggtggaggttgctgccctcaagtttcctgagcttgaaggggtttagaatatgccacggtggcatgaaaattattttgagcagaaggcatgtgaattcctgaaatctggtcgggtgtggtggctcacacctgtaatctcagcacttgggaaggccgaggcgggcggatcacctaaggtcagggtttcaagaccagccttaccaacatgatgaaaccccgtctctactaaaaatacaaaaattagccaggcatggtggcggacgcctgtaatcccagctactcaagaggctgaggcaggagaaccgcatgaacccaggcgatggaggttgcggtgagctgagattgtgccactgcactccagcctgggtgacagagtgagatcttgtctcaaaaaaaaaaaaaaattgtggtaagatacccataatataaaattcaccattaaaaaataacacggaagggatcatcgtgaatgcaatgtgagtattgatgaggatggtggtgatcttccagaaccttctctgacgccacccaggccgccagccttactttaccggcttcggcgctcatcatactgtgctgcaaatgccagtttcctccttcccccttgggaagtttcctccttgggggtcggcacctagactgtataccccccagggcggaaacagcggttcacccaccaggtgcttaagaagggtttgtggaccagtggacctcctgctctccctggggaaaggagctgggacatgtgtacacacctgcagctacaagattcggagggcgcacagagcctcaaccgtaagaaggagaggcgatcaggctgaggaagatggggcagtggagctggatggatagagagagggtgggttcattcattcgttcactcattcgtttattcatattcatccatccatcattcatgccctgagcgtgcgttgtgttctgggcagggcctgtgctgggcaccgattgtgtaatatatcatctctcccttcaaggtgcacccaatctgggtgggtgggtagagagaagctacggtgacaaggcaaaaatttgggaaacactctcgttaacaattcaaactgtggtcccctcccagatgtataaatccaaatgtttaggggtgggcacagtactctgcatctccagacagcatcctccgctgattcggatgcatgatgacgtcagaacacttggatattgtggtaacttttgggccaggggctctgaaaccccgaagacctccccctgggagatccgggacagctcccagagaaggtgagtcttaaacacatccgtgacaggcaataaggaaaataaggggggtccgctctgctgatcagccctaagagccgcggcggttgtcggctggggcggggcactccacgactttcccggccagacacggtcgccttcctaggtgtcttggcctgcgaggcactcgtagcccgcccctctcctaggtgacgtacattggagacgccgtcgctcagcgacccgggttcgagtccccgcctcggccgccatggcggatgcggagccggaggctgggggcggcagcgaggatggcggcggcggcggcggcccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcggcccaacaggccgccctgcagcggggccggggcaccgagcccccgcgcctgccgcgcctgctcccgccccaggtgaggcgtcgggagggacgtggggaaactgaggcccgaagggggccgacgccccgcggcggggtagctgcttgtccggggaggccagtatccgcccgggttaagactcagggcgtccccaggctgagcttcttagggacggcgttcggcccccacctgtcaccaccctggcattttcaccccaggagcctcactctaggagcggttgctcacgctgggccctgtgcctggaacgccctcgtgccttctctgccttcacagccctgctgggggcttttgcgtgctccctagctcttcttacaggcctttcaccgctggttcagcctttgtggagcacttagagaccgtgttcccagcactccccactatgtgcaggaggtgaagccttgaacacacttgctgaagaacgaacataaggcaggttctgggattgacgggggctgctttagagtgggtggtcccgtaggccagacactggagctgaaacataaatgaattaaaaggaaccaacttagcttttcagttgtaaggtgccaaggcccaggcttggaacaaagtcaagcacaatacactagttcgctgcaggacttaacatcctgggtgatagtgactgatttgtaaccgcagtacccagcacagtgcctgatacacaatgtttggaatatgtgaaagcactctgtatactacaaaacatcctttcccagtgggtttatttcctgggccacacaccttttggttgctaggggggtgataactagaagacggtcgcccaactccggagggtgaagcatagcgcctgaagccagagggcctacacggcatctgtaaaattccaccccatttcagcgctggggttgtaaacaaaattagtctcaccccaaaattgccaaaagaagacagctttttccactagaagaaacgggttagggaatagaatcaggaaccttcactcgttgagtttttttgactgatgttagctgcttagggttgtatccagttaatcatcaagactggagagttgtcttgctaaggtttaggaagaccagtgtgattctgtccagatgccacactatcactatctagaggtgtgaccttgggtaagtcaacctttttggactttggtctgggtcagaaggctgcaaggtgccatctgggggcagctatctgcaaagcctctgctctgcgcccggcgctgtgcggggccgctcagttttcagcagtgtttttgtaccggcattttgcaggtgggaaacaagctcagggaggttgcgtggctttgcccaaggtccctcaggtgtggctgctctccctagcccctgtactcctcaccataccctgctgaatatggccacagctttttgggtttggaatccaaaaatgacatatttttcgtaaagcaaaagcaaacttattcgagcttaggcagcatgatgggattgtattttgtagctaatctaatggagacgatataaattctacctgcaataatatacctttgcagcacattcttttaatactctttcagccccagctgtgtcatggaggccacaaaggcaaaccggatgcgtactttgcccctcagtagtttatgaactaacaggagatgaaacaagacccagataacttctagtcaaggccagaaagctaaagatagtgaaaaagaactgaatgtatttagagaaagggagattgttcctggctgaggacatcagaagcagctttgttgaagaagtggtatctgaactagatttgaaagggtgcgtctgagttgaaaatgcagaaggggagaggcaggttctggggcggttgggggtgcatttcaacaaccacagcagaaggcccagtgttcgctgtgggggtggtgtggatcagcagcacagaccaatggacacacttgggtcagatcgaggcccctgtctctccccatcctccctcttccccaccccacagaaatttccagttccatccaacatgctgtgccccttttcatgcatccgtgcatttacacatggatgtgtgccctttttcacctggcaaaaattcccagccttcaaaatgcccctcagagatcacagcttctgggcagcccaccacctctgggctgttcctgcctcttgattgcacctgttgtaccatgatgacatttttcctgtctgcctcacctgtctgcattccttagggaagcttgtctgccttcagaatcatcagtggagcttttgaaagggcagatcttggggcctcaccccaggagatccgattcagcaggtctgcggggactgaggtatggcaggggaaaccgcccccatctcaagggtgaggttaggacttggctcctgtgtatgtattccacccagaaatactgagttaacattagctgaattaactaaacaaagtatcaagcataatacccacagggtaagccagtgaggatagaggataaatacattattagtctggctttgccgctgtggttatcctcaaacagtagggtttagtgtatgtatgtatatgtattatgtttttgttttggggttttgttgagacagggtctttctttctcacccaggctggactgatctcggctcactacagcctcgaactcccaggctcaaatgatcctcacacctcagcctcccgagtagctggggctacatgtatgcaccatcatgcctggctaatttaaaaatgttttgtagagacagggtcccgctatgttacccaggctggccctgaactcctggcctcaagcagtcctcccgcctcagcatcccaaagcactgcgattacaggtgtgactggcagtaaaatgaaagagatggggttcttgaaggatatgcgcagtcaatctcgttgtcatttgtttcacaagtagcccaggagtcggggactcccagggctatggtgccacctctctacaattcttcatacaaagtgttggctgacctctgctatttgtactagtataacagacagacgagagacacactccagcttgatctcagtgaggatctttattctgtcctgtgtgacatttttgttgatgctccactgtttgagggtcacaccagaaggttgagtccaaagagggccagttggtcgtcccaaataagtgattctcaaccgagggcagttttgccccacagggggcacttggcaatgtcttcattgtcaggactcgggatcactactggcatctagtgggtagaggcagagatgctgctggccatcctccagccacccatgtcaaaggattatgttctgaaatgttggttgggaaatcgtgctctggatgatgaggtttgcctctttttctccctggaggaaagtgctcattatttctgctctgtgagggcgggagccttgtttcttttgcttccccgtccttctcccctaagctgtaagacagctgtttccctgacacctgtaacagtgtttctggcacgcggtcagtgctcaataaatatttgtggggtgttattgaaggtagttctcccctttggtaggtgttttgctattatagacagtgctgccctgaacttcgtagaacagaacatctttgtggccacctgcgtgttttttttatagaatccaggaaatggaattactgggtcaaaaagcacatgtatttgaaattttgttagatatatttgtaaaaagttattgaagatactcagccctacgcctaggtacatgcccctggagaaagtcacacatgtatacacatacatcgtgaagattcagagcagaacttaggaacagaaggttggaaaccacctgtccatcaataggagactggtgtactcatactgcagagaaaatgaacccgtgacacctacccatgttaatgtggataaaattcacgaagcaaaatgaagtaaagaaacccagaaaagccctttcaagttgcaggagatgatatcatttatataaagtttaaaaacatttcagaactgaactatatatttttagaaatatctgcatatgccacataaatttttaaaatcataagaatgctaaacagcacattcaggacagggtgaagaaacaggcatgcaggttgtgcagtaggaagctgggtaacattgttccttatggctttgttgtcgcttccagaatttcattaaaaactttttaaaaaacatgggcccacattatgaattacgtctgcttttagagtactaaaaactccaagcaaaaacacatgggtaacgccgggcacggtggttcatgcctgtaatctcagcactttgggaggctgaggcggacagatcatgaggtcaggagtttgagaccaccctgaccaacatggtgaaaccccgtctctactaaaaatacaaaaattagccaggtgtggtggcaagcgcctgtaatcagggctactcaggaggctgaggcaggagaattgcttgaacctgagaggcagaggttgcactgagctgagatagcgccactgcattccagcctggaccacagagcgagacttcatcttaaaaaaaaattagctggtcatggtggcacacacctgtgatcccagctattcagtaggctgaggcaggagaatcatttgaacctgggaagtggaggttgtggtggcactccagcctgggcgacagaacgagactccatctcaaaaaaacaaacaaacaaaaagccagccgggtgtggtgaggcaggtggatcgccagaggtcaggatttcgagaccagcctgaatggtgaaaccctgtctctactaaaaatacaaaaattagccggggcgtggtggtacgtgcctgtaatcccagatacttgggagactgaggcaggaaaattgcttgaactcgggaggcggaggtcgcagtgagccaagatagtgtcgctccactccagcctgggcgacagagcaagggtccgtctcaaaagaaaaagaaaaacctcacatgggtaaaactgttaggaaggctcttatctcttcactggtcatgaaatcaacttagtggattatgactagtattttttaaaaagtgatgtagaatagggctgggcgtggtgtctcacgctggaaatcccagcacttcgggaggccaaggcaggtggatcaatcacttgacgtcaggaatttgagaccagcctggccaacatggtgaaacccgtctctaccaaaaaatacaaaaattagctgggtgtggtggcagctactccggaggctgagatgagagaatcgctgaaactgggaggcagaggttacagtgaactgagatcgcaccactgcactctagcctgggtgacagagtgagaccctaatctcagaaaaaaaaaaaaaaaatgatgtagaatagatacaatcagcgggcatttatatagggatggtaagtagttccatcaactttattttatttatgtatgcagatatttatatacacgtgtactaggtcataatgtaaaatgtatcattgtggtctctgtttttgtttttgtttttttcagatggagtctcactctgttgcccaggctggagtgcagtggtgcgatctcagcttactgcaacctcctcccgggttcaagcgattctcatgcctcagcctcctgagtagctgggactacaggagtgcatcaccacgcccagctcatttttgtatttttagtagagatggggtttcaccatgttggccaggttggtctcgaactcctgacctcaagtaatcggcctgccttggcctcccaaagtgctgggattacaagtgtgagccaccaagcccagcttatatcactgtggtctctggtcagaaaggtctggaaaataccaccttagtacaaacacattacatcaacttttatatgtaagatgtaatttagaaaaaatgtcaataatggttttatgacgagactgaaattgcagacatgttcataagcacaatgcttcttttctctttcttgtctttctgtacgtaagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcaggtaatgtttctgtctgggtatgtgtctttttatttggccgttctcggattgctataaagaaatacctgagaccaggtattttataaagaaaagagggttggctcacggttccatagactgtacaggaagcatggtgctggcatctgtttagcttctggggaggcctcgggaaacagagtcacggtgaaggcagagtgggagcaggcgcctcatatggccacagcaggaacaaggggcagggggaggtaccacacactcatttattttttttgagatggatcctcgctctgtcatccaggctggagcacagtggcctgatcttggctcactgcaacctccgcctccccagttcaagtgattctcctgcctcagcctcgcaagtagctgggattacaggcgcccaccaccacgcctggctaatttttgtatttttggtagagacagggtttcaccatgttggccaggctggtcttgaactcctgacctcaggtgatctgcctgcctcagcctcccaaaatgctgagagtacaggtgtgagccaccacgcctggccaccacacacttttaaacaaccagatatcatgagaactcactcactgtcatgctaaaccagccatgagggttctgcccccatgatccagcagtcacctcccaccaggtcccacctctaactttggagattgcacttcaacatgagatttggtggggacacagattcaaaccaaatcagtcccagttcctgcccctgcctgctcatcatccttacattgacccttatggtgtctgatctgatggggattcaggcgaaggctgtagcgggaccagaatcactctagtggaggatctgagacccccacgttgtctgcactgctgccaaacaggccaggaaatgtgtgtcttctgtgtgctaggatgatttagtgagcacatctcatgggaatgcatccgtcagctctaggtttggtcagtaaaaccaatggcagtgcgctcttggctgatgttgccattacagagggtgttgagaaaaggagtccctgggggtgcttctggagtgtcaacagctcctggctgcttagcgtgtcctctcccccttctgctgcttctgcaactcctgataaagtaggtgtgagtcgctatgaatttgcattatcacatcaaaaaatttttttctaaaatattttattgagccgggtgcagtggctcacacctgtaatcccagcactttgggaggccgaggtgggcggatcacctcaggtgacgagttcgagaccagcctggccaacatggtgaaaccccatctctattaaaaatacaaaataagctgggtatggtagcacatgcctgtaatcccaactacttgagaggctgaggcaggagatttgcttgaacttgtgaggtggaggttgcagtgagccgagatcatgccattgcactccagcctgggcaacaagagtgaaactccatctcaaaaaaaaaaaaaaaaaaaaaatatatatatatatatatatatatatatatatatatgtatacacacacacacatatagtagtaaaaaaacacatagcatgacatgtaccatcttaaccatatttaagtgtgtggttcaggggtattaaacacattcacagtgttgtgcagccatcacccccacacatctccagaactcttttcatcttctaaaactaaaactccgagcttcacgttgggctaagtgaaaaagaaacaaaaaaactaaaactctgtccctgtaaacaccaactctccattcccttttcccccaaccttcgactttctgtcttctatgatcttgactactctaatttccgtatagaagtggagtcacagggtatttgtctttctgtggctggcttatttcactttgcacgatatccaaggtttatgttgtagtaagtgtcagaatgtcctccctctgtaagactgagtaatatctcactgtgtgtacatatcacacgttgcttgttcatctgtcagtggacacttgggttgctttcaccttctggctattgtgaacgatgctgctatgaacacagatgttcaattacatctttgagaccctgctttcttctttttttttttttttgagatggagtcttgctctgtcgccaggctggagtgcagtggcgcgatctcagttcactgcaacctctacctcccgggttcaagtcgttctcctgcctcagcctcccgagtagctgggactacaggcacgagccaccacgcccagctaagtttttgtatttttagtagagatggggtttcaccatgttagccaagatggtctcgatcgcttgaccttgtgatccaccgccttggccacccaaagtgctgggattacaggcgtgagccaccacgcccggcccaatttctttgggtatatatccagaagtggaattgctagattttaagtggaattattttctttattttcttttcaaattgttcattgctagtgtttagaaatgcagctgattttgtgtatttatttatttatttattttttcagtctgactctgttgcccaggctggagtgcagtggtgtgatctcagctcactgcaacctctgccccctcgtttcaagcaattctcctgcctcagcctttttagtcgctggaattacaggcgtgtgctaccatgcctggctaatttttgtacttttagtagagacggggtttcgccatattcgccaggctggtgtccaatttctggcctcaagtgatctgcccacctcagcctcccaaaatgctgggattataggcatgagccactgcaccttgcctcatttattaattctaatatttgtgtgtgtgtgtgtgtgtgtatgtgtgtgtgtaatctttaggcatttctacatataagatcatatctgcaaatagagataaccttttttttttttttttttttttgagacgaagttttgctctgtcacccaggctggagtgtaatggcgtaatatcagctcactgcaacctccatctcctgggttcaggcgattctcctgcctcagcctcccgagtaggtgggattacaggtgcccaccatcatgcccagctaattttttgtatttttagtagagacagggttttaccatgttggccaggctggtcttgaactcctgacctcaggtgatctgcccgccttggcctcccaaagtgctaggattacaggcgtgagccattgcgcccggcctcagattttctacttctttgtgatttagttttggcaggttttgtgtatgtaggaatttgtccatttcatttaggttattcatgttgttcagtgttgtagtatttagtattctattataattctctctctttttttaatttttattattattttttgagacggaggtttgctcttgttgcccagtctggagtgcaatggcatgatctcagctcactgcaacttctgcctcctgggttcaagggattctcctgcctcagcctctctagtagctgagattacaggcatctgccactatgcccagctaattttttgtatttttagtagagacggggttttactatgttggccaggctagtctcaaactcctgacctcaggcaatccacctgcctcagtccccgaaagtgctggcattacaggcatgagccactgctccccgctctttttttttttttttttggcgatagagtctcactgtgttgccctggctggagtgcagtggtgcgatttcagctcactgcaacctccacctcctgggttccagtgattcttctgcctcagccttcaggtgtgcaccatcacacctggccaatttttgtaattttagtagagacagggtttcaccgtgttgtctaggctggtctcaaactcctgacctcaggtgatccacccgcctcggcctcccaaagtgctgggattacaggcatgagccaccgggcacgcctggcctttattttatttttctacgttattattcctgttttcagaggagggaattgtcagggaatgaggaaacaggacatgaggacaaggccagatctagggttctcttcaaaagccatgcagatgcatggagacagaaagtagaccggtggttaccaggacctgtcgggagggaggaggaggagtgactgctaatgggtacagtttctttctgagctgatgaaactgtgttggaattagatagtggttatggttacacaatttcgcgaatattttgtatccactgaattatgtactttcaaaggatgaattttatggtattttaaatctatccagtaaaataatttaaaagtttaaaaagtcatggatacgtaatgaattaggaacaaaattcaggtcaggttttaaaatgacagtcacatcagagaaatctttttttttcttttttttgagacagagtttccctcttgtcacccaggctggagtgcagtggcaccatcttggctcactgcaacctctgcctcccaggttcaggtgattctcctgcttcaacctcccgagtagccaggactacaggcgcgcgccaccgcgcctggctaattttttgtattcttagtagagatggggtttcaccatgctggccaggtcggtctcaaactcctaacctcaaatgatccacccgccttgggctcccaaagtgctgggatttcaggtgtgagccacggcgcccggccactaaaaggtttttatggggtatataaagcatgattgttttattttacttttgggtgtgcaacactgtctagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggaggtacctcactcttaaaccctgtgcttgaaacccgtgtctttagcatggatgtggcaatcactatcagtttctgaatcacctaagcagttcacctgaaatgtcattgcattaagtgtgtgatgatgccaaggacagtaatatctgaactaattcgtactcttacctgtttaaagtgactgtacagcctttggtgcagctccaaaagctgcttgacttgataagttttggaataattataacctgtgtttatatggaagcagtttagaaaacaacggaagtggttttcaaaaccattctttttttttagacggagtctcacactgtcatccaggctggagtgcagtggtgccatcccggctcactgtgcttctccacctcccaggttcaagcgattctccttccttagcctcctgggtagcttggattacaagcgcctgccaaccacacccagctaatttttgtatttttagtagaaatagggtctcaccttgttggtcaggctggtctcaaactcccgacctcgtgatccacccgccttggcttcccaaagtgttgggattacaggcatgagccaccatgcccggccttcagaaccattcttgacttacagatgataatttctccagaaatggatattaatttatacatttactgggtgtccatcaagtatcagtccctgttctagggatggaggggacagtgtgcacaagatagacagggctcggctcttaggggagaaacaggacagtcaaaccagtcatctgacaaaactgtcagttgaggccgggcacggtggctcacacctgtaatcccagcactttgggaggccgaggtgggcggatcacctgaagtcaggagttcgagaccagcctgaccaacatagtgaaaccctgtctctactaaaaatacaaaaattagctgggcatggtggcaggcgcctgtaatcccagccacttgggagactgagggaggagaatcgcttgaacccaggaggcggaggttgcagtgagccaagatcgtgccattgcactccagcctgggggacaagaacgagacttcgtctcaaaaacaaaaacaaaaacaaaaaaaactgtcagttgaacctaagtgttaagcagaaaattgtggagtttccctgtctgctgttattaagctcatacagaatttaggtcaggccatggcaaggtaatatcccatattcccaccttctcccacttcctgtggagttgaaagtcagctggccacttctttcaaaagatttttgaaagtcttaattaaacatttttgtcttataatgaaaagatttttctgtagcttttctgcttgttttgcgagcatctgtggccctcctctgaagcccttccagccctttgcagctcctactcaatctcttgctctctctctaaatgccaatctttttttttttttttttttgagagagggtctcattctgtcacccaggagcgtagtggctcaatcatggctcactgcagcctccacctcccaggctcaattgatcttcctgcatcagcctcccgagtagctggacccacagcacaggcgcacacccccacacccagctgatttttaattttttttagagacagggtctcattatgttgtccaagctggtctcgaactcctaccctgaagtaatcctcctggcttggcctcccaaattgcagggattacaggcgtgagccactgcgtctggccttctaagcactgatcttgtgatctccctggacctcagaagacttcctgtttctaggacttcctcagcttccctctcactttattgcttccctggggatctcaccgtcctcctggtttcccaggccttcttccctctacagactcccacgcttcccgttcagacctctctctggtgcctcagatctcttcattgaaacatctccacctggctgtcctgtgaacccctctgcctttcatgtctgagcagagcccacaagctggctttctgtccacccctgcattgtcaggggccgtttcgcctaccccaggctcaagctgggaacccagagccattcttgactttctccttcactcactcctccccatgtcctgtggtcgctaagcctggagggctatgctctcccctcatctccctcccctgccacccacatccctctccttacctgagtcctcatcttttcctgactgtactgtgggggtagtcttgactgcctgccaggcttccagccctgccccatcctctgcaccaccacccaaggcaccttcctaaaacctccctccacagctgcctggagaaggaaatccaaaccttggcccctctcagcctgggcctgggttgcctttcagcccttctggcctgcccgtctccaggcgccgcctccagctgtgccaccccctcacctgagtatgcggcgcagcctgggtgagtcctggagggcaggacacacatctccttatcaccgtgtccttattccagggccttgcccaggacagtgcccagagcttgtcatgggggacccagaatggatcatagtacttcattaaggagcaaacaggtgaaatagttaataaagcagaatgtttagagttacttggtcactgaaatttttggagaactttctgttttttatgttgtatattgcaccaacttgttggctattgggaaattcttacgggacattcaaaggcatgaaatgctttcccttggtagttcctccagcagtgtgaccgggaggatctggtggaattggctctgcctcagctggctcaggttgtgaccgtgtatgagtttcttctgatgaaggtgagtactcttagtgtttctaaatgatagcgggatgattagaagttatttagaaataatattattatttattaattatttttcaatagcctgcatagttgttaattttatttttgagacagggtcttgctctgtcgcccagctagagtgcagtggcaccatcgtagctcactgcagcctcaaactgctggtctctagcaatccttccacctcagccttccaagtagctgggactacaggcatgcaccatcatacccggctaatttttaatttatttaaaaaaattttttttgtagagatgggatctagctttgttgcccaggctggtctcaaactcctggcctcaagtaatcctcctgcctcggcctcccaaagtgatgggattataggtgtgagctaccgtgcccagctcatagttgttttggaaagagccaggccatttggaatcgttttccttttgcaggacagctgaagtgagcctgctggtcacacaccgtgcctggtgtgggggccgctgcctgggtagctgggtgtctcgggcaggtgcccgtttactcccttgacttttaacttggtacaggaggaatggaagtggcagccacaaataatggctatcctgggctctcctagaacccactcgccccagctggcctcttctgcccgcggctctgctccttctgagcccactctgaggctgcagcccaggctgcctgtgccccacactccctctggagctgacagtccagccggggctcagggcctttctgccttcccttcccaccctgtccaggagctcacccatgccctacatggcccccacccagggcttgtttgtttcttggcctgctcctcccatgcccatcctggcttctctgcaccatgcggggcacacagtaggtgctcactggggactgaaggaaacgcacaccactgagggctgctgaggggttaaggaaccgaaactttgtttagattttcttctgtattttccatatcagtgccttgagtttaaactttttttttggtctttatcttcacgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggtaacaatctcccatggcagaaagagttttgctcatagagttagccagaagaaagaagggccacgtgcagtggcttatgcttgtagtcccagtgctttgggagactgaggcaggtggatcacttgaggtcaggagtttgagaccagcctggccaacatgacaaaactcagtctctactaaaaatacaaaaattagctgggcgtggtggcacatgcctctaattccagttattcaggaagctgaggcacaagaatcatttgaacctaggaggcagaggttgcagtaagctgagattgcaccattgcactccagcctgggtgacagagactctgtctcaaaaaacaaaacaaaaccaaaaaaaaaaaaaactccatgtatgaaggagaatgtttttagtaatgacattttcctgttcgacctcattttagctttttcccatcaagtgaaaatttttttttctttttgtttttttgggagatggagtcttgctctgtcacccaggctagagtgcagtggtgtgatctcagctcactgtaactgccgcctcccaggttcaagcaattctcctgcctctgcctcccaagtagctgggattagaggcgcacaccaccatgcccagctgattttttgtattttagtagagacagggtttcaccgtgttgcccaggctggtctcgaactcctgagctcaggcagtctgcctgcctcagcctcccaaagtgctaggattacaggtgtgagccaccacatccggtccccagttttttttttcttaaagcaataaatgctcttccagaaaactcaaaaatgaagataagctagaagaaaatggaaaacaccataatcttcccactcactgatgatcagagttaaaacctcaggtatcattttcttctttttttttttttgttttgaaacagggtttccctctgtctcccagactggagtgcagtggcacaatcacagctcaccgcagcctcaaccttctggtcccaaacaatcctcccacataagcctcctgagtagctgggactaccgccgtgtgtcaccatgcccagctaatttttaaatttttcgtagagaaggggtctcgctgtgttgtccactctggtcttgaactccagggctcaactgatcctcccttataggcctcccaaagtgctgggattacaggcatgaaccaccatgcctagccctgttttcttccttatgtgggtttttggggatggattatataggggccattcatttttgtttgtggtggttccgacacaattctcatttcagtgtcattgttattatcaaattgcctttagctacattggattttttggggtgtttttgtttttttgagacagagtctcgctgtcagccaggcttgagtgcaatggtgccatcttggctcactgcaacctcccctcctgggttcaagcgattctcccacctcagcctcctgagtagctgggactacaggtgtgcaccaccatgcccagctaatttttgtatttttagtagagacagggtttcaccgtattggccaggctggtcttgaactcctgacctcaagtgatccgcccgcctcagccttccgaagtgctgggattacaggcataagccaccatgccctgccttattttcttaaattacatatgatgaaaatgtaaaaggtttttgctaagcctcatgtagatgccctccacagcagtcacctgtgtgttttttaaactcttgagtttagcaagtgtgggtatcatcctgctttgaggcggaactcggcacacacacactgtgcctgccctacagaatccggctttttcagcagctcagactgtgccatcgcctcttgggagcatgacagtggctccgtttgtgaggggacaccatccaggttggtccgcgcagaacccacatggcccgttttctcctttaaccttgttctgccgcccttcctgccgtgcccacccccatctcatgctctgtggggttctctttataacatccatgtataaatgataccagctgtctcttagcactttcacatctggtgtttacgtaggcattgcatatggagtcaaatctcatcttcacaaaagcctttccaggtagctgtaacctcttgtctggataagtcagggagatggacaagggagactcaggagatggtggctcaccaagatcacccaggccatgggcagagaagctgggatccagctcaggcccccaagcccatgcctttttaccagctgggaagggagatctgggtgtgggataggcaggatcgtttttctcaagagaccagtgagaagtcagtaaaggagggatagtgggaaagaaagttactatggtatcagctaacattattaagctcgtgatagcattaaagagagtgttttaaatgttttgtaaagactgttctgggctgagcacagtggctcacgcctgtaatcccaacactttgggaggctgaggcgggtggatcacttgaggccagaagttcaagaccagcctggcaaacatggtgaaactccatctttactaaaaatacaaaaattagccaggcatggtggtgcatgcctgtaatcccagctactcaggaggctgaagcaggagaatcacttgaatctgggaagcggaggttgtggtaagccaagatcatgccactgcactccagcctgagcgacagagccagactctgtctcagaaaaaaaaaaaaaaaaaaaaaaaaaagattggtctcctcctctaaattgtgctcacatagaaccttctagtttttataatccatttttatcatcagctagtccatctaacattatattgatcttcatctttctcattgttgagatggcatctcacagtaggtgaggaactttgtagatttaattctatgaagtcgtttaattcttgcatgtgaatgtgcttctgggggtgtgtgctgtttgggtgaagtttattctcttggcccatttcttttcaggttgctgagtcattaggaatcacagaattcctacggaagaaagaaatacacccagacaaccttggacccaagcacctcagccgagacatggatggggagcagctagagggagctagcagcgagaagagggaacgtgaggtgggcatggctgaagtgggtgccaggtgactgtgcacggtgaattagcgtggtttggcttcttctgttcacaccaggaagaggaggtagcggtttgcctattccttcctattctagctgattgggtcttctcttcacaggctgcggaggagggactggcctcagtgaaaaggcccagaagagaagccctgtccaacgataccactgaatctcttgctgccaacagcagaggccgggagaagcccaggcccttgcatgctttggccgctggtgagggtaaaatgctgtttgtggggtgtatccatggcctggcagccctgctgacatgcacagatgtacccaggattgccatttttcaggttgggtgacctgtgctggatttaaggggaccctctggtttctcaagtttcattccagcctcccagtgttctgtcattccagattcattccctgcgagtcttgaggtcttcagggttttctagagtgccttgttaaaatggagagccacaggccaggtgcagtggctcacgcctataatcccagcactttgggaggccgaggtgggcggatcacctgacgtcgggaattcgagaccagcctggccaacatggcaaaaccccgtctctactaaaaatacaaaaaaaactagctgggtgtggtggcgtgtgcctgtaatcccagctacttcggaggctgaggcaggagaattgcttgaacctgggaggcaggaggttgcagtgagccgagattgcaccactgcactccagcctgggtaacagagtgagactccatctcaaaaaaaaaaggagagccaccaaatggtagtaaacaggctataccaggagggtcccaagaggttaggctgagacgggtcccaggacacatccatctatggcttggctttcatgagacttcgctgtacatgccagctgagatttaacatttgaaaacaagacaggtcctggcttttattctggctctagccagaacctatcaactaggcacttaaaaaattatatatataaattttttttttgagacgggagtcgcactttgtcacccaggctggagtgcagtggcacaatctcggctcactgcaacctctgcctcctgggttcaagcaattctactgactcagcctccccagtagctgggattacaggcacccgccatcatgcccggctaatttttttttgtatttttgtagagatggggttttaccattttggtcaggctggtctgaaactcctgactgcaggtgatctgcccacctcggcctcccaaagtgctgggattacaggcatgagccactacgccagcctttttttttttttttgagatggagtcttgctctgtcacccaggctggagtgcaatggcatgatctctgctcactgcaacctctgcctcccaggctcaagcaattctcctgcctcagcctcctgagtagctgggattacaggcgcccaccaccacatctggctaatttttgtatttttagtagagatagggtttccccatgttggccaggctggtcttgaactcctgacctcaaatgatctgcccgcctcagcctcccatagtgctaggattacaggcgtgagcagccaccgtgcccagcctgatggtgattcttaattggggcatgtgttggaaccacctggggaggttattgtgaaatacaggggcctggacctctgggaattccaggtctgcaggtagggttgttgggagggtgtggatgtgagtatttggaaaggcctctttgggtgattctccagctcactctgatgaagaatcaccaatcattcattcagtattggcataaaatcactgttgctgggtgtggtggctcatgcctgtaatcccagcactttgggaggctgagtcgggtggctcacaaggtgaggagtttgagaccagcctgacctacatggtgaaaccttgtctctactaaaaatacaaaaattagctgggcatggtggcgcatgcctgtaatcccagctatcaggaggctaaggcaggagaattgcttgaacccaggaggtggaggctgcagtgagctgaaatcgtgccactgcactccagcctgggtgacagagcgagactccatctcaaaaaaaaaaaaaaaaaaaaagcacactgtcgattggctcttagagcatatttttaatacaaaatctgtctttgtgaatagagaatagggacgtattttttaaaattgctaccaatcccaaggagcaaggagcatcgatgctttgacttttctgcagggcaggtgacttggcctagctggttttgggtggtgagtgcagtgagtgggccatgacacagtacacgccatgttcacctgtttcccaaaatgtttaggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaattatttttgagaccaagtcttactctgtagcccaagctggagtgcagtggcgcgatcttggctcactgcaacctctgccgcctgggctcaagcgattctcgtgcctcagcctcctgagtagctgtgactacaggagcatgccaccatgcccagctaattttttttttttgtattttagtagatacggggtttcaccatgttgcccagggtggtctcaaactcttgagctcaggcaatccgcccacctcagcttcccaaagtgctgggattacagtacaggcatgagccactgcacctggccaatgatttttttttttttttttgagatggagttttggtcttgttgcccaagctggagtgcaatggctcgatcttggctcaccgcaacctccaccacagggttcaagcaattctcctgcctcagcctcccaagtagctgggattacaggcatgtgccatcacacctggatcattttgtatttttagtagagacggggtatctccatggtggtcaggctgatcttgaactcctgacctcaggtgatctacgcgcctcagcatcccaaagtgctgggattataggtgtgagccactgcactgggcctgattgtttttttttgagatggagtcttgctgtcgccaggctgaagtgcaatggtgcaatctcggctcactgcaccctccgcttcctgggttcaagtgattctcctgcctcagcctgccgagtagctgggactacaggtgtccgccaccacacccggctaatttttgtatttttagtagagatgaggtttcaccatgttggccaggatggtctcgatctcttgacctcgtgatctgcctgcctcggcctcccaaagtgctgggattacaggcgtgagccactgtgcccggccccggcctgatttttttttttagagatgagttttcactctgttgcccaggctggagtgcagtggtgcaatcatagctcattgcagcctttaactcccaggcttaagcgatcctcctgcctcggcctcctgagtagctgggactacaggcgtgcgccacggtgcctggctctcctcacattttacagatgaggaaggtgaggcataaatgatggggtgacttacttgaggtccacagcaagatgctgctcagggtagaagcccagttctttgatgtcccacttggaaagtcacttagtggcatgtcttcaatatttccgtgggctgtgttacggggaaggaagggaagggccatttgtccacatgtggaagaaagcattcaaagggagcagcaggtctctccccacgccttgcagagacggtcaggagagaccccaagcagagagcacgctgctcagggacagagctgggcttgtgaccatgtgtcgccctggcgctgtgctccttccaggtcctgccctggagggcagctgtattctcagagagccagcctttcctacagcccttttagtgaccaggggcatttcctaccctcacttgatctcaaagccacggtcggtaggaacaaaaaggtgggttttctagcaggctggaaatggccagcaggggagcaagccgcggctgcctgggagtgttgggtggtcaggtcaggctgtagatgtatcctgtagactcaaggccgcttctcaggagtccagagtcccataaaccaccatgagtgccctcctgggatcctggagatggagacaagagccctgaggatcattcataaccactgtcaggtaactgacacaacatgctgactcgagtatgaccatggtctggatgaggccctggtaaatatacatttattttctatctataggacactagtgaatatcccaacacatcttagtttcaccactgtgtatgtgctactatgaatggatggtcaatgtaactgatgtaaaaaaaacctacaacaaataaacctttgttccaccagacagaattgaagacacaggaggctctgagagcagtgtcctcatgaatcggccacgtgcctgtcgagtgctgctgtgtgccaggcacaggactgacggcagtgagggggactcatgggccctactctttgggagccctgtgccttatcctctcttccagcttggcctttgcagagttccccaatacagcatagagacagatgtatgcacagcttccacattacaacccccttctaatagacgtaacctaggaggctgaggcgggaggatcgcttgagcccaggtgttcaagaccagcctggacaactccgtgagaccccatctctactaaaaattaaaaaaaaaaaattagcccagcatggtagtgcacacctgtagagaaaaagaaagaaaaaaagacagacataaccttatttatgaaagaatgataaatggaaatttccttttctcatgaagaactttgttttgtatacatagtacttttaatttcaaatactcagattaagagcaagtgtgaagagacattagagtacagaccgggggacaaggacacccaaatgactcccaggggtggctggctggggcttcaatgaggacacgtggtttcagcatttgtcatgatccctggcacctggtccatgttcagttattattactaaaggcaaagaaagaaaattcccttgtgttccctggaaaccatgaggattcctgtggctgcaaccctggttgggtacccctggtcaggcacccacggcactgcagccctggcacctcccaaatggtcacaggagtggggagagctgaaccagcaggaaagaaaggagccagggcagagtggatctttaatgccctctgaggcactttttttttttttccacagggctttgctctgtcacccaggctgcagtgcagtggtgcagtcgtggctcactgcagcctcaatgtcccaggctcaggtgatcctacctcagcctcctgagtagttgggaccacaggcatgcaccatgacacctggttagttttttgtattttttgtagatgttgcccaggctggtctcaacctcctggtaggctcaagcaatctgcttgcctcagccaccaaagtgctggaattacaggtgtgagcccgtaatgactcatgcctagccaggtcatattattatcattattattattttttgaggtagagtctcgctgtcaccaggctgaagtgcagtggcacgatcccggctcactgcagcctctgccttccgggttcaagggattctcctgcctcaggctcctgagtagttaggattacaggcatgcagcaccatgcccggctaatttttgtatttttagtagagatggagtttcaccatgttggccaggatggtcttgaactcctgacctcaggtcatccacccaccttggcttcccaaagtgctgggattacaggcattgagctagtgcgcccagcctaatttttgtatttttagtagagatgagatttcaccatgttggccaggctggtctcaaactcctgacctcaggtgatccacccacctcagcctcccaaagtgctgggattacaggcatgagccactgcatccagccgatagtcagatcttaataaatatagcaaaggcagaggaaagagaaatcctaagaaatgttgcctttaaatgcttttggccaggcacggtggctcacacctgtaatcccagcacttggggaggccaaggcgggtgggtcacctgaggtcagtagttcaagaccagcctgaccaacatggtgaaaccccatctcactgaaaatacggtattagctgagtgtggtggcgcatgcctgtaaaaatcagccaggcatggtggcaggtgcctgtaatcccagctacttgggaggctgagcggggagaatcgcttgaacccgggaggcggaggttgtgatgagccgagattgcaccactgcactccagcctgggcaacaagagcgagactctgtctcaaaaaataaataaagttacaatagtcttaataaacttagataaatagtatttatagttaaatactaaaatgacacaattaaaaactatacttggccaggtgcagtggctcgcacctataatcccagcactttgggaagccgaggcaggaggatcacttgaggccaggagttcaaggcaagccagggcaacatagtaagacccccatctctaaaaagtaaaaataaaaaaattagccggacgtggttatgcacacctacagtcccagctactctggaggctgaggcaggaggatcacctgagcacaggagtttgaggttgagattacagtgagctacaatcatgccactgcattctagcctggacaacagagcaagaccctgtatctaaaaacaccaacaacattattgctgggctgggcagtgcatgactgtagtctctgaggagactaagtagggaggatcacttgacctcaggagtttgacactacttgggccacatggtaagagcctatctcataaaaaccaaaaaactaaaactgctgtttattaagtatcactctatacacagtcccacagaatataaacagtttgggatcagagaacttacaaaaaggcaaacgcagatgtagaaaccatgtaacaagtaatgccacaaaaaagagtttaggcttttgcaggctcggcgcggtggctcacgcctgtaatcctagcattttgggagggcgcggtgggtggatcacgaggtcaggagatggagaccatcttggccaatgtggtgaaaccccgtctctactaaaaatacaaacattagctgggtgtggcggcgcgtgcctgtagtcccaactactctggaggctgaggcatgagaatcgcctgaacccaggaggcggaggttgcagtgagcttacatcgtgccactgcacaccagcctggtgacagagcgagactccattaaaaaaaaaaaaaaaagtaggcttttgcataccttcacattctccccatgccctagcttttggccagtctcttcggtctgtttcaaaactgtcacctttccctcattctaacctagtatgttaactctggaaatggctgcaaacattgtgaaactcgaggatttgtgtcagaagaatgccagggaaggcagtttacatcgcttgccatgtccccagtatgcaaacagcggcaatttttttgtaggttattttcattttcatgatgtcaaacttcattttaactccatgggatcttattatttaagacgaagtctcactctgtcgcccaggctggagtgcaatggctcacagcagcctctgcctcccggttcaagccattctcctgcctcagcctctcaagtagctgagattgcaggcacgcgccaccacgccagctgatttttgtatttttagtagagacagggtttcatcatgttggtcaggctggacttgaattccgaacctaaagtgatccgcccacctcggcctcccaaagtgctgggattacaggcatgagccaccgcacctggcccaaaaactaatatagtctcataaaaacttcaacaatcagataggcataaagtaaaaatattaaaccagggattttctacacaaacataatgtataaagcatgcctaatttatagaaactagatcactcactcattctgctcagaaactcattgattttactctgaagcacccacgaatgacagattcccaggaggggcagagaaggctgagcagcaccacgtggggctggccgcgggttgtgggcatgagcacgcctggagaggccatggggctggtgacaagctctggccagaagaccccaaggtctgatcctggggtctgatccaggcctgcggcactgggtcctaggcagactgtctgcctggtgagacgtggaaggagccagtgtccgcagccgtctcaggacgtcagagagctcggtggcctgtctccagcagcatgctctccagatgcagcctgctgtcgctctccacatagggctggtgcagccacatggacaggtagctcagggtgaggtcgggatccccggtgtgggcaagctccttggccaccgtgcgcttcaggagcagctccttcctgtacatctccaagagcttatgcgaaacctcatctgaaagaaacgtgaatctcccttaatggcagtgattcaagaacatagtgtcgacttgggaagaactacattttaacagctcttgattaaaaaccagaatcagcaacagcactgaggggaagaagggcccgatggagtttactactctagctggtgcagattagtacaatttgataacatggtcagcagagtgaaataaaaagtgtatacaagccgggcgtggtggcccacacctgtaatcccagcactttgggaggcccaagtgggtggatcacctgagttcaggagtttgagaacagcctagccatcgtggcgaaaacctgtctctactaaaaaatacaaaaactagccaggtgtggtggcacgcacctgtaatctcagctacttgggaggctgaggcacgagaatcgcttgtgcctgggaggcggaggctgtagtgagccaagattgcaccactacactccagcaggcgtgacagagcgagactctgtctcaaaaaaagtatatataaccttttctacttgactcttaggtgacctacagtgattatcagtaggagattcccctcaaactgacaatatttcactaaacacattccactaggtgattttaccctttcctgccttatttaaaaagtctcaggtcaacatcaaatagcttacccttgtcttgaactaataaaagctaaaagtaaccctttaagaagcgcctcatagagtttactgaagccatgggtttcatttttcccagtcatcttccatgaggttggctgcagtgaccctcaatttgttttttaattaaaacaaaaaacaaaagaaaaacctcaacaaaccaaaaaaactcctttcttcctttccccccctcaaaatgagagatatctgcttccacagaggaggtggaattcactctgcccattggttttagaggcctaataacagcagcttgcttcacgggtctctatgtttcatatactctgctgataaccaggtaattaaagccaagaagaaatgtttaagatgcctctgtctcctttcctcccgatacttttgcattgaatttgaaagccttgtcagcttcttaaagtaccagatgtaaacgatactaaatgcccttaataacctttaccctcctgaaaatcaactgagaaggaactacttacagaaatgggttgtaggccacgtgtggaacagagggggtcgtttactctcctccccataatggtagttttctagttcacaaattcccttggtagttgaagacagcttttccattttcacctgtattttggtctgaaagatatccatttggaatatgataatattatttgaaatctccagtctcagatttaataactctaagatttcaaagctaagaagtgtaagtctattatgataaaaattccaataactaaacactgttaactctacgtacagcaaattcccagggagatgaaggtggacagttgctatgatttcattaatttgaatgactttggtaataaaccccagatttccagtcctagagcaagaaaggtttccgagtgccatttcactaggatttccaaacagcattaatgtcttagacccaaagacctggaggaatcccaaggcaggctcttgctgcctttttttttttttctttttttttttgcgacagggtctcattctgtgtggcatgatcatgccttatgcagcctcaaccgctggcacctcagcctcccaagtagctgggatcacaggtgtgcaccaccacacccagctaattttttttaatttgtggagacagggtctcgttatgttgcccaggctggtctctaactcctgggctccagcaatcctcccgcctcagcctcccaaagtgctgggattatacaggcatgcgccaccgcgcctggctggctcttgctgcttttaagaagtgagagagaaaggcatcaaatgagctcgtttctgatgctctctctctctctcttttatcaaatgagctcgtttctgaggctctctgtctctctatcaaatgagctcgtttctgatgttctctctctctctcttttttttttttttttttgagacggagtcttgctctgttgccaagctggagtgcagtgccaggctggagtgcagtggcgagatctcggttcactacaacctctgattccctggttcaagcgattctcctgcctcagcctcccaagtagctgggattgcaggcatgtgccaccacgcccagctaatttgtgtatttttagtagagacggggtttcaccatgttggccaggctggtcttgatctcctgaactcgtgatccgcccacctcggccgcccaaagtgctgggattctaggcatgagacaccgcaccaggcctgactctctcttattaactgcctttatttacggaaacctccttgacttccttgtttataaaatggcaacacagaaagggagccctacacacttcacgcagaaaggaaggaaacgtggcaagctgccattgacggtccctcagtgtggaccaggctctgtcctaagccctgtaactgcatgatgtgtatggctacttgtgggagacactaaaccaaccccactgcacacaccaggcagcacagaataggggcaatggcgggcttactttcacagcttggtgaagaggattaagtgagttagtatttgtgaagcacctacttggagatatataagggttggataaagaaaattaatgggtgaagtaactaggatttcagatttaagtagcataggtctataaagaccaaattttgaactcctaagtatagttgactttacatacataaatatgaaaaaggggaaataagaaaagatatataaattgtcaaatatcttaattcctttacttggtccttccaaccaccctccaattacattggaagtggcaagcactaaattcagctaacgttaatttttaaaggactttacttaagtagtttcccaaatcttttaaggtttgatattttatttggcccaaccccaagaggcaggacttgtcatttccgtttcacagctgggaaattgcttaaggttgagctgaggaaggatgaggccagaactcgataccatgccttctgacaccaagtttttttgtttttgtttttgtttttgttttttttgagacagagtctcgctttgtcacccaggctggagtgcagtggcgcgatctccgctcactgcaacctccgcctcccgggttcatgccattctcctgcctcagcctcccaagtagctgggactacaggcgcccgccactgtgcctggctaatttttttggtacttttagcagagctggggtttcactgtgttagccaggatggtctcgatctcctgaccttgtgatccgcccacctcagcctcccaaagtgttgggattccaggcgtgagccaccgcgcccagccgacaccaagttttaacacccaatcctctgctctttcctgtgagtcctgcagcagctccctggtgccacctgattctaagaaaagctgataacaggagactaaggaaaattctggagccttgaccccaggcaagaagtcatgctcaatcctgcagctcagccatcaataaagaattcaagtcacataggcacgtgcagccctgaatgaacagtgcataaacagcaggcccttacatttcaacatcggtggcttcttcccacagcaaacacagaccacagtgaaatgttagcccagcttaggaagaacggtgcatgaaacccccagaaggtcaaagttatgaaagacacagaccaggtctggaaaccattctctataacggatagaggaaaataggaaaaataataataccctataaaatcaacttttggttttgaacatagaatgagaacttattcccaaaccacttttctttttctttttttcttttttttgacacggagtctcactctgtggcccagactggagtgcagtggcttgatctcggctaactgcaacctccgaaagtgattctcccgcctcagcctcccaagtagctgggattgcaggcacctgccaccacccccagctaattttttgtatttttagtagagatggggtttcactatgttggccatgctggtctcaaactcttgacctcaggtgatccacctgcctcggcctcctagagtgctgggattacaggcatgagccactgcgcctggccaaaacaaaaattaaaaaaaaacaaataaaaatacaacaattagctgggtgtggtggcaggcacctgtaatcccagctacttgggaagctgagacaggagaatcacttgaacccaggaggcagaggttgcagtgggcagagatcaccccactgcactccagcctgggcaacaagagtgaaactccatctcaaaaaaaaaaaaaattaacaaatgggagggagggaacaaatctcccacgcagaataattccaaataatttatgtagatactgcaccctcaagcaggtggtgaatacgtccctacccccaggtgtgggctatgcatagtgacttcctgccaaagagcacagcgtgggaggaggagaaagagcaacgtcacagcagaggaacctggaaacactgcccagccaggtgatcaaggtcaacttcagcagtggaaagtcctggctgtgcacagtggctcacgcctggaatcccagcactttgggaggctgaggtgggagcactgcttgagcccaggagtttgagaccagcccgggcaataggtgggacccaaagaaaagtcctgatgacagtatatccagtacgtgcccttgatatgacatgatagaaatggcactttacttctgtggtcctcctctgaacaaaacccgtaacctcagtctaattaggagaaaaacatcagataaatctcatgatgttctacaaaatacctgaccagtatccctcaacattgtcaaagtcatcaaaaacagggaagtctgagaaactgtcacggccaaaaggagcctgaggaaacaaggggactcgatgtcatacaggatcctgaagccaaaacaagacatgacggaaaagctaaggcagggcgccagggctcacacctgtgatcccagcactttgggaggccaaggtgggaagatcacttcatgtcaggagttcgagaccagcctggccaacatgagaaccccgtctgtacaaacgaattttaaaaattagccgggcatgatggttcatgcttgtagtcccagctactcgggaggctgaggcaagaagatcacttaagcccaggaagtaaaggctgcagtgagctgtgatcatactactgcattccacagcgagaccttgtctccaaacaaacaaaaaggtgaaaatataaagatcttaaatgtttatgggtaagcttcagttatccaagttcaaatatgtgtaaaacctgatttcctgtgcctagcaaagaaataaggtggtgttatcttcacatctggtggccagtatggtaggtattgaaatttagttattagttcattaaacaaacactttagtctcttacgtgctgtatcagggatgggcaaactatccctggaacacaggtcaattctggcccatagcctatttctgtatggcccataagctaagatggtttttacatttttaaatggttgaaaataaccaaaaggacaatagtgattgtgactcataaaaattatacaaaattctaatttcggtgtccaaagataaagatttcctggacgaacatggtggctcacgcctgtaatcccaacactttgggaggctgaggtgggtggatcacttgaggccaggacttcgagaccagcctggccaacatggtgaaaccccatctctactaaaaatacaacaattagctgggcatggtggcgcacacctgcgatcccagctatgtggaaggttgaggcacaagaattgcttgaacccaggaggcggaggttgcagtgagccaagatctcgccactgcactccatccagcctcagtggcagagtgaggccctgtctcaaaaaaaacaaaaacaaaaacaaaaaaggccaggtgcggtgactcacgcctgtaatcccagcagtttgggaggccaaggcaggctgatcacttgaggtcaggagttcgagaccagcctggtcaacatggtgaaatgctgtctctactaaaaatacaaaaattagctcatgtggtggcacgagcctgtaatcccagctacctgggaggctaaggcagcagaatcacttgtacctgggaggcggagtttgcagtgagccaagatcatgctactgtactccaccctgggtatcagaatgagactccatctcaaaaaaaaaaaaaaagaaaatccaaaaaacaaagataaagttttcatggaatgcagccacatccatttacgcatatattatctatggctgtttagtcctatgtggcagagatgagtagctgagatagagactggctggccctggaagcctaaaatatttactctgtggctgggcgtggtagctcatgcctgtaatcccagccctttgggaggccagcaggtggatcacctgaggtcaggagtttgagatcagcctgaccaatatggtgaaaccctgtctcaactaaaaatgcaaaaattagccaggcatggtggcggacgcctgtagtcccagctactctggaggctgagacaggagaatcgcttgagcccaggaggcggagtttgcggtgagccaagatcacgccattgcactccagcctgggcgacaaagcaagactccatatcatggaaaaaaaaaaaaaatttactatgtgatgagccctgaaagtgggtgacatttccccggatgacgcacaggaggagtgagtgtctaagacagcatcttggggaacattaaggtttacgcagcaggcagaggaagagaacatcagaggagactgagaaggagtaagtgatggccaatggtcaagcaaaccccaaatacgtccatcggattcagtgacagtgaccacaagtggcctgcgtctttatgtcttaccaacccatccaaggtggcctgcagttcctcacacagcttctccagttcctcgttatattccagacacaccttttcttcattttccttcgaggctgggctgctgctgtctagttctatcttgtctttattcctaaacaaaatagaaaataatgtgtacaaaatatactctttaagcttgccttatttccttataataaattctacaaacctctatatccacatagttacgtgggacattttgcataagcattgttctttcatatcattatgatacaaatgcagttattatttatatgtgcaatgaatatgtccattggtcactcaattttgcaccaaaataagtcagttaaattcagccatgtgacagccggttttggtggctcatgcctgtaatcccaacactttgagggatggacgcgggaggactgcttgagtccaggagtctgagtccagcctgggcaacacagtgagacctcatctccacaaaaattaaaagtaaaaattagctgggcatggtgggacacgtatgtggtcccagctacttaggaggctcaggtgggaggatcacttaagcccaggaagtcaaggctgcagtgagccattatagcaccactgcactcagcctgcacaaaagagcaagactgtctcaaaaaaaaaaaaaacaccattcagcggtgtggcatccttggcatagggcatggtgctggatgtacaaagatgaataagacatggatcatttcctcaaagagttcacaatccaggaatataggcacgcctcattttattgtgcttcaccttattcagtttcatagataatgcattttttacaaattgaaggtttgtggcaaccctctgtatgtagagcaagtcaatcagcaccattttgccaacagcatgtgcttacttcatgtctctctatcatattttggtaattcttacaatatttcaaactttttcattattatgtctatgatctgtgattggtaatctttgatattgctagtttaattgttttgaggtgccatgaaccatgtgcatatataacggcaagcttaatgaatggatgttgtgtgttctgactgctccactgaccggctgctcccctttctccccatctccttgggcctccctgttccctgaaataggaggatactgaaatcaacccaattaatagccctacattggcctctaagtgtacaagtgaaaggaagagttgcatatctctcattttaaatcaaaagctatactttggccaatttaagaaacaaaaaaattaaaagctagaaatgattaagcttagtgaggaaggcatgtcaaaagctcagataaggggccaggtgcggtggctcacgcctgtaatcctagcactttgggaggccaaggcgggcagattgcctgagctcaggaattcaagaccagcctgggcaacatgtgaaactccgtctctactaaaatacaaaagaaattagctgggcgtggcggtgtgcacctgtagtcccagctacttgggaggcaaaggcaggagaattgcttgaacccgggaggcagaggttgcagtgagccaagattgcaccattgcactccagcctgagcgacagagcgagactccatctctacaaaaaaaaaaaaaaaaaagctaagataagctgaaaaccaggcctcttgtgccaaacagttggccaagttgtgaaggcaaaggaaaagttactgaagaaaattaaaggtgctactccagtgaacatgtgaatgatgagtgaaacagccttagtgtggatatggagaaagtttgagtggtctggatagaagatcaaaccagacacagcattcccttaagtcaaagcctaatccacagcaggaccctaactctcttcaattctgtgaaggctgagagatatgaggaagttacagaagaaaagtttgagatagcaggatttggttcatgaggtttaaggacaaaagccatctccataacataaaagtgcaaggtgaagctgcaagcgctaatgtagaagctggagcaagttatccagaagatctacttaagatcagtgatgaaggtggctacatgatacaacagattttcagtgtagatgaaacagccttctattagaagaacatgccatccaagacattcacaactacagagaagtcaatgacaggcttcaaagcttcaagagacaggctcaccctcttattaggggatattgcagttagtgactttaagttgaatccaatgctcatttaccattctcaaattcctagggcccttaagaatgatgttaaatctactctgccagtggaaaaagcaagagaaccagaactggaagtggggtctgaagatggaactgaattgctgcaatctcatgagaaaacttgaacagataaggaattgtttcttatggatgagcaaagaaggtggtttcttgagatggaatctattcctgggaaagacactgtgcacactgttgaaatgacaacaaaagattgagaatattatataacttagttgataaaccagtgtgagaggtctaatgtgggtaaacactattaaacagcaatgagaaagaacagaaccagaatagtggctctacattacacgcatggcttccatgttgaaagacagtgagacatggctgggcgcagtggctcatgcctgtaataccggcatttagggaggccaaggtgggcagatcacttgaggtcaggagtttgagactagcctggccaacatggtgaaactctgtctctactaaacatacaaaaattagccgggcatggtggcaggtatctgtaattctagctactcaggaggctgagacaggagaaccacttgaacctgacaggcagaagttagagtgagccaagatcacgccattgcactccagcctgggggatagagtgagactcgtctccaaaaataaaaaataaaaaatagaaaaagaaagtgagatataaaggaaacaataacatatgttttttgtttacgtaaaatccaaaaatggatgaaaagaattcatggtagttttttccatatcagctaggtaatgtgccaacatcatagcaaagtttgaggaaggcacaggtcatacatgagcatgaaaacccaatcattatgcctatgaactacaaaagaatcaaagaatctgtggttttaaaaatcagaatagccaggcacggtggctcacacagcactttgggaggctgaggcaggtggatcacgtaaggtcaggagttcgagaccagcctaacatggtgaaagcccgtctctactaaaaatacaaaaattatctgggtgtggtgacgggcgcctgtaatcccagctactccggaggctgaggtaggagaattgcttgaacccaggcggtagaggttgcagtgagctgagatcgcgccatcacactccagcctaggcaacagagtgagacttcatctccaaaaaaataaataaataaataactaaatatatatatatatatatatatatatggaatataattttgtatttaaaatgtacaatacaatttatacttacacgtatcatcttaccacttgctttttttgcttaatattttattttaaaatttattcacattatttccccagttattaagggtgaaaaacttagagcatgaaaaaccaatatgtacttacaataaactgattttcaagttggcaatattatttgcagtggtaaaacctgcatcattgagggtttcccacttcaggattaaattgtgccaatcagccgcattgtccttaatttttcttgcactgacagataagacaggttttctgggcgttacagttccaagagtctttgctgatagggtataaaagaaacaaaattattatcatggaatatacaatcatagttggagggcaaatgtccttataattttcaacagtaaaactatctgaaatgctgtatcaactggacaaataaatgtggaaactacaaagtctgaatgaatgtgaaagttcctggaagaagacaatatagaatatttttaacattttaaaattcaccagatagagctgaatcctcttccagcttaatggctccacaaagtttttaccttaagccctttgttttccaaagattggaaataaggtaaagttgtgactgtctgctaaaactcttcaatggctcacgttcccttccctacaggataatctagccctgactcccgagtacttccactatctagtctcaggcactctgatactttaaatttgctcagagtagcgtggcccatgagtgctaatcatttcaagacactgagacaacagagatgcagagttgatcacgatgctgccactgcccttcttggtaatcaggaggaagtccaaaatccttccagacctagctacccctccacatcatcacgtacatcaacccacaccttggccccccgtcaatatccagcgaaaatgaactactggcagctcttgaaaagctgaggtgcctgcaggcctttacacgtgttctctctgcaggaaagctccttccttcctcaggctcacgatgcccatcctccaagatgcacccggatcccactgcctgtaggaagcaacccccagaccaccaagagccaactcaggttgtttgttctccccgaaccctcctgtgccctcttgccttctctactttgaaccccacaaaggcttctcactgcccacaggataaagtcctcttgaggaatccaggacacacaacagctggatggtttgatgcctcaagtcagaagaccacactgcctgcgtctgaaccccagctcgccagctgtgagatcttgggcaacttaatgtacctttcagagcctcaacattttcatctgtaaaatgggaataaaaatagtatctatttcataggattgctgagattagataatatatgtgaagctgtgaggcctcgcacaaggcaaaaacccagtatctcacctgttagctcaagggcctctactatccaagctctgcccaccacttcagcttctaccctttcccacttgccctctgtgcatcagagctggctctgtacaagttctgactttgacctggaatatttttcctatctgtgtgtgtccccactcccctgcctcatacttagtatcctcactttaaaatatcatcttgatttatcattcattctttacttaaacaacaaatatttgcttactgcctacaatacgccaggcatgggggaatgaagtgattgaatgagacggaccaggaccgttttcatggaacttactttccaaaggggaggcagataataaacaaatgaccacgatcagttcagatcatgattaagtgtgtgtggaaaataaaacagggtcttgtgttagtgtgatcccctgagaaggtgtcgtttaggctgagatttgaatgatgaaaagccagaaatagggtaggtcagtagtatgtgccctaattatgataatgaggttggtgagttcaaaaaacagaaaacaaaacaaaacaaacaagcaaacaaaaaaaccagtgtgctggaatgaaatagacagaaaaggactagtgcgtgagtaggtgatcagacaactagaacctaataggccaagataagaagttggaccgagggcagtggctcacgcctgtaatcccagcacttcaggaggccaaggcgggcggatcacgaggtcaggagatcgagaccatcctggctaacacagtgaaacctcatctctactaaaaaaatacaaaaaatcagccgggcgtggtggcgggcgcctgtagtcccagctactcaggaggctgaggcaggagaatggcgtgaacccgggaggcggaacttgcagtgagcccagatcgcgccactgcactccagcctgggtgacagagcgagactccgtctcaaaaacaaaacaaaacaaaacaaaacaaaacaaaataaaaaaatgaagtttggacttctaagtattagcttggtgcaaaagtaacagattttgccattacttttaacagccaaaattgccattacttttgcaccaacctaatacaatggggagtgagcaatgagctctggatagggcagtgaaattatctgatttaggtttttagaaagtcatttccacagagaagtattcctggatcccccaggttgggttacgactcaccactagatatgtggtacaccctataattctgctatcatgatattcaccagtggagtgtatttgcttgtttaatgtctatattccctgctaaactggaaattcgactagggtaggaactatgtctcgttctctttcaaaccttccacacataggaggctttgcataaaatgaggtaaatggaggaatagctcttaccacctgttctataattgtctaagggttttccccccaacaggagattctgagggcaggatcacatctgattcatggtcagcctgactcatacggggcacatatttaggaaccaaaaacataactgacttcaagaaactcaagggctggtaaagacagaccagtcatcagcgtcacaggacagggtagggtgagggcacagtggctaagttacttatcccctctgagcctcgattccccatctgcaaaatggggttgacattacttcatgggaccactgtgaggttcaaatgagatgatccacttaaagtgcttggagcagtactcagcaaactgagcactaggcgaaagccagctttcattacaagcagaatgttctgactgagggcagttcagagaggagtttctggacgagatgagcatgcaaggcttggtacccagtgaactctgttagtactaatttatagtgacaataattacaatttggatgtcggatctgctgacactcatttgcgtatatcgtcccgttcatctgtcactgcacatgtgaaaaaacggaggctcggcaaaactgtctcccgagcagctcgcagaggctgcgaggggcctgcgggctaggctggggtaagacagaggacctccatttaacctcatgtaatccggggagctcctgagcttctggtccaacctgcggcctaagcagtaacattcacagccaccccaccccgggaaaggaaccgatctcacgcaccttccataaggtccacagatatccgtagaaggagacgcgaagccccgcccaccccaccggaaacgcatttgcgtcacgtccgccccgcccgctgccacttgtggctctgccgctctagcccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggaggtgagtccggcgacgccgcaagcggccccgacgcccccgacgcccccgacgcctggccccgagcccctcctcggcctcccccgggccactcttcccttgcctcagccccgcagggtctccatgcccgtccgccccgtctccctcgcccgcggtctcgcccgcgcggagtggcggacactaaatgccacaacacacggagcgcctggctcgccgcccgcagaatccggcggtccgcagcggggaacaggggccgcccgcccctcctcaggcctccgctgcgcgtcccgcgccctcggcccccggccccaccctgcatcccggctgccggtctggccgcgggctctgctccttcgccttaagattgacgtcgtgttctgtcccccactcgcagcccgcgtcccttacatccgcccaccggcgcctggccccaggccttgacactcatccagttggtgttcagtgttcgatgagtggataagtgaatgactcctttcccaatcctatttgaaggcatgggaggcagaataggtagtaagtgttaaaggatggggtgtcctggagtcagagccgggcaggtcccagcggccccttcctagctctgtgctggggcaagtgccctacctcactccgctccagtttcatcaccagtggaatggagatgagaatagtttctacctctggcttggtaagaggattaaatgggtcagtgcatgtaaagttaagcacggtgcctgccgctgtacatttcagtaaaggggagcccctgctgtcatctgtgctagcctgcgttctcgccctctagtcccttctgatatgtctctgacttctcatgactttagtttctccttctctacctccatttctcttccctgcacttttttcttcctctcttattgggattcaggaattttattctgttctgtgacttatgttccatgtgttggcagaatgtgggataccagcctgggtgcatccttttctcatctattggagtgaccagttgcacttgtggactgcctccttgcagccaaggtcttgtagacagagttctgggaaatctcaaaacgcaaatcccaggcataggtagaatctgggaatgaagccactgtagctccttgtgatcaccagcgattcctggtcttttaggctgcaggactttgtgttttctcacacccagctataatgtaccttgataaacctctgaccttatttttgttgttgttgttgttaacctgacttacgtcccatattggtggttatttggccatcgtgtgccagcactgtgccaggctggctctagggatgctgtggtgaaccagacagacccttcctgaggtcactgcctcagaaagatcatggtctggcccatgaactttaaaagggagaactaagtgcaggtgtaggggacacacaaattgaattttcaggactgccttggaaaaccagtggtggggaagatggaatgaggataaccctcttctgaaggagtgactaggaagtagcttttgttaggcatcagctatattatacccacgtgtctttttcaatagaagactggcatctactggatttttttttccaattttttcttaaagaagttacacttaagtttggggagaatttcatttcatattagccgctgtaggagttgaaaaaaatggctactggaacttagtgggaagaaaaggaaggaaacaggcatcaggcagaggcagttgattgaacttgggaagatgaggaatagatcaggaaagggttataatgaaaagctttggtgtcaagcacgaagagatttctagattcagtaatgcacagagagatcagtaaaattagaagggagtagttgatggctttgcgaattgctaaggtagaagggagctgttactcaagatgcatgttcaatttaaaatgaatgtattctttggacctggacataagagttctattgactttttgccactattttatatttagggctgtcatacttgggtgaatctagcacagtgctttgagagagagattcattcaacaaacgtgtattgagcattgattgtaccatactctttattggtcttttaaagcaccacaaagtatacagactagaagaacataggtgaagatgagaaagagtccattgaaggggagagaaaacagataatgatggtgctgtgcgataactgccatcatggagttctgtgaaagcagagaaagaccaaccaagtatctgagggaatttatgaaggcttcctggtggcggaggactagttcttacagggcacatgtgggggaatagggaagagtggaaagggactttgttctgcagagacatacaggttatggtgtgtgcagggactgtgatggaaagctgatggatgcacaaacaaaacgtggcctgtctacacaatggaaggctgttcagcaataaaaaggaacgaagtactgatttgtgctacaacatggaggaaccttgagaacattaggctaagtgaaagcaaccagacacaaaataccacatattatatgattcaattttgatgaaatctccagaataggcgaactgtagacagagaggagatcagtggttgcccagggctgagagaagaagcgtgtagaggggtgattgctaaagggtagggagtgcacagtgtgtggatggaagagtggcctgagatgaagttagatatagactgttttgtcatagtgtctaatttccatgcttgtgttaggctttagcttgtgaccattgggtagccaatggggatgggagcaaggaagtgacaaaattttgtctggaagataaatgactgcctcagtctcattacgttcctccttaataatttaatactcaaataattaatagatgtcgtagccagatttcaaacatagattctacaatagggatacaaattgttgcttcctagggattttggagagaatcctgaaaccattagtgtacccagagcactctgataacatggttattgtacagcgaagtggatgacttagactctatattagtcctagctccagtttgagaaatcatccatctgggtggcagttgggtgttagtagtcagcagtgaaggctagctgccaccttccagggttatgagattgacagggctagtggggaaaggaagcatcgtaacttgaaggatgccatagggtggtgttttgtatttttttaactgaaatagtcatgactaaggaagcattattcattatatttttatttatttatttatttttgagatgaaatatcactctgtcacccaggctggagtgcagtggcacgatcttggttcactgcagcctccacctcccaggttcaagtgattctcctgcctcagcctcccaagtagctgggattacaggtgtgcgccaccacacctggctaatttttgtattttttagtagagatgggtttcgccatgttggccagactggtctcgaactcctggcctcaagcaatcctcccacctcggcctcccaaagtgctgggattacaggcgtgagccatcatgcccagcccaattttaaaaattggattgagactattgttttgcagtaagacctgaagttaacaaatctttactgagcatctactctgtgccaaagctattattagatactaggatttaccttggtaagcaagagagaattcatgttgcttacattcttgtaggagagatgatttttaaatggtttagcaaataaagcaattagaggttgtaatgaggattatgaagcacatatgatagaggaaagaagggacagttgggtactcttgagtgatctggtcagagaaggcctttctgtggtggtgatatttaagctgagaccccacagttgagaagaagccagataaatggagtgagatcatttattctgcatagaggaaataattatgacacctgagtgggacagagtgggtcagtggagctagaacttggaggacaagtggagacgggtagagaggtgacaggggagctgcaaagggcttagaccacacggggcatttggtttttattcttagagcactgggcaaccagtgaggagttttgagtagaatgggtagtatggtctgatttctctttgaaggagctgatattttcctttgttttttggggggtaacagctttattgagatataatttacatgccacacagttcacccatttatatacaattcaatggtttttactgtattcacagctatgcaaccgtcactacgtcaattttagaactttctcatcaccctaaaaggaaactccgtacccttcagcaatacaccctaaccccttcttctcccagccctgggcaaccactgacctactctgcctacagcttgcctattctagacattttgtatacatggaatcatataatatatggtgttttgtgcctggttgctttcacttagcataatattctcaggattcctccgtgttgtagcatgaatcagtacttcattcctttttattgctgaacaggcttccattgtgtggatagatcacattttgtttgtccattcatcagttgatggacagttaggttgttttgacattttggctattatgagtggtgatattatgaacatttatctacaaattctttgtagatatgttatcatttctattgggcataaacctaggaatagaacttctgggtcacatggtaactctgtaaccttttgaagaactgcccactggtggctgcaccattttatttttcaccagcaatgtatacagttttttccacatccttgctaacacttgttcataccctagtgggtatgaagtggtatctccttgtggtttcgatttgcatttccctgatgagtaatggtgctgaacatctttttatgtgcttattggccttttttttttttttttttttttttttttttggaaataaagtctcgctctgttgcccaggctggagtgcagtggtgcgatcttggctcactacaacctccacctctcgggttcaggtgattcttgttccttcggcctcctgagtagctgggattacagatgtgcgccactatgcccacctaatttttgtgtttttggtagagacagggtttcaccatgttggccaggctggtcttgaactcccaacctcaggtgatccacctgcgttggcctcccaaagtgctgggattacagatgtgagccaccgtgcctggccttactgggcatttgtgtgtcttctttggagaaatgtttcttagactttgcccattgtaaaattgtcttttgttgttgttttgagatgaagtcttgctgtgttgatcaggctggtctcaaattcctgggttcaatcgatcttcccaccccagcctcccaagtagctgagactatagccacgtgccactgcacccagcttttaaaattgtctttttattattgagttataagagctctttatatattctgggtaaaatctctttatcagatatataaccaggagatattttcttccattttgtgggttttttttttttatttttgtcggtggtgtggattagatgtatttttactttcttgatggtgccctttggagcacaagcgtttttcatttcagtgaagtcaaagagctaattttgatggctgaatgagcctggcttctgggggcaggtgtggaagaccatggcagcagtgtaggcgagggatatgatagcttgtactgtggcatggccacagagttggtgaggaggcgccaggcttgagggaggcttggagatagggctgatggactgagttgagagattgttgtacgggtgagggaaacagaggaattgagggtgaatactaggatttcagcttgaacaacacttttgattcaaaatgtgattatgctgttacctgccggacaattgtgacagtttctaatacctgctggagcctagcaagggcagccctgcgctccctccctgggttctgaagttgcttttggtaggattatcactgagtgtgccaaggagatggtcagggattctgaccttttgtaatacccactaagacctcctaagccaccacaaataaacatattatctgagtagaatagtgcacttgctctgcaaatgcacttttgaggcaaatctcttgactcccttctagctagactgcagtctcaaagcccttcttgtgtagagcctgcgagctgtcagtggatagcatcaaatcaagcggatggattcttgaaagctaaatgtcatcatttgacagagctactatgaggaaaaatatttttatttttaaaaaagttttattgatcgattgatttgagatggggtcttgctctgtcacctaggctggagtgcagtggcttgatcatggctcactgcagcctcgaactcccgggctcaatggatcctccaggttcagtcgatcctccgggctcaattgattcttgtgcctcagcctcctgagtagatggtactacaggcacgcaccaccacacctggctacttttttgtattttttgtagagacagagttttgtcatgttgcccaggctgatgtcaaacccctgggctcggccaagtgcagtggctcacgcctgtaatcccagcactttgggaggccgaggcgggtggatcacaagatcaggagattgagaccatcctggctaacacggtgaaaccccgtctctactaaaaaaaacaaaaaaacaaaaaaacaaaaaattagccaggcgtggtggcaggtgcctgtagtcccagctactcaggaggctgaggcagaatggcatgaacccgggaggcggagcttgcagtgagccgagatcgcatcactgtactccagcctgggcgacagagtgagactctgtctcaaaaaaataaataaacaaacaagcaaacaaacaaacccttgggctcaagtgatctgcccacctcaacctcccaaagtactgggattacagatgtgagccactgtgcctggctgaggaataacttttttttttttgagacagagtttcgctcttgttgcccaggctggagtgcaatggcacaatcttggttcactggaacctctgcctcctgggttcaagcgattctcctgcctcagcctcctgagtagctgagattacgggcacctcccaccatgcccagctaatttttgtgttttaatagagatgaggtttcaccaagttggtcatgctggtctcaaactcctgacctcaggtgatccacccacctcaggctcccaaagtgctgggattacacgcgtgaaccaccacacccggccggtaataagatttttaaaggaggaaataacattaggcaatacttactggtgaagagctcagtacttccgcttgcttgctaggagatctcatgagctaaagcagatacgaaagtgcctgccagagatagggagtagaaggtgtgaaggccaggacgtgagaggccaggcctgttgtaattagaagcaattcagtgtggctggaggacaagtgagagatcctcgggtggcagaggccagatcaccaaggttcttgtaagccagcaacacttgggctttagcaggaggaagatggggaccactgcagagtgttaagcaagggagtgatgacatcagctttgcacatcaggaaaatccctctgtttgccacgtggatgacggggagggagaggcgggcagatgagctgggcaccagagagagctgcaggtgagaggtaatggtggcccgagctaggggtgacacactgaggtgtgtgggagatgtactgaatggagaatcggggacatggagaggagaggaggagggatcagggatgatgctccttttctggcttggtcagcatggcccaggcaactggtagaagatacaagataggtaagtgtctttgacattgttcatttactctgtgtttatagctaggatgtaagttttactaatcccatttcagatggtaattggagatctagagaggttgagcagttattccagggtgcctcaggtagttttaggagcattgggatttgaacttgggtctttttcacttcagtatcattagccactcattgtgcagttcttcctcggtggaaagagggtcagttctgtggctgtgggtctgagacctgggggttgggtgaggtggaacatggagttgggtgaacattgggtaaggaggaggagcagaaagtcttagcagaaatgtttgctgtgtctgcattgtttttcccaaacctagcgcaggacagtgagacagcggctctatgccttttcctcagcccgtcctagacactgtttctgccaggaggacagttttgctgggagttggcctcaacctgctcctcctatctgaatggtgggtgaaggacagacaagcctggtgctaagctcatccagaggcccccagatagggaaatagcatggattctcttctgcccgctggggacttcttgggcacctggcccccaggcatggctgtcctgactcatctgggtgctatggcttacgggcctctagatatcctttggaaaaacgtgtgaggcataaattgatatgaacattcttcaaggcagtttggcaatacatttttttttaattcaacatttccacctcttgcagtgtactccaagaatatacttggatatatttctgttgtttttgatggcaaaattaaaatcttttggttgagaaaattttggtttatccatacagtgtgttctctgcagtttttctgtatagtcactaaaaatcacattctaggggaatatttaatgacatggaaaatactcatgatttattaagtgaaaaagtctgtgtgtgtgcatatatgtttatatacatatatctgtagctatctgtgtacatggcatatctcagtatgatgagattgtgacttttctttacttctttgtccttttattttgagatagggtctcactctgtcacccaggctggagtacagtggtataatcagctcactgcagccttgatctcctgggctcaagcgattctctgtgtaccaccacacctggctaatttttgtattttttgcagagtcaggatcttgccatgtttcccaggctggtctcaaatttctggcctcaagtgatctacccaccttggcctcccaaagtgctaggattacaggtgtgacctactgcacccagctgcctttgtacttttcttttcttttttttttttgagattgagtttcactcttgttgcccaggctggagtgcaatggcacaatcttggctcaccacaacctctgccttctgggttcaagcgattctcctgcctcagcctcccaagtggctgggattacaggcatgcgccaccacgcccaggtaattttgtatttttagtagagatggggtttttccatgttggtcaggctggttttgaactcccaacctcaggtgatccgccctgactcagtctcctgaagtgctggggtttacaggtgtgagacaccgcgcccagccttctttgtgcttttctatattaacaaatttttgaggccgggcatggtggttcatacctgtaatcccagcaagtctgggcgtggtagctcaagcctgtaatcctagcactttgggaggccaaggtgggtggatcacctgagatcaggagttcaagaccagcatgatcaacatggtgaaaccccatctctattaaaaatacaaaaattagccaggcctggtggcaggcacctgtaatcccagctactcgggaggctgaggcacaagaatcacttgaacccaggaggcggaggttgcagtgagccaagatcatgccactgcactccagcatgggcgacggagcaagtctcaaaaaaaaaagcaactttttgatagtgagcatttataactgttataaaaagaaacctttatttttaaaaagttaaataaattatggcacatcaatgtgtgtatgagtatgtatgtatgcactctttaaggaaacaaagccttttactatttctgtgccttggaaagaagaataagaagtttctgcatccatgaagtggaggtaacattcatgtctaatgtttggggattgcaggaaaaaaaaatggaagtaactatgatgcctacttcatgtttgttttttttttctttctttttggtgaggatttaatgggtttgtgtgctaagaacagtttgtattaagtacagacggttttcaacttacagagtttcaacttactattttttgactttaagattgagcgaaaacgataccattcagtagaaactgtatttccagtaaccatacaaccattctgtttttcactttcaatatggtattaaataaattacatgagatatgcaacactttgtgataaaataggctttgattagatgattttgcccagctgtaggctaacataagtattctaagcacatttaagttaggctaggctaagctaagatgttcggcaggttaggtgtattaaatgtattgtgacttatcttttcagcttatgacggttttattgggacataaccccattgtaagttgaggagcatctgtaaaaacattagctattcccattattattactgcaaaagagggtggattgggttcttaagtatcacagaggaatgcaattattattattattgttatttacttacctttaagaaagttctcatacgtggatatgttctgcctgtattggctattgtgactgtcagatgaaatgggaatctaaggctgggcgcgatggctcacacctgtaatcccagcactttgggagactcagatgggcagatcatgaggtcaggagttcgagaccagcctggccaatatggggaaacccccatctctactaaaaaatataaaaattatccgggcttggtggcacacgcctgtagtcccacctactcgggaggctgaggcagaagaacccaggaggcgagtgttgcagtgagccgagatcgcaccaccgcactccagcttgggggacagagcgagattctgtctcaaaaaaaaaaaaaaaaaagaaaagaaatagaatctaaaaatgcttggaaaactggatatgctatacagatttagggaattattattccagcattgaattggggtcatattgaagaaaaaatgatactttgctgctcttccattccattttttagaattttatatttaatattttttcttttgctctacacattcagagaaacttctctagtaatgaactatagaaatgatcccagaaagcacagcctttgttcttctgttcttgtcactcattccttccttgcatattttccttttatttatttattcatttaagagacagtgtctcactctgtcactcgggctagagtgcagtgacacagtcatagctcactgcagcctcaaattcctaggctcaagtgatcttcctggctgagtgcagtggctcatacctgtaatcccagcacttggggaagctgaggaggaaggatcacttgagcccaggagttggagaccagcctaggcaacatagtgaaaccctctctattttttaaaatgaaatatttgttttaaaagcgtgatcttcccacctcagcctcatgagtagctaggactacaggcatgtagcaccatgcctgactaatttttaaaaatattttttgttgaggcgggagtcttgctatgttgcccaggctggttgtgaactcctggtctcaagcagttctcccaccttggcctcccaaagcactaggattacaggcataagccactgttcctgggccaaattttctgtttcatcattcattcatttatgcaacaaatacttgctgaatgcctctgatgtgcctagcccttttctccctgcggggggaagaggggtgagtgaggcagatatgggctctgctgttatgggccttacagactagtgtgtgtgtcagagtggcaggcaggcagataaccagtcagagaaaagaaaggagatgtgtggataggccggacacggtggctcacacctgtaatccaagcactttgggaggctgagatgggaggatctcttgagcccaggagcttgaggctgtagtaagccatgattgagaccagcctgggcaacacagcgagacctcatctctacaaaataatttaaaaattagccaggcatggtggcatattcctgtagtcccagctacgtgggaggtggaggcaggaggttcacttgagcccaggagtttgaggcgtcagtgagtcatgatcttgctactgctttccagcctgggtcacagagtgagactgtgtctcaaaaaaaaagaagaaaggggctgtgtagagaaagtaaaactgggagaggtgacagagagagaactcagtagggggaggagaaatcaagtacggcctcatgaaagagggcacaattgagaaggaggaagagctcagtagagaaagaacattccaagtggacggaacagccaatgcaagggccctggggtgagaacgagctggattaatttgatcagaagagggactggaagttggtcagtccactatgtagaaatagaaaacctacagttcaaagagaccataaatccatgatgcaagaagtttctgtgagaggagcttggaagtctccatagaacctgtagagctaaaatatccctccaggtgtaatcaggtacagagcatctacctggactgttacagcctgcctgtcagagctgtgactgtgctgttgtcaagagcctaggacttggagggaaaagacctagagtcaagtctcggctgtttgatcttgagtgagtctcatgaccctctggcccccagtcccttctaaaagttagggatgatgctacctgccttataaggtagggtcaggattaaatcagtgagtgagcactttgtgaaagatggcgtgcatggaagggttgcatatctttagtaagggaagctttgaagccaaagtgcaagtgggtgggtctccatgtggaacagagtaaggtgctgtgtggctggactcttgagcgctgaggaggctgtgggcatccaaccaggccagggcacctgttcttcaccatctcattaacacagccagcatatctgcatctgagattggcccactattctcctaatagagtgtctttcctgtttctcttttccatatcctgtccaacctggtgggcttcatagttcaggatgtgttcagtgaagccatgtctacactcactctaatccccactgatctctctctcctcatgaaaacccacaaattatcacctcattacttgtggatttgtgtcttttcactatttcatctgcctccctgtctagatcataagctacttgggagtaagaactgttttgttttttgtattctttccactcctccatggcattcactacaacataaatcatagaggtcagaacatactgaagtgcattttgagttaaaatgctcaaaagtgatcttagtgacacgtgtttactttccctgtttatttaagctccagctataatgtttacctgcctaaaagttccatgttgccagtattaaacatacttctttttgccatgactaggcattgaaaggattgtaatgctttgttctgtagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggtgagccttgctttgcttttcacctgagggggcacgagccatagctgacgcttaacatgcttgtgttctaggatgagataatttacttctgatttgccagaatatggccttaatacctcacccaaacaatactttaaaaccatctttagctgaagtggaatataactaaaaacattggtgtttttaactttttcctgcctccaaaaatctaacatcactttatttatttatttgagacagcgtctcgctctgttgtccagcctagagtgcagtgggacaatcatagctcattgtagcctcaaactcctggggtcaagtgatccttttgcttcaacttcctgagtagctaggaccacagggatgactgccacacccagctagtttttgttttgttttgtctgtagagacatggtttcactatgttgcccaggctggtcttgaactcctcggctcaagcagtcctcctgccttggcctcctaaagtactcggattacaggcatgagccaccacacctggcctaacatcactttaaaagagaatatcacctgaggtcaggagttcgagaccagccttgaccaatatggtgaaaccctgtctctactaaaaatacaaaaattagctgggcgtggtggcatgcacctgtactcccagctactcaggaggctgagacaggagaattgcttgaacctgggagatggaggttgcagtgagccaagatcacaccactgcactccagcctgggtgacagagtgagactccatcttaaaaaaaagaaagaaagaaaaaaagagaacattttagtatttaaaacttactacaacactttgaaagcagatatttttttcctaagtgtttacaggagcaggcacatgcctgtttttcaaagttttgaataatctctagttcttctcttgaaattatgatgaaaaaaggatgtatatgaatattggctcattgccagaatatgcacctcttagctgagctgaggtctcttctatagcattgggatcctgaccaatctgtttctgcagtgctgtggactcaggcatttctgtgtattgtagatattggtggagatgttatttgactgtgttgtggctggcaccaactattggtgaactgtaatgtaattcacccacttagtcaatatctgtagtttattgagtacgtcacttttgtgagagactcaaagttgactgagttgtggcttccaccacatgggactctattctgtctgtggttagggggcttttatggaccaagatacagcttttgtatctaagagaaatgtttacaaatacttgtgttttaatcagtattcaatatattaaagttttcatttaaaacgtaactaatttaagcctctgtgctcattttaaaataatcaaaatggttcatacacatacagccctttctatgtgtcagacattattctttaaaaatatattttttaaattttttaaaacattattttttccttctcactatgcttcttggacagacatatattaactcattttatcctcacaaaaactctctgaggcagatgttattatgatcttcctcatttactaaggagacagctggtgaagagagggtaggtgacttgcctgaggttggctggtagtaaatggcagcaccatcatgtgaacttgggcagactgtctctagggtctgtattaatatatatatatatttttgagacggagtttcactcttgtcgcccaggctggagtgcaatgacatgatctcggctcactgcaacctccacctcccaggttcaagcaattttcctgcctcagcctccagagcagctaggattacaggcacccgctatcacacccagctaatttttgtatttttagtagagacggtatttcaccatgttggccaggctggtcttgaactcctgacgtcaggtgatccatctgcctcagcctcccaaagtactgtgattacaggcgtgagccaccacacctgcccgtgtattaatattttttgtataaaaattagaactactgctatttcttctctttgagtaatagctcatggattcgactgatcaaattccccaaacatttaaaaccattacgtaatctttcaaactgtagttaggagtttaatagtctgaaatctctcaaatgcttcagacactttataaggaagactcgtgaatccaacgatgaaccccaacaagatctatcaaagaaatccatgcacagaggcaccctagtcacactgctaaagatcacaatcttaaaatccgtgcacagaggcgtcctagtcacactgctaaacatcacaatcttaaaatccatgcacagaggcgtcctagtcacactgctgaacatcacaatcttaaaatccatgcacagaggcgtcctagtcacactgctaaagatcgctgtcttaaaatccatgcacagaggcgtcctagtcacactgctaaagatcacagtcttaaaatccatgcacagaggcatcctagtcacactgctgaagatcaccatcttaaaatccatgcacagaggcgtcctggtcacactgctaaagatcaccatcttaaaatccatgcacagaggcgtcctggtcacactgctgaagatcacaatcttaaaatccatgcacagaggcaccctagtcacactgctgaagatcacagtcttaaaatccatgcacagaggcaccctagtcacactgctgaagatcaccatcttaaaatccatgcacagaggcatcttagtcacactgctgaagatcaccatcttaaaatccatgcacagaggcatcttagtcacactgctgaagatcaccatcttaaaatccatgcacagaggcgtcctagtcacactgctaaagatcaccatcttaaaatccatgcacagaggcgtcctagtcacactgctgaagatcacagtcttaaaatccatgcacagaggcgtcctagtcacactgctgaagatcaccatcttaaaatccatgcacagaggcaccctagtcacactgctgaagatcaccatcttaaaatccatgcacagaggcgtcctagtcacactgctgaagatcaccatcttaaaatccgtgcacagaggcgtcctagtcacactgctgaagatcacagtcttaaaatccatgcacagaggcaccctagtcacactgctgaagatcaccatcttaaaatccatgcacagaggcgtcctggtcacactgctgaagatcacagtcttaaaatccatgcacagaggcaccctagtcacactgctgaagatcaccatcttaaaatccatgcacagaggcgtcctagtcacactgctaaagatcacaatcttaaaaatagccagagaacaatgacgtattacctgtagaggaacaatgatttaaatgactgtggatttctcatcagaaactgtattagcccgttctcatgctgctatgaagaaatacccaagcctgtataatttataaaggaaagaggttttattgactcacagttacgcatggctgcggaggcctcaggaaacttacagtcatggtggaaggcacctcttcacagggctcactgtcacaagaacaggaggggggaaaccatgcccatgattcagttatctctacctggtccctcctacgacatgtggggattatgggaactacaattcaagatgaaatttgggtgaggacacagccaaaccatatcagaaacaatggaagctggaagacagtagcatttttttggttttttgtttttgttttgttttgagacggagtctcgctctgtcgcccaggctagagtgcagtggcgcgatctcggctcactgcaacctccgcctcccgggttcaagcgattctcatgcctcagcctcccaagtagctgggactacaggtgcccgccaccacaccggctaatttttttgtatttttagtagagacggggtttcaccatgttcaccaggatggtctcgatctcctgacctcgtgatctgcccgcctcggcctcccaaagtgctgggattacaggcgtgaaccactgcaccaagcttgtttttttttttttttggcagagtttcgctcttgttgcccaggctggagcgtagtgactgcaacctccacctcctgggttcaaacgattctcctgcctcagcctcccttgtagctaggattacaggcacacgccaccaagctcagctaatttttctatttttagtagagacggggtttcaccatgttgtccaggctggtgtcaaactcctgatgtcaggtgatccactcgcttcggcctcccaaaatgctgggattacagctgtgagccactgcgcctggccgatagtagcacatttttaaagtggctgagaggccgggcatggtggctcacacctgtaattccagaactttgggaggctgaggcaggtggatcacttgaggtcgggaattcgagaccaatctggccaacatggcgagagccccatctctactaaaaatacaaaaattagccgggaatagtggctcatgcctgtaatcccagctactgagaaagctgaggcatgagaatcgcttgaatctgggaggcagaggctgcagtaagctaagatcgtgccagtgcactccagcctaggcgacagagtgagactccatctgaaaaataaaatgaagttctgagagaattgtcaacccgaaattctttactcagtgaaaatacctatcaagaaaggtgaaatgaaagtattaccagatgaaggaaaacttaagagggttcgttgccaaccgacctgctctaaagtcattgctaaatgaagttctttagacagaagggaactttgtacatcaagaatgaagaatggtaaatacctgggtaataaatacaatagatgatttttcccctattgagttctttaaaatatatttgacagttgaaaacaaaaattataactgatcaagttttaacagatgtagatgtagtaatatctaagacgagtacaacataagtaagggagagtaaggtatcctatacatttgtacattcttcttgaagaggtacaatattgattctaagtagattttgaaaaattacgtataggccgggcacggtggctcacgcctgtaatcccagcactttgggaggccgaggcgggtggatcacgaggtcaggagatcgagaccatccaggctaacatggtgaaaccctgtctctactaaaaatacaaaaaatgagccaggtgtggtggcgggctcctgtaatcccagctactcaggagactgaagcaggagaattgcttgaacccaggaggcagaggttgcagtgagccaagatcgcgccattgcactccagcctgggcaatgagagtgaaactccgtcccaaaaaaaaaaaagaaagaaagttggagtggctgtattaatatcaaggttttcttctgtgcaaagaaataaccaggggtaaaaaagacattacataataacagattcgtatatgtcccttaacaacatagcttcacacaatacacgaagcagaaatggacaaatctgcaattacatgtggagacttcagtattcctctctcaataatagaagtagtagacagaaaaccaacaggatgtagaagaactgaacaacaccatcagccaacttggtctaattcacatttatagaacactcagctgaatatacattctttgcaagtgcacatggaacattcatcaatatagaccatgtcctgagttagaaaacatacctcaacacatttagagtagactaagctttccaggcccttgtgttttactttgttttttcacttttctttaaaatataatttacacaaagtttgcaaatctttttttttttcgagacggagttttgctcttgttgcccaggctggagtgcaatggtgcgatctcggctcactgcaacctccgtcccccgggttcaagtgattcttgcctcagcctcccaagtagctgggattacaggcgcctgccaccacgcccagctaattttttgtatttttagtagagatggggtttcaccacgttggccaggctggtctcgaacgccagacttcaggtgatccatccacctcggcctcccaaagtgctgggatgacaggcgtgagccactgtgcccagcctgcaaatcttaatagtaccatgtgatgaatttatatgtgtatgcctgtttaatcacccagttcaagatacagaacatttccagcaccccagaagattctcttgtgctacctcctaatcattacccctccccaaggtaactattctgacttctaacacagagtagttttgacttctacagagtagttttgctagctccttgggttttaattcactattaagtaacctctggcagtaaggtttatatgcgttagcggaatttggactccttactcaggttgcagttacaacccagttttcttttataaagcacatgtgtctcattgatcaccattgtattgtcttttttgttttttttgtttttttttttgaggcagagtctcactctgtctcccaggctggagtgcagtggagcgatctcagcccactgcaatctccgcctcctgggttcaagtgattctcctgcttcagcctcctgagtagctggaattacaggtgcccgccaccatgcctggctactttttgtatttttagtagagacagggttttaccatgttggccaggctggattcaaactcctgatcgcaagtgatccacttgcctcggcctcctaaagtgctgggattacaagcatgagccactgcgcccggtcccgtattgtcttttagaaaaactgtataactatttaaatattttcagtcaccaaactaaaaaacaaatactaaagttgaagtttattgctccccagaatgaaactacaaattacatctgatggccatttttacagtttaaccaataattagttctctatcatattatctttgtttcgttttcctttaacagaatacctaagactagtagttgttctttttttttttttttgagatggagtttcgctcttgttgcctagcctggagtgcagtggcgcaacctcggctcactgcaaactctgcctcccgattcaagcgattcttctgcctcaatctcctgagtagctgggattacaggcatgtgccaccccatctggctaattttgtatttttagtagagacagggtttctccgtgttggccaggctggtctcgaactcccgaccccaggtgatccacctgcctcggcctcccaaagtgctgggattacgggtgtgagccactgcatccggccggaagttgtttttatttttttactatttttaatttttttaaagaggtttatttggcccacaattctgtagctggaaagtccaagattgggcagctgcatctggtggggacctcatgctgcttccactcatggtgggaattggaaggggaccaggtgtgtatcaagagatcacatggtaggccgggcatggtggctcaggcctgtaatcccagcacttcaggaggccaagacaggcggatcacgaggtcaggagtttgagatcagcctggacaacatggtgaaaccccatctctactaaaaatagaaaaattagccaggcatggtggcccatgcctgtaatcccagctactcaggaggctaaggcaggagaatcacttgaacccgggaggcggagattgcagtgagccaagactgcaccactgcactccagcctgggtgatggagcaagacaccacctcaaaaaaaaatatatatatatatatgtgtgtgtgtgtgtatatatatatacacatatatatgtatatgtatgtgtgtgtatatatatatatctatatctcacatggtcacatggcaagagaggaagcaagacaggaaccaaggatgccagactcattttcttttcctttcctttttttttttttttttttttttttttgagacagagtttcactcttgttgccctggctggagtgcagtggtgcaatctcggctcactgcgacctctgcctcctaggttccagcaattctcctgcctcagccttccgagtggccaggactacaggtgtgcgccaccacatctggctaatttttgtatgtttagtagagacagggtttcaccatgttggccaggctggtctcaaactcctgacctcaggtgatccacatgcctcaccctcccaaagtgctggaattacaggcatgagccacggcacccggctctttttcttttagtatggagtgcttcacaaatttgtgtgccatcctcgtgcaaggaagccagactctttttaacaacctgctgtcttggaaactaatccagtccttggagagtgagcactcattcacccatgaggagggcattaatctattcatgagggatctacccccatggcccaaacacctcctactaggccccacctcccagcactgccactttggggatcagacttcaacataaattttggcaaagacaaaccacatctaaaccatagcagatatgataagtcacgtgagctttgaaggactgtgacatggtagaacagcatccacaggctctaccagagtttggtggaacagcatccacaggctctaccagagtttgagggagcagcatccacaggctgtaccagagattgagggaagctggtacaaattactggatccagcaccatagaaggggactctgggagaatcccatgtaaagattttagctagtccaggcatagtggcacacacctgtaatcccagcactttgggaggccgaggcggacagatagcttgagctcaggagttcgagactagccttggcaatacagcaagacccccatctctacgaaagaatacaaaaattattcaggcgtgatggcgtgtacctgtagtcccagctactcaggaggctcaggtgggaggatcatttgagcccaggaggtcgaggtcgtagtgagccgagatcgagccactgcaccctaacctgggcatcaaagtgagaccctgcctcaaaaaaaaaaaaaatttagctagttatcctttaaatgtatttcacccatacatgcatatgcctgctgtgtacctacaaaaactttttaaatctaaaatattaacatttggaaaaaaaatgtattttgctggggccaaaatccatacttggtagccctgagtatcaacagcattttttgagcgcccattatatataggatatcaaacttataattgtggagaatcacaagggaggtataaaataaatttcttgtccaggcacggtggctcacgcctataatcccagcactttggtaggccgaggcaggcagatcattttgagctcaggagtttgagagcagcctgagcaacatggcaaaaccccatctctactaaaaatataaaaattacccgggtgtggtggcgggcacctgtaatcccagctactcaggagactgaggctggagaattgcttgaacccaggaggtggaggttgcagtgagtagagattgcgccactgcactacagcctgggcgacagagcaagactctgtctcaaaaataaaataaagtgaaaattttttttttggcaagaatgtagaatttagaggtagaagatttagagcttggaaacaaagctgtatacctatatgtaaacacataggaaaaggtctgaaggaattttcacatgattacttaactctaggtagggattaagattgggatgggctgagggaggaagagtgaaagggaattacgtatttttttaactttactgaggaattactagaaatttttggtacatattacacgcataaacacagcaacacaaagatttgttttgagctttggctgccagttattagtggtttaaccccagagatgaattaaatatttatgttgttgttgttgtcattttcatcatgagagctggctgggtcttagaatcatttggtacaatccccactttttatagataaagaaattctaagattcctgcttcaaggcacgtatctctgattgcctaaccattgtgcttacttcttgtgagaggaggtaggccctctgtgcagtctgtggatttcaaggatatggaatacagatgcgtggtctctttggaatgtccaagtcgaaagttaaagatgcattaactagtttagggaaaatctaagattttatgggaagataaataaaaaagtttatgctcaaataaatccatgtatggcatgattgaaagattatgtttttaaatgaagttatgtttcctaaagaggaaagcagaccttttctgtggtaaatatagccttgcatgtgttttcaagaatggtgctttggaaaccatttttttctacagaagttagtgggagagggcagatggaaacacagattcttcctacctagtgccaaaagcactgagaaaatgttgcaaggagctaataacaagtacaaaaatgttagaaatgtgttaaatatataggtctgatatgtgtaagcatagaccaaaaagactacctgacctgagtttctaatgttctgttttgaagttaaacatatgatcccttttccttagcattcaacaagccaatgagatttcatggatttgccttcagagctgtctttttttttttttttgagacggagtcttgctctgtcccccaggctggagtgcagcggcgccatctcggctcactgcaagctctgcctcccggtttcacatcattctcctgcctcagactcccgagtagctgggaccacaggtgcctgccaccacgcctggctaattttttgtatttttaatagagacagggtttcactgtgttagccaggatggtcttgatctcctgacctcgtgatccactcgcctcagcctcccaaagtgctgggattacaggcgtgagccaccacacctggctgggtggttgcagttttaaatagcattccagggaaggtctgactgagaaggtgacagttgaacaaagacgtaaagagcatgaccaacacaccatactgacatgtctgtattccaagaaaacggaagggaaaggcactgagcctgaaacatgtcttggatatttcgcattgagaaaagtcatgcttcagaatgttacaagtatttcattggcttatactttatagacatattttaaagaggtgcagaaaggacagtttttgtctcaccatagcagccaaggtgcatttgcccagtgccttccattgtctttccctgtgggagtaacttttaggtccagtgatgaggagcctgtgatgtctgtgttctggtttgttgataacattaccatacagggcttcacgggtgtccttcttagcatggattgcttccattcattggttgctggaaaatttgctttcaaatgtttttaacagtgactcttagggaaaaaaaatacattttattagatgtccattctccctaaatttacctgagttcaactgaattccaataggtttttttttagtgttaatttaaaaaaacaagctggccaggtgtgatggctcatgcctgtaatcccagcactttgggaggccaaggtgggcggatcacttaaggtcaggagtttgagaccagcctggccagtatggtgaaaccccatctctactaaaaatacaaaaattggctgggcgcagtggctcacgcctgttaacccaacactttgggaggccgaggcaggaggatcacgaggtcaggagatcgagaccatcctggctaacatggtgaaaccctgtctctactaaaaatacaaaaaaaaggccgggtgcggtgcctcacacctgtaatcccagcactttgggaggctgaggcgggcggatcacgagatcaggagatggaggccattgggctaacatggtgaaatgctgtctctactaaaaatataaaaaattagccgggtgagatggcaggcacctgtagtcccagctactcgggaggctgaggcaggagaatggcgtgaatccaggaggcggagcttgcagtgagccgagattgcgccactgcactccagcctgggcgacagagcaagactccgtctcaaaaaaaaaaaaaaaaaaaattagctggatgtggtggcacgtgcctgtagtcccagctactcaggaggctgaggcaggagaattgcttgaacctgggaggtggaggttgcagtgagccgagattgtgccactgcactccagcctgggcaacaagagtgaaactccatctcaaaaaaataaaaataaataaataaataaataataaaaatacaaaaattagccaggtgtggtggcacacacctgtaatcccagctacttgggaggctgaggcaggagaatcatttgaacctgggaggcagaggttgcagtgagccgagattatggcactacactccagcctgggtgacagagcaagtctctgtcttaataaatacataaataaaaatgataagctgatttaaaaatgcatatgaaattgtagtgggtggaatagtcatactagtggaaaagaggaagcaaatgggagaagttgctattaggtaacaaaacttatagagctttagtaattaagggagtgtggtattagcacaagaaaagatacatagatcactggaacagattagagaagtcagaagaccaacatgtatatggatacttgagtaattgcaaaggtgatacgacaaagtctttttcagtaaatgatgtgggacagctggatatgaatgggaagaaaaatgaaactggatccctacctcacttcatatggtggttattttgagcactttaaagtattaatgccactgtctcttgactgctgagattctgctggcagtgtaattatttcctttaccgggaatttgccttgtctgtttctgctttagatcttctctaatgatagagtccctggctttaggcttcttccttcaactccagtggatattccctactttgttttgtcctatggagttaagaaaattattccagaaaagcagatatctttgtttaacttccagatcattaaaaagttgtgttagtattcaaacattaaacagatgttctttgttagtaaaaggaggaaaatagtgtaaccattcttaataattgaatgaattcatatttggtcttaaatatttcaaaatatttcagatcaattctttggtatgctagtggtttctactgaaggttaagctttgacctactaaaagcagctcataaagaaagctttgtcagacttcagttcccatgaacctgctcacaaagaacactttttcccaatgtagttttgtcttgtgtatgaaaggaaaactgcctgccaaggaggctaagaaggttagctgaatgctattgtaatggtgagatgtttgtccagaaaaccattcctgacacctttcaaatcaaaagccttttttttttccttaaactttttgattgctggatttctgtttgaggaagttatgttgctacaatgagggtagcaataaatgcctcctgggaagttggaaataaaggcaaaggagagttaaacacaatagatgagatcagaaatgggcaaagttatcttaaagagacagaatggctccctggctagaataagactgaattgtccctagatcaaaaaaagaagagaatgtgtgtggcagaaggaagaaagtggactctacactgtgttagttaggaaaaccagaaattgggccaaattgcctgtttagtgggagagatagcttttgagagctgtgatcccgctggtgtggctggctctgggcagatatttgtatctgaaatgactcatgctgtgggacccttcctgagatctaacacttacagtggtttgatcagaaattgcaccatgcttgccaagcaacttttggactaaaagttgctgcccacgtatatcaggggaagaatatatatatatatatatatagtacctatcttagcatctgatttgtatgaccattacttcaatgtaaaataataaattggctttccagcttaaacttcaatttcttgtatattatatgatcatgagacaacctccctgggctgatcaacagcaggacgctaaaaagattgagtatctgagtcaggaaggtagagggccagaccctacatgtagctaattcaccattgtgaatctgcatgttaggtaaaactatggatttgttttttgtcttttgagacagattctcaccctgttgcccaggctggagtgcagtggcatgatctcagctcactgcaacctttgcctctgggttcaagagattctcttgcctcagcctcccaaatagctgggattacaggtgtgcaccaccacgcccaaccaattttttgtatttttaatagagacgggagtttcaccatgttggcgaggctggtctcgaactcctgacctcaagtgatccgcccacctcggcctcccaaagtgctgggattacaggcatgagccactgtgccaggcctaaaactatggtttttaaagatatacacgcatgtggtaaagctatgaatcaaagcaagagaatatttcatctcaatgttaggagagtggttttggtggggtggggtatgtagtcaggcagaggcacacaagagcttcaaaggtgctgttaatggtccctttcccaagctagatggggattccatgggtgctcattttttagtaactctaatttaagctgtacatgttatatatagtcatggatatataatcattattttaaaaatgaaggcaaggaggataccataaaatgaggtacttcatatttaaccagctggcatcctaagcacctttcctgccctcccctctctgcacctggcagagttgatcacatcctccccattacccactatacatgggtgtcagtgccaatagtgctttgctcttgtattattgatgagtcttgctccttttcctaaattgtgaggcctcctgaaggcagcacccttgtcttatgaaaaagttgagcttctgaggatatgtctttggtgaattttggaaaacgtttagcctttatctctgaagataccacttttcattaccctctcttttcatttcctgctgaaacccctttttttgtttgttttttgttttgttttgttttgttttagacagagtttcactcttgttgcccaggctggagtgcaatggtgtgatcttggctcaccgcaacctctgcctcccacattcaagtgattctcctgcctcagcctcccaagtagcagggattacaggtgctcgccaccacacccagctgattttttttgtatttttagtagagacggggtttcactgtgttggccaggctggtcatgaactcctggacctcaggtgattcacctgcctcagcctcccaaagtgctgggattacaggcgtgagccactgcgcctggctgagaacccacttatgtgtagcttggacctttatgttctctcttctatgtctctaaacttctctttcatgttttgaatcttttcatctctttgttgcatggtaggtaatttcctcagatctgtcatctagttcaatacttttttttccagctgtgactaatttgctgttcattccacccagtgacattttaaattctcttggattttttcatttctatttccaatagtagttgttctttgcttacatttcagtttcctgttttatttttaaaacattttaatcatttttcttttatgttctgtgttcttcaatctaagtgaaatacttggggttgttcagtgctgttatggcttgttttacttgactcattcatgggcctgcttccctatcgtaatttctaattacgagcaatgtggctgatcctaatgtatgagaaccctgggggacctggatcgggactgctccacagatggggtttatgtttaccaatgccaggcaccttggagtgctaccaacatagaagcacttcagattaaccgtctgcatagagctttgcttggaaagagaataaattcaaactctgatgctgaatggggcaggcttatgatgacacattcttcggaaagattcttttttattcgttccaatcaatgcttgagataagacagatttccttgccagctccatttgccagcaaatcaatttttccctagcttactccttcacttagggttaggtccttgggattctggcttggcagagaatatcagctccagctccccatcatctactccgctctgaaaaccaaggctccagaggtgtgccagatagttacagggtagcctgtagcttcagggctagcttctgttttagtttgggggcattcttcttggttttggggtcctgtggattttccatactttcttgaaaattcagctgtgcatttgaaaggctttgttatatattgcactcagcattgccaggtgtttggagaggggtgttttgggatagctaggctattgtattgtgcaaaattaaagcctcatattctatttctatatgaactgtagttaagtgttaataatctgatgtctgggatgttttgattcttacatcaataactatgacatttattaataatcatattaaataacattaactcaagctcattggttacattacaaaggacactgatacattacaaagcacacatacaagcactgcacaccagtattgaggcttccagccccctctacatgatcatttatttatttatttatttttgagacggagtctcactctgttgcccagactggagtgcagtggcatgatcttggctcactgcaacctccgcctcccaggctcaagcgattctcctgcctcagcctcccaagtagctgagattacaggtgcgcaccactaccacctggctaatttttgtacttttagtagagatggggtttctccatgtgggccaggctggtatcgaactcctgacttcaaatgatccacccgcctcggcctcccaaagtgctgggattataggcatgagccaccgcgcctggtcatgatcatttttattttggaaccattcattcagaaaaatttcacagccattttgaacttgtgctatgacatggcaaaatctctagtaaatcattttaattcctgatgagttcatttttataatgataaatttctaaggaaaatattttgttttcaacttcttgccaccatgtcaagactgtacattttaaaacatattacatcacattttcccttcaaagcaatgccagtgaattctgttaatggtatcattcatctcatgttacccaactccagatcataaagtttccctcattctccttcctttccacaaacctaccaaatcctctatcgccaagtcctttgggttaattcacggagaaagtatcgagcacagaggcagaacagggcctctggagagtgtcacatttgtgtgtgaatcctgactcttgattttcactagctttgtaaccttagacaaattactaccaggcacggtggctcacacctgtaatcccagcactttgggaggctgaggcaggatcactggagtccaggagtttgagaccagcctaggcaacatagcaagatcctgtctctacaaaaaataaaaaattagctgggtgtggtggcacacacttgtattcccagctacttgtaggggctgaggtgggaggatcacttgagcctgagaggtcaaggctgcagtgagccatgatcgggccactgcactcagcctgggtgacagagcgagaccctgtctcaaaacaaaccaaaaaacaaattagttaacctgtctggagctcagtcccatatttgtaaaatgtggctaactacagcaccttcccttatagaaagctgtttgaggatccagttatgcatttaaagggcttaacacattacctggcacaggaaaacaaagacaagctgctgtcctgttttctttgttgctgccatccttctcacaaggtctcgacggagtctgtcttcatcacgatttcactgccctcatgcctgttctgtttaccccttttctagactgggcccttacttaccttagcctgagctattgtgaaacactcccagcggcttcctgacttgccccactccctccttccgccgtcctgtcctgctcctaatcgtgtttgtcagaaatgcctctgactgatacactggcaaaatcagaaatcttcaagggatccccctttttcttgctgtagcttaagatctaaatctcttaacctagatcacgatctgacactagatatatttatagtccatgaaaataccctgaaagctttcaagtaccagatgaaagtgagctccttcattaccacctcaactcactgtaggcggcttttcatgtgcaacagctaagctttaagagggctgggactgtgacctactttattttgtattgttatagcagctcacttggtacccagagcaaggaggtatatttgtttcttgcatatttggcaggttgattactatataaattactctattgaagattaaaatggtttactgaagatgtcgccatatatcttagcaaggtcaaaacagttgtgtaatttttctgaatgaatactttcaaaataaaaaagaccactcagaccagaagcctgaacatctgtgagcaatgcttatacatgtgctttttaataaaccaacatgttgggccgggcacggtggctcacgcctgtaatcccaacactttggaaggttgaggcaggtggatcacaaggtcaggagtttgagaccagcctgaccaacatggtgaaaccccgtctctactaaaaatacaaaaattagctgggcatggtggcgtctgcctgtaatcccatcgactcaggaggctgaggcaggagaattgcttgaacccgggaggcagaggttgcagtgagccgagatcacaccgtggcactccggcctgggcgacagagcgagactctgtctccaaaaaactaaactaaactaaactaaaataaaccaacatattaaactttaataggattattgatctgaaaaccaaaacatggtaggaattagtttataagtcatatttagacgcatcatcttataaccctctcagcaaaacctgtggggcaggtagattatggataacaagtgttcacttcatgaattgtccctgttgatcaggtgaagtagaacttggatctggggcagctcttgtgactccagattcttggtttttgagcaggtgttgggggaaatacctttcttgttgaagttctttagtactcttttttttttttttttgagatggagtcttgctctgttgcccaggctggagtgcagtggcgcgatctcagctcattgcaacctctgcctcatgggttcaagctgctctcctgcctcagcctcccgaacagctgggattacaggcacacaccaccacgccaggctagtttttgtatttttagtagagacggagtttcgccgtgttggccaggctggtcttgaactcctgacctcaggtgatctgcccaccttggcctcccaaaatgctgggattacaggcataagccactgcacccggcccatcttttaataagagctcagcatattcatacttgattgatcagcattttcgtcattagaaatgaggtggggtttttttgtttttgtttttttgtgttttcatttcaaagattaaaaacctagagaggaaggagagtatttggggaaaatggtggaagagggagcaccagtcatctgtctccacacctagacatcaattgtactggcaggatctgtctgatctaactattttggaactcggaagtctactgaggtttacacattcttgctgggatggcaaactgtggttaattttggtcagtttcaactcttagcacagtagcagctatgcactccccaaccccagttctgtggaaggcggctacgcgggtgttcctagagcttgcacacagcgtgggagccagaataggcaaaaagcatcttgtcctctaaatatttggggtctgtgctctgactgctgattgctgcttctgatcgtagaggtgcagacaaagagatgggtggccattgtcgttacacctcctcattattgcaagttcttccccctccaattaacaagacttccaggggatttaaagagctaatggtcctgctcccttgcttcacttttattttttcccatttgggagccagatgttagagaatatgacattgaaaagcaactgcatataagggggagaattaagaagtgactgtgcatgcctaggaaaaggtataggcacagtaaagacctgagaagaccctgagtttatacccaagactgatctttggcacagacggcctacagtaaacaaaaagaatcacacacacatccacacacagaataacaaaacccagtaaacttgaaaaggggaggatctgattttctgaattaccacagtattagattcaaatgttcagttttcaacaaaacaaatcacgaggcacacaaagaaacaggaaagtatgctcttccaaggaaaaaaaaaacaactgaaactgtgagaccacatagtagacctactagaaaaagattttaaaacaactgtcttaaagatatgcaaacaactaaagaagatgtggcgctgggggcggtagctcatgcctgtaaacccagcacttggggaggccaaggcaggtggatcacttgaggtcaggagtttgagaccagcctggccaacatggggataccctgtctctactaaaaatacaaaaactagctgggtgtggtggtgtgcactggtaatctcagctacttgggaggctgaggcaagagaatcgcttgaacctgggaggcagaggttgcagtgagccgagattgtgccattgcactccagcctgggtaacagagtgagactccttctctaaataaataaataaataagatgtggaaaaaggtaaaacagcgtatgaaggctgggtgtggtggcttacgcctgtaatcccagcattttgagaggcagatcagttgagtccaggagttcaagaccagcctggccaacatgttgaaacccgggtcatcgctagtaaataagacaaaaattagctgggcgtggtggcacaagcatgtagtctcagctactcaggaggctgaggcaggagaatcacttgtacccgggagatggaggttgcactgagccaagatcgtgccactgcactccagcctgggcaacagagacagattctgtctcaaaaaaaaaaaaaaaaaaagaaaaaagaaagaaaagaaaaaggaaaacagtgtacaaataaaatgtaaatataaataaagagatagaaaccctaaaaagaaactgaaaataattctggaactgaaaaatacaataactgaaatgagaaattcactggagggattcaaaggcagatttgagtaggcagatgaaagaatcagtgaatttgaagataagatattaaaattatcaagtctgacaaacagaaaaatgtttgaagaaacatgagcagagcctaagggtcatcatcaaagagactaacatgttttctgggagttatagaaagaaatgaaagggggagagagattatttgaagaaatagtatctggaagcttcccagatttgacgagagacatggatataaacatctaggaagttaaacgacctccaagtaagatgaactcaaggacacccacaccaagacacattacaatcaaactcccaaaagcgaaaaccaaagaacctttgggctggattcagtggctcacacctgtaatcccagcactttgggaggacaaggcaggaggatcacttgagttcaagctcagcctgggcaatatagtaagacctcatctctactaaaaatcaaaaaaattagccgggcgaggtggcatttgcctgtagtctcaggtcctcgggaggctaaggtgggaaaattgcttgagcctggaaggtcgaggctgcagtgagctatgattgaggcactgcactccagcctggcctaccgaatgagaccctgtctcaaaaaaggattcaacctgaggaagctgactaaaaaaacaaacttcagagaggagagaaatgcctcctcatatacaagggacccccaataagattataagcagatttctcatcaaaaactttggaggggtcaggtgcagtggctcacatccataatcccagcactttgggaggctgaggcaggtggatctcttgaggccaggagtttgagaccagcctggccaacatggcgaaactctgtctctaaaaatacaaaaattagccagggatggtggcgtatgtgcctgtaatcccagccatctgggtgcctgaggcacaagaatcgcttgaatctgggaggcagaggttgcagtgagctgagatcaggacactgcactccagcctggatgacagagtgagaatctgtctcaaaaaacaaaacaaaacaaaaaaacaaagtttggaggcaagaatacagtgggctgatatattcagagtgttaaaaagaaagaagacctgtcaactaaccatctaatacccagcaaaactgtccttcagaaatgaaaaagaaattaagatattcccaggtgaacaaaaatggagggagttcattagccacaagacctgccccgcaagaaatactcaagtgagtcctgcagagggaaattaaaggatattaaacagttactcaaagccatataaagaaatgaagatcttggccgggcacggtggctcatgcctgtaatcccatcactttgggaggccgaggtgggtggatcatgaggtcaagagatggagaccatcttggccaacatggtgaaaccccatctctactaaaaatacaagaattacctaagtgtggtggcttgtgcctgtagtccccagctactcaaggaggctgaggcaggagaatcgcttgaacccaggaggtggaggttgtagcgaactgagatctggccactgcgctccagcctggtgacagagcaagactccgtctcaaaaaaagaaatgaagaaaaaaaaaaaagaaaaagaaatgaagatctcaaaagtgaaggatatgtgcaattttaaaagctaatattactgtaacaatggtttataattgcatttttgtgttctacatgatttaagagactaaaatgcttttttaaaattagtctaaaagctagtagtattgtaatgttggtttgtgaatccacattttcttttcttttcttttttttttttttttagatggtgtcttgctctgtcacccaggctggagtacagtggtgtgatatgggctcactgcaacatctgcctcccgggttcaagtgattcttgtgcctcagcctcccaagtagctgggattacaggtgtgtgccaccacacccagctaatttttgtatttttagtagagacggggtttctccatgttggccgggctggtgttaaactccgacctcagttgatctgcccgccttggcctcccaaagtgctgggattataggcgtgagccaccgtgcccagcccacattttgttttctacataatttaaaataatttttttggtaaaataatttctaaagcatttaaaataattatttactttatggtttggggcacacagtttataaaggtataattttgtgatatcagtaagcaaaaaggttgaggacccagctgtaatggagtggagcttttctgtgttactgaaattaagctgatagaaatttaaattagtgttataactttaggatgttaaatgtaatcctcatggtaatgacagagaaaatcactgtagaatatacacaaaaggacatgagaaaggaatttaaatattttaatgtacccccaaaaatcaactaaacacaggagtagacagtaatgcaggaaactagggacaaaaaccttaaggcatatacaaaacaaaatgacaagccaggcgcggtggctcacgcctataaccccagcactttgggaggccgaggcgggtggatcacgaggtcaggagttcaagactagcctggccaagatggtgtaaccccgtctctactaaaaaaacagaaaaattagccaggcatggtggcggggacctgtaatcccagccacccgggaggctgaagcagagaattggttgaacccaggagacagaggttgcagtgagccaaggtcacaccattgcactccagcctgggcaacagagtgagactcgtcgcaaaaaaaaaggaacaaaatgatagaaataagtccctgtttattggttaattaccttaaatgtaaatggattaaactctccaatcaaaagacaaagattgtcaaaatggtttttaaaaccaatctgggctggacgcagtggctcacacctgtaatcccagcactttgggaggccaaggtgggtggatcacctgaggtcaggagttcgagaccagcctgggtaacatggtgaaacccaaactctactaaaaatacaaacattagctgggtgtagtggtgcatgcctgtaatcccagctacccaggaggctgaggcaggagaaatgcttgaacctgggtgacagaggttgtagtgagctgagattgcaccattgcactccagcctgggcaacaagagcaaaactccatctcaaaaaaaaaaaaaaaaacaaaaaacaatcctactatatgctatatataagagactcacggccaggtgcagtggctcaagcctgtaatcccagcagtttgggaggccgaggccagcagatgacaaggtcaggagatcgagaccatcctggttaatatgatggaaccctgtctctactgaaaagtggaaccctgtctctattaaaaaatacaaaaaaattagccatgcttggtggtgggtgcctgtagtcccagctactcaggaggctgaggcaggagaatggcgtgaacccgggaggcagagcttgcagtgagccgagatcgcaccactgtactccagcctgtgcaaaagagcgagactccgtctcaaaaaaaaaaaaaaaaaaaaaaagagagactcactttaaatccaaatgttgctggtgaaaggatagaaaaagatattccatgcaaatagtaatgaaaagggatcggggtggctattctactatcagacaaaaagagttacagaattgcaggaagaaatagacagttctacaataaaagttggaagctttaatatcccactatcaataatggatagaaaaataaagaaactttacatgataaaccaactagatttaacagacatttatagaacactctacccaataacaatagcatacattttctcaaatgtagatgggatgttttccaggatagactatatgttaagccacaaattagtgtcaatagattttaaaagatatacaaagtatgttcttattgcaaccacaacaggataaagttagaaatcagtaacagaaggaaaattggagaatccacaaatttgtgcaattaaccatatactcttagtcaaccaaagggtaaataaagaaattacaagagaaatttaaaaatacttaaagatgattgacaatgaaaacacacataccaaaatttatgggacagtgaaaacagtgctaaaggagaaatttatagctttaaatatatacattaaaaaataagaaaaatctcaaatcaacaacctaaactttaccatttaaggaactagaaaaggaagaaaaactaaactcaaaactagcagaaggaaggaaataataagattagaacagaggtaaaggaaatagagactagaaaacaatagagaaaatcagtgaaaccaaaagttgaatttttgtaaaggtaaacagaattgacaaacctttagccagatggatcaagaagaaatgagagaagacacaaatgattaaaaccagaaacaaagtagacccttactattgattcaacagaaacaaaaaggattatgacaggatggtgatctgttgaataccaacagattggataacctagatgaaatggacaaacccctagaaacacaaaacctactgagactaaaccgtgaaaaaatagaatacctgagtagatctataattagtaagaggatagaatcaataatcaaatatctccttgtaaagaaaagccctagacacgaagccttcaccagtgaatttaaccaagcatttaaagaagaactaacactatttcttctcaaatttttccaaacagttgaagaggagggaatacttctgaattcactctatgaggccagaattatgctgatatcaaaactagaaaagataaccacaagaaaaatacacatcagtatccctcatgaacattgatgcaaaaatcttcaagaaaatactagcaagtaaattcagcagcatattaaaaggattatacaccatgaccaaagtgggatatatttctggaatgcaaggatggttcaacatatgaaagtcagttacctaatatgctgttttaacaaaatgagggacaaaatcacatggtcactccactggtccataaaaagcacttgacaaaattcaacacccttttatggtaaaaacactcaacaaactgggaatagaaactaccccaacataataaaagccatatatgaaaaacagtgaacaattatacttaatggtaaaaaacggaaagcttttcctctaagatcagaaacaaggcaaaatgcctgcttttgtcacttcagttcaacacagtgctggaaattttagccagagtcattagccaagaaaaagaaattaagaggcatcaaaattgggaaggaagaagtaaaagtatctctgtttgcagatgacatgatcttgtatgtagaaaccctaaagattccacaaaaaattgtttgaactaatacatgaaactgacatagtagcagcatacaaagtcaatgcacaaaaatcagttgcatttctaaacaccaacaatgaataatatgaaaaagaaattaagaggaaaattccacttaaaatggcattaaaaagaataaggaggtgaaagactcatacaatgaaacatgaaacattgctgaaagaaattaaagacataggtaaatagaaacacattgtatgttgagaaattggaagacttaacattgtgtgtttggtttttggagacagggtcttgctctgtcacctaggctggagtgcagtggcacaatcacagctcactgcagcctcaatctcctaggctcaagtgatcctcccacctcagactcccaagtagctaggactacaggcatgcacaactatgcccggctttttttttttttttaattttttgtagagatggggtctcactatgttgctcaggctggtcttgaactcctgggctcaagtgatcctcctgccttggcctcccaaaattgtgggattacaggcatgaatcaccccgactagcctgacttaatattgttaagctgtccataccacccaaagtaatttataagttaattcaatacaatttctatcaaactcccaaggccattttttggcttgggagttttagaatataaaaatttattctaaaattcatatgggatctcaggagaacctgaaaagccccaacaaacctgaaaaagaacaaagctggagatctcaaacttcctgaacttaaaacttaactgcaaaaatgcagtcattgaaacagtgtattggacttggctgtggtatgaagaaataagaaaaagaagagaacagcatgatacataaaaatagacatagagaccgatgaaatcaatagcccagaaataaaccctcttatatagtcaagtgaaatttttttttttttttgagacagactgtcactctgttgcccaggctgcagtgcaatggcgtgatctcggctcactgcaacctccacctcctaggttcaaatgatgctcctgcctcagcctcccgagtagctgggactacaggcgtgtggcaccacacctggctaatttgtgtatttttagtagagacaggatttcgtgttagccaggctggtctggaactcttgacctcaagtgattcgcctgcatcagcctcccaaagtgctgggattacaggtgtgagccaccgtacctggcccagtcaagtgatttttgataaggacgtgaagattgttccacagggaaaggacagtcttttcaacaaatggtataggggaaactggatattcacatgcaaaagaatgaagttggacccttacctaatactacattcaaaaattaactcaaaatggccggggcctggtggctcacacctgtaatcccagcacttgggaggcccaggcaggcggatcacttgaggccaggagtttgagactagcggggccaacatggggaaactctgtctctactaaaaatataaaaaattagccaggtgtggtgatgcatgcctgtagtcccagctactctggaggctgaggcatgagaatcacttgaacccgggaggtggaggttgcagtgagccaaggttgcaccattgcactccagcctgggcaacagagcgaggctccatctcaaaaagaaacaaacagacaaaaaactcaacaatgaaaaaacccaattcaaaaatgggcaaaggacttgaatagatgtttccccagagaaggtaaacaaatgaccaataagcatatgaaaaatgaccatcactaattattagggcatgcatgtcaaaactataccccacacccattaggatggctactgtcaaaaaaaagaaaaaaaggaaataacaagggttggtaaggatgtgagaaatgggaaccctggtgcattgttcacaggaatgagatgatgcagccaatactagaaaacagtatggtggttgctcaaaaaaattaaaaatagaattaccatatgataccaaaattcagtcctgagtacagtatgtacccaagataattgaaagcagtatctcaaagagatgtttgtacactcatattcataggagccttattcacagtagttaaaatggggaagcaatccatgtgcgtctatcaacggatgaatggataaacaaaatgtagtatgtacatacaagagaatatgagtaagccttaaaaaggaaggagttctgatatgtgctataacacggatgaaccttgaagatactgtgttaaggagataagccagttagaaaaaaggcaaatactgtatggttccatttgtatgaggtatttagagtattcaaaatcacggtaaaaggaatctgaggagattaaaaaaaaaagagtagtcaaaatcataaagacggaaagtagaatggtagttgccaggggctggggggagggatgaatggggaattattgtttaatagagtttcagttttacaagattaaatattcgtggagatggataatggtgatgattgaagagcattatgaatgtattgaataccactgaaatgtatactttaaaaagggatactggtaattttacgttatgtgtattttaacattaaaaaattgggggatgagggctgggcatggtggcccacacctgtaatcccagcactttgggaggccaaggcgggcagatcacgaggtcaggagatcgagaccatcctgcctaacacggtgaaaccccgtctctactaaaaatacaaaaaaagcggggcgtggtggcgggcgcctgtggtcccagctactcagtaggctgaggcaggagaatcgcttgaacccaggaggtggaggttgcagtgagccaaggtggcgccactgcactccagcctggtgatagagtgagattccatctcaaaaaaaaattaaaattggggcatgagggcagggtgcagtggctcacatctgtaatcccagcactttgagaggcccaggcaggaagatcccttgtgcccaggagattgagaccagcctgggcaatatagtgagaccttgtctctacaaaaaaaaattaaaattacctgggtgtggggcacacgtctgtagtcccagctacttgggaggctgaggtgcgaggatcgcttgagcctgggaggttgaggctgcagtgaactgtgattgcaccactgccctcctacctaggtatatttgttttttggtttttttgttgttgttgtttcttgttttttgagacagagtcttgctctgtcgcccaggctggatgcaatggcacgatctcggctcactgcaacctccgcctcctgggttcaagtgattcttcctgcctcagcctcccaaatagctgggattacaggcatctgccaccacgcccagctaatttttgtgtttttagtagagacggggtttcgccatgttggccaggctggtctcgaactcctgacctcaggtgatctgcttgccttggcctcccaaagtgctgggattacaggcgtgatccaccacgcccagccctgtttttgtttttgttttttcaacagatgtaatttctgacttgtataccttttcaatcaagaatatgtatggactgcagcctgatgaagtttttcactcctttagtaatgtcctccttgttttacattttcaaagcctgcatagttacagattcatttgttttcaacgtttccccaggggaagacggaatctatcactgtggtgaagctgctgagctgctttgatgacctggtggcagcaggcacagcctctggcagggttgcagtttttcaacttgtatcttcattgccagggagaaataaacaggtgagtactcatgatcttaacacgtgttaacttcttggcacattcctcatggatttttaaaattagaaatcctcatctgcttagaaagtttatgctcagagaaagccgggcacgactttctctgcccaggctcatgcctgtaatcccagtactttggaaggccaaggcgggctgatcacgaggtcaagagatcaagaccatcctggccaacatggtgaaaccccatctctactaaaaatacaaaatttggccgggtgcagtggctcatgcctgtaatcccagcactttgggaggccgaggcaggcagatcacgaggtcaggagatcaagaccatcctgactaacacagtgaaactccatctctactaaaaaatacaaaaaattagccgggtgtggtggcgggtgcctgtagtcccagctactagggaggctgaggcaggagaatggcgtgaacccggaagacggagcttgcagtgagcggagatcacgccactgcactccagcctgggcgacagagggagactccatctaaaaaaagaaaaaaaatacaaaaattagctgggcgtggtggtgcgtgcctgtagtcccagctactcgggaggctgaggcaggagaatcacttgaacccgggaggcagaggtcacagtgagctgagattgtaccacgctactgcactccagcctgacggagcgagactctgtctcaaaaaaaaaaaaaatgctcagagaagcttaacactgtgctgtttataattggagaacatttttgtgctgggttggacacttggcataaagtacatgtgggtcatttcatttttgcttaatattctcaaggtatgctctctgtgggttttgaaggtgactagacagatggaactttgtgcagggttctgcttggaaaacgagattgggaaaaccagctcttccctaactaggagtgattgtataccttttccatgtagccccagctcacagcatttatcctttttttttcttgtgtatatttttatcccttgttcatagcttcggagatttgatgtcactggtattcacaaaaatagcattacagctctggcttggagccccaatggaatgaaattgttctctggagatgacaaaggcaaaattgtttattcttctctggatctagaccaggtaaaattattttcagaaatactgttggctcttaccttcttacatttggaaaaactatatttataacttgtatttttagtcaacttgtattcttgatcatcatccctttataatctcaattgttatttgtaacatttacttttatagacttatgttttataagcttccacttctatgactaaggagttggcctactggaacattcacttttttcattccactgttgtgtattacttttacttgaaaaagaagctattatcattcctacttccttgaaaggttagtaggagtgatgccaagcacttctgaatcctaactgtggacaagtcagtgatttcaatggatggaggactctgccagccacctggcctgtgtgagatgacctcatgtgacaggaagtggcagaggaggttaggtggcagtatggtgaagatgaagaaactggagtgccaagagatccaggaactagtccaggggtgcaggcttgcacctcacagagcttgctttcaaactgtgcttctgcttcgacgcccgtgccttttccactgcacgtatggcttgatgatctgctgggttttatttgttttgtcatgtgtctgcaaccaaactgaactccttggtggcacagtcctttctttttcttatttgtagccttcattcctagagcactataggaattcagcaattttttttttttttgagacagtctcgctcttgtcgcccaggctggagtgcagtggcccaatctcggcttgtgacaacctccatatcccgggttcaagcgattctgccacctcagcctcgcaagtagctgggattacagggacctgccatcatgcccgactaatttttgtatttttgtagagacggagttttaccatgttggtcaggctggtcttgaactcctgaccttagatgatctgcctgcctcggccttccaaagtgctgggattacaggcgtgagccaccacgcccagccaagaattcagcaattattagctgcatgactttcagtccctctgatccaagactgacctagtacaaatattctctagtagtagttctcaagctttgtagtcacaggatccctttacactcttagaaagaggaccccaaagcatttttgttcatatgggttatctctaccaagtacaccatgttagaagttacaactgagaaatttaaaaatatacatatttttttgagatggagtctcgctctgttgcccaggctggagtgcagtggcgcgatctcggctcactgcaacctccgcctcccgggttcaagggattctcatgcctcagcctcccgagtagctgggactacaggcacctgccaccacgtctgactacttttttgtattttttgtagagatagtgtttcaccgttttagccaggatggtttcaatctcctgaccctgtgattgaaatctcccacctcagcctcccaaagtgctgggattacaggcgtgagccactgcgcctggctgaaatttaaaaatattttactttgaaataataaatccataacatctgcacataagtgacatattttgtgaaaatatctctatagctctattttcaaaacaggtgagaagagtgagtggcattgatttatatttttacaaatttctttattatctggcttaatagaagatggctggattctccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaataaaaaataaaaaataaaaaaataaaaacacacctcaccaagctcagccaccaacttaaaaaggactggacaatacttttaccactttcccttctcagaattcaggcctgtcctcggaatgctacagggtacagcccatttgagctcctgtatggatactcctttttgttaggccccagtctcattccggacactagaccaacttagactgtgccccccctcaaaaaaaaaaaacttgtcatccctactatcttctgtctagtcatattcctattcaccattctcaactaactcatacatgccctgctctggtttacactgccggtttacactgtttttccaagccatcgcagctgatatctcctggtgctatccccaaactgccactcttaactcttgaagtaaataaataatctttgctggcaggactgtgctgaatctccttaggcactctctaatcagatatcctgagtcgtcccaattcttagaccttttatacctgtttttctccttctgttattccatttagtttctcaattcatccaaaaccatatccaggccatcatcaatcattctatatgacaaatgtttcttctaacatccccacgatatcaccccttaccacaagacctcccttcagcttaatctctcccactctatgttcccacgccgcccctaatcctgcttgaagcagccctgagaaacatcgcccattctctctccataccaccccccaaaaatttttgccgccccaacatttcaacaccattttgttttatttttcttattaatataagaaggcaggaatgtcaggcctctgagcccaagccaagccatcacatcccctgtgacttccacgtacgtatacgcccagatggcctgaagtaactgaagaatcacaaaagaagtgaatatgccctgccccgccttaactgatgacattccaccacaaaagaagtgtaaatggcctgtccttgctttaagtgatgacattaccttgtgaaagtccttttcctggctcatcctggctcaaaaagcacccccactgagcaccttgcgacccctgcccctgtccaccagagaacaaccccctttgactgtaattttccattaccttcccaaatcctataaaacggccccacccctatctccctctgctgactctcttttcggactcagcctgcctgcacccaggtgaaataaacagccatgttgctcaaaaaaaaaaaaaaaaaaaaaaaaaaaaaaaagaagatggctggattctgcattcaatctgttgccatacattgttttgattgaagtgtataaagaaaaactggctttacacagacatgtagttggaaatgggaggagtattttgatagccttttcagatagttgtggacattctttaataatatcctcatatgactacctcataaagcaaatggtagttgctttaaaggttacggtgacaaatgacaaatggtagtttctttaaaggttagtaaaaatgtggaatctgaaaccacatggatgaatttttcctactctgttacattaaaatctactttacccatgttggattttgtaacattatgtattggtcacttagaaaatactattcacagagtgatgcagatcttccaaatgttgacactttttttttttttttttttttttttgagacatggtcttactcctctcacccaggctggtgcacagtggtgcaatcacggctcactgcagctttgacttcccaggttcaggtgattcccccaccttggcctcccgagtagctgggactatgggtgcacaccaccatgcccagctgatttttttgtatttttatagagacagggcttcgccatgttgcacaggctggtcttgaacatctgggctcaagcaatctgctcaccacagtcttccaaagttcttggattacaggtttgagccaccgtgccagctgataaattttctaatacaatatcaaaaaaataccttcattaacatcaacatcattgtaatcgggaaagtctagctataaggaatcatgtcaagttcacagggacagatacaagttttcagattgctaatctttgtgtgagagcaacaaataccattacttgttttccttgaagtgacaggcttttttttttttttgagaaaatgtctgctaaatacccaaatttgaataattacagcatttcaaataaaaatggtgttttgtgaaaaaagcagctggctcagctcatagctgcaacagttgcacaagtggtttccttgagagaaccactgagtgtatttcagtgtgcagcagaagggagaatacaaaagtacctatcctctggccaggtgtggtggctcacacccgtaatcccagcactttgggaggccaaggcaggatgatcacttgagcccaggaatttgagaccagtctgggcaacatggcaaaaccccatttctaccaaaaaacataaaaattagccaggtatggtgatgcacacctgtaatcccagctactctggaggctgaggttggaggatcagttgagccttggaggtggagattgcagtgagctgagattgcaccactacactccagcctaggccaagagccagaacctgtctcaaaaaaaaggtttgcaacattttcatgtaatggaaatttctttatcttgattttggtgttggttacatgactataaatttgtcaaaattcatagaattgtatacccaaaaagggacgaaatttactgtaagttttaccaacaaatctgatcactgccccctacttccctcacaaaatgtcagtgatgttacagcagtatttctgaaataattgatgaaacttttcatatatatattggatttcatatatatgaaatatacatatatttcatatatatataatgtatatatatatatattttttgagacagagtctcactgtgttgcccaggctggagtgcagtggtgcgatcttggctcactgcaacccttgcctctgggttcaagtgattctcctgccgcagcctcccaagtagctgggattacaggcatgtgccacctcgcccagctaaattttgtatttttagtagagacgaggtttcaccatgttggccaggctggtctcgatctcctgacctcaaacgatccacccacctcggcctaccaaaatatagggattacaagtgtgagccactgcacccggcctgatgacacttttctgtaaaagtaacttacagaatcagattttttatacaatgaaatatgctttgtgttagcagtcgtatgccttctagaattttattttgtgtttatatataaaatatggtttttttttcttttttaaagacagagtctcactctgctacctgggctagagtgcagtggtgtgatcacaactcactgtaacctgaactcctgggctcaaatgatccttctgtctcagcctcccaagtagcggggaccataggcacgtgccaacatgcctggctaataaaaaaaatttttttgtagagacatgatctcacaatgttgcccaggctggtcttgtaaagtatcattttatgttaatagcattttatatatttaatatcatttaatttcttctaaccttctgttttctattaccctttcagttggcaaggatataatgtcctcaaagctgctttgaaccctttgtgaggggagactataatatgaacttacagagctgattattgtcgcaataattttatagaatgttccattccattgttttataatagaataagcaatacacacagtgcaacagatttctgtttagatctttatggattcttctttgaactctctgcatgtttactgcatcatccctgagcctgctatggtgcacagtaaagaatgtatctactgaggacatgtttttaaaaattatgcagattttaaaatgtttcctgtcaaactggatgcagcatgagggagatgttagtatggactcttttcccatccgtcaaataatctcgctatggtgggttgagagtgaatctgcagagagtgaaagcatgcgttaagtaaggtgcaagctgacctaagcacagctagcgggaaggacactgacttgtcctaagggaggtccattctttagcctggcgctgatgtgaggtgtaaccagactttctctgccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaaggtaagtttcacaagtttgccagtttggcctaaatgctgggccttgttgtagaaggtgctttagggtttcttaggtctcctgtttgccggagacctcctgtttgcaaacccacagcgcctctaagcctggggttcctggtggggccctgtgcctgcttaggatttctcctcccagaggcagacaagaagagtgtgttcttcttgtcgcagagctgtaggagcctgcacacacagccactctgcctctcagggtgccacagtcagcgcagagaagcctcaggggtggcctggtctatctgttccttgtggagccacctcctccacacagccctggtgaggggtcagggttgtggggctcactcgttattcagcacgtgtttaccatgcacccctgtgcactgtggcaggctcagcagtgacatggtaaacacggcagatctgagccctccgttgtggaaatggaaacacagatagaacacttgttgaccactgtgtcagctgctgtggaccaaaatacacaggatgctgtgtgagtttagacacacttttgtccaggtgaagggtcagggaagacatcctgaaggcatgggttccaggttgagagatcattcctcctttgaccagtgatgtggaggaagggcatcgagaagtccaccagccataccagccgtgtgggaaaagacaactggaacacctggggaacctgtaattcatcatcccaccctagcctgtaaagcactcttgtaggactctgcagcgagtttgcgtggggatggggtgaggaggggtaggtagagcagtggagctgacccctcctatgccaaggaggaggtagactggggccaacgtgggggtgggaagcagagggcggcattagtacagatcatgcgttgatgagtctacagtcatggattgtcgattggccgatgggagctggaagagttcccgtcttgtgtctcccaggaaagggcactgtttgcctgcatagaatcaggggcagggcagctgatggtcacggcatgtggggagggcttgaggctggccctgtggagagtgacagcagggactgggaaacatggtgagattggcaggcgttgatgaggccctgcggctggtggtgccgttggggacaggccgtcctggagagtcgggtgaggcggagccagcccctgtggtcgtagtcactgcccgttattctgtgttctgggctttgcggcaacacacaagtttattctcttttctgcatggcagccctccggctgttaaaagacgctctcaaacctcccctttcttctattttcgatgctgaacaccttcttttttctttttctttttcttttttgtttgagacagagttttgctcttcttgcccaggctggagtgcagtggtgcgatcttggctcactgcaacatctgcctcctgggttcaagcgattctcctgcctcagcctcctgagtagctgagattacaggcatgtgccaccacacccggctaattttgtatttttagtagagacagggtttcaccatgttggtcaggctggtctcaaactcccgacctcaggtgatccgcctgccttggcctcccaaagtgctgggattacaggtgtgagccaccacatgcggcctgctgaacaccttcttaatcccatcaacaatctggcctttttatatctgcagtctccctttcggtccctggagaactcagtggaatttatggccctgcagatcttagttctgctgctctctctgccagtatcctactcctctggcattttatcctggttcgtctgtcaatgttttactgcactgtcttggaaggaaggcagagtgtaaagagaggcattgaaaaccaattactttacatgtgggtcctattcccaacaatctctcttaaaacctggcccttggccggacacagtggctcacgcctgtaatcccaacactttgggaggccaaggtgggcgggtcacttgaggtcaggagttcaagaacagcctggccaacatggtgaaacctcctctctactaaaaacacaaaagtttgccaggcagggtagcaggcgcctgtaatcccagctactcaggaggctgaggcaggagaatcgcttgaaccggggagacaaaggttgcagtgagctgagactgcaccaccgcactccagcctgggtgacagagcgagacttcatctcaaaaaaatcgaaaacaaaaaaacaaaaaacaaacctggccctttaacctcttgtgtggagacccaggcagtttctgtaaacctctcctagtgcgtctgtgcagtcaagtctttagggaacattgattgaaagcgtgctctgctccccaggaacgttttaggatgcagaaacaaataaatgtgtccccttctcagaaggagagagattttactgagccttggggaaatgagggctaacagaataagaggaaatgtttttaacatctgtgtcttaaagacttgctttctgctgtagactattgtgtgcgtctatccctggaagcagtgcttccctcacaactgtttagtgagcggagctaggcatgtacacgtggaggcgtgacagcaagtacggaggcatccaaggagacaaggcctctgccctcaaacacaatgagagagactgtcggtcagcaggaggagagtagaggctgtcagtgctgtaaaggagcgggctaggtgaagcattagggagtgctaggcatggggcaggaagttgcatttggataggatggtcaggaaaggcctctacaagggcagtgatctttgagctgaagcctgggaagagctgctggaagagcattccaggctcagggaacagcatatgccaagacctcaattgggcaagagcttagatgttcaagaagccagaagtgactagggcactggctatggctggagtccaggggagccgtggggaggctgacacgggagtccaggggagccgtggggaggctgccatgggagtccaggggagctgcgaggaggctggcacgggagtccaggggagcctggcatgggagtccaggggagccgtggggaggctgccacgggagtccaggggagccgtggggaggctggcacgggagtccaggggagccacggggaggctgctgcaggagtccaggggagccgcagggaggcaggggagccgcagggaggctgccttgggagtccagggaaaccattgactgagatggagactggagactggggaaggctgggccagaggtcaggacatcaggacctctgctgtggacataaggggtttgacgggcctgtcaggtggctgcgtgggagtcgcagaagagagttctgtggaccggtctggagcccagggaagaagtcttgaccagaggggaaaatgaggtcaccagatacaggtgacactgacaccctgacattggatgaatccacgcagggaatgtctgttcattcagcgctggagctttgcgccaagcctctgccctgctccagtactcctcatcgggggatatctgtgaacaaggcagaacagatctctaatctcagggagctgtgtgcagagtagtgaacagataaacatgtcagagggtgcagagccagagagggaggagcaggagacacaggtgtctctttaataggatgacagggaaggctcctctgaggaggtagcatgggctgattcctgaaacaaagaggcaactagtgcgagaagaccttagagagaggctctggaggcagagggccctgcgcaccgaggatctgagcagccaggctggctgtgtggagcacggtgtggggagccccctcccgtcggctttgtgggccctgcccatggggctctttcagtccagtgctgtggtcagtcacagagggctgtggccaagccagggaggtcactctggctgctgcttggaatatgctggagggggcaggtgtggcagctcagcagggccagcaaggattctgggtgatccgggtaggagaagacaggatggggcggggttggtggtcggactgcttccaaggcagagctggcagatttgctgccacgttggttctgaggtgtgagagggatgagttggagatgattcctaggtctgtggtctatgcagctgggtgagtggacatgctgtggattgacgcagagaatcctggaggcacggggagaaggaggagatggaacagcctgctgtggccccgccatgtcctctccctgcagtggagagctggcgtgggaggcgggtggcgggtgtacctctcggggagctgtgcgctggcagccactggcatgcagacaggagctcgcctagggagatttgggcaggcttgtgttctgaagaggaaagggcatcaggagagaacaggagttggggggtcagaggagtcggaggccatatggagggacatagcagctgctgcgagaccgggggctgaggcagcttcgacgggcctgagtctgtagcatggaggctgtgcacagccctcctcatcagcagggccaagggattggaagggctgaaagaggagttgacggcgagtatggagagcttttaggaggagtgtttttgtagaagagaacaaagaaagacaaataggtggtgcccaggggggaaccatgtggcctggtgggagttttgggagaggggccgtgtggcagcacattggtgtgtgacgcgggtgcctgtggagggaacacagtgctggtggggacagagtgcaggcggtggcctcagttgggccctctcatgggcagcagtgtagggttgaccagaaaccgggacagagactctcttccagagaaagggcagggcactgagcacagggcaggtgcaggcaggtcaggaggcccagaggtagaagacgaggggtcctcttcccgtcgagtccgtgaacctcttcagaccggatgatgtgtgttacatccagaaaacctcagaggccctagccatctgcaaccgtgggtttgctgtcctgtgtatttatgttgcattgtttcatgtgtcagagccctctgcagacctgttactgtgtcccctgtgagtctagtactcagggaagccctccctggcagtagcactttgccctggggaaggagaaggagacgcagcaatctgtaggtgtggcgcccgcatgtgggtaagagccagcagccggttctggaaccccgcgactagcacatctgtttggatggccagtgggtgttagctgttgagatctctggcagggcttctgtggatccttcttctcactcagcttagactttcaggctcccattttgggtgctgtcagctttcagcgtatcagctctgtggcaccatacattatgcacaaaatcataaaacaccattttatagctagaatttgttagccagaacacactccttacatatcaacgtggtctataaagggaattaaaatttttttaggtaatcaatgaggtttttggaaatcatctctaccgaaattaagaaattatattaatttgtttatgattttagaatcctgcaatacttagaccttaaaagttggagcttcagtgtcaaattcagaaagcaccagcaagtactgcagaatcgcactgcaagtggatggtggctgagtcgggggcttaggacaatttgtacctggctctagctggttcttcacaacttcactgcctttgaccaacccactcatcagacatttccgttctttttattttttagagacagggtcttgctgtgtcaccaaggctggggtgcagtggtgtgatcacagctcactgcagccttgaacagctgggttcaggcgatcctcctccctcagcctcccgagtaactaggactacaggcacgcaccaccatgcctggctaaattttttaatttgtagagatggtgtctctctaggtcacccaggctgttgtcaaactcctgggctcaagcagtcctccctccttggcctccaaaagtgctgggattacaggtgtgagccaccatgcccagctattcagcagttttagaggcagccactcccaggaccttgctcagcagggctcctttcccttcctccagggtaagagtccacctggtgttcaggacctcgccttctcatgcccactcagatgcaccaccttgatctgagctctttgagcagctctttgagcctcagatggcgcttccagatgctgatgtgattgttcacacaggtcagcacagtgttatgagacaggctgaggacctcatcttatttattttttattttacccagagcatcaaacacgatgtcttacagaatgtaggaatcactaaatgtttgttaacatgagtgctttagttacataagatgaaccagtcaaaatggaaatgacaagagatttttcagaggtcctacaaatagaaggaaaacatttaaaaattggatcgccaagagaaattgattgacaggaaaggcagaggaagagattatgggctcccttgctggaattcctctggttcgctctatttagaggacatctccagaacaaacccaccaaaggcagtaatcagatacgatgctgttgatagagttgtccataaaagatccacgatgtcaaaacacccttggttcgtcctaacgatcattgtttcaaagctgaatttgatatataatatcctccttggaccctatccaaagggatttagttactgaggtgccagagggacctagtgagattctggtgtgcgaagaaaccccgcaaataactatctgtttgcctatgtgggtgggccctgggggtggcctctagggttgggtgtgctgctgtgtgcagggagtgtgggaacaggcacagcacaagttggccgaggtctggtggggaagcagtggcacggaggcagctctcaactgtgacctgcctgtagcctcgttcaggacaattgagcacttatggggacttagtgtcacaagcattgcttttgtgctgcatgtaagtaatctcattaattcctcacttcagcctttgagatgggagttactctgcctggtttacagaatgggaaacgggtccagaaaagttcaataattgcacgtaccacatacccactaggtgtcagggctggacatcgagcccagggctagctctaaaaccagtgctgtttctgcttttcacaatctgagaagtatttgggagaaggaatcagccaggcatagggctgaactgaaatgcttacatgtgaactctgttagcatcctgagaaataacgagaactcagattgccagtgggagtgtagattgtataatcacgtttaaaaagcttgaagttgtcttctaaacttgaatatgctctcagcaacccagcgattaccccacagcccaccaactgcatcctgagtgtccgtgacagactctgacacctgtgggctaaggggtatgcacagaaatgctcatagcacaattgctcaaaatagctttaaaaaataataattgaaatatccatcaacaagaaaatgaataaatgaattgtggaatacattaagtcctcgtttaatgtcattgataggttcttggaaactgcgacattagcaaaacaacgtataacaaaaccagtgtttttccctcaccaatgttgttgaaggagatggtgttatctgaggacctgctctatgtcatttcgcttacagttgtagtttctaagaacctgtggacgctgagtaggacgtactgtaccattcagcagtagaaatgaattagtgcgacagcttctttttatcaagaaggataaatctgagaaacatagtgttaagtgagaaaaagcaaaagagtacaattagcatcatacattttaataaaaatgaaagataaacaatactaaattatattgtctttagagatacatagatatgtgattaaaccaacaaaaaagtgaggaaatgataaaggcaaaatgcagtccagtggttccatctggggcacaagggggcaggaagtgttaggagcacaggagaacattggttgggtgactgatgatttctttcctaagtttggggatgggttcccaggtgtacctttccttgctaggcttcataactgcatggatatatgtacatatacacagtggtgcactgcataacaacatttcagtcattgacggactgcatgtatgacagtggtcgcagaagattataatggagctgaaaaaattcctatcagctggtgtcttagcgccacacattacgtgttctgtttttagatagacaaacagtcatcattatgttacaggtgcctacagtgttaagtacagtcatatggagtacaggtttgcagtccaggggcaataggctagactaagcttgtccaacccacggcccaacacaaatttgtaaactttcttaaaatgagattttttggccaggcgcagtggctcatgcctgtaatcccagcactttgggaagccaaggcaggtggatcacttgaggtcaggagttcgagaccagcctggccaacatggtaaaaccccatctctactaaaaatacacagttagctgggcatggcggtgcacacctataatcccagctacatgggaggctgaggcaggagaatcacttgaacccaagagggagaggttccattgcattgagcccagattgcgccattgcactgcatcctggacaacaagagcaaaactctgtctcaaaaaaaaaaaaagaggttttttttgtgactattattattattattattatttttagctcatcagctattgttagtgtattttatgtgtggcccaagacaattcttcttcttccaatgtggcccagggaagccaaaagattggacagccctgggctagactatgtgggtgtgtcataggctgtgccatctaggtttgtgtaagtacgctctatgatgttcacacaacgaagacatcgcctaatgacatatttctcaaacatccctgtcactaagtgacctgtgactctatatatagcatattcttttgtttgtgtcagatatttcataatttcagaaagaaaaaatatcaagcttgggggcaggaagggacattggtgcctctgatgggtttagagaaattctgaaaaggcaacaatatagatgggttgctgtgaagctcattcattcaggatgtggactgagcacagcaatcagacgtcagaagcaacagaatcagagcagggaaaggatgagcagacctggattcttcaccttctgcctcagtttcctctcctccaaaacgggagttgtaatacagtcatgtgtcacctaacaactggaatatattctgagaaatgcattgttaggtgacatctttgttgtatgaacagcattgagtgtactgacaagcgtaggtggtaggtacagcctacttccacctgggctaaatggtacagcatattgctcctgggctacagacttgcaccacatgtgactgtactgaatactttaggcagctgtagcacaacggtaagtaattgtatgtctaaacatagaaaaggtaccataaaaatatggtattataatcttatgggaccactgttgtatttgcggtccatcattgactaaaatggtttgttgttgttgtttttgaagcagagtcttgctctgtcacccaggttggagtacagtagtggcactatctcagctcactgcaaactctgcctcccaggttcaagcgattctcctgcctcagcctcccgagtagctgggactacaggcatgcgccaccatgcctggctaatttttgtatttttagtagaggcatggtttcaccatgttggccaggctagtctcaaactcttgacctcagatgatctgccgtcttggcctcccaaagtgctgagattgcaggcatgatgcatccagcctgaatacaatgttatgtgatgcgtgactgtatctgccactcatggttgttgtaaggattagacacgagagtgggatcaagtgccaggcacagtgcaggctgtgtgagtactcagtgaatggttccctgtgtgctaatggggcacacacctgtgagggtgtggtcgggcctctgttggtacagggatgacagtgtggtttgacaaaaaacaaacagtagaaagggtgaaaaatcaattattgtcttagccaaaaaattcttgttgtacttaatattaagggttgacaactgcattactttaaatcagtccatgtctgttttttgttctttctttctttcttctaattttagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggtaagtgaagggacgccaccatatcttctgtgtctataggcaagagaatgtatctctataaactgttctactcagggacctcagaatgctaccaggagcagtattgacttacactttactttttcctttgggccagtcaaggaaatcaaatgaaggtttggtaatttttatagatttgaaaaaaaaaatttggttttgacatttaggtccaattttctgccgagaaatgatgtatgttttttgtatgtaaacacaaaattaaacttgttctttttgttgttgttgttgttgttgttgttgttgagaaagagtctcgctctgtcacccaggctggagtgcagtggcatgatctcggcttactgcaacctccacctcccaggttcaagcgattctcctgcctcagcctcctgagtagctgggattacagacgcatgccaccacgcctggctaatttttgtatttttagtagagacagggtttcacaatgttggtcaggctggtcttgaactcctgacctcgtgatctgcccgccttggcctcccaaattgctgggattacaggcgtgagccaccatgcctggtttttttttttgttttttttttttgagatggagtcctagtatgtcacccaggctggagtgcagtgtgcagtggtgcaatctgggctcactgcaacctccacctcccgagttcaagcgattctcctgcctcagcctcccaagtagctgggattacaggtgcgcaccaccacgcctggctaatttttttgtatttttagtagagacagggtttcaccatgttggccaggctggtctcgaactcctgactcaggtgatccgccagcctcggcctcccaaagtgctggggttacaggcgtgaaccgccgcgcccggccgccacttggttttttttttgttttttgttttttattttcagttttctttacttagcaatatatcttgggcaaatttccaacatcattaaaatcatggtaggaaataatttctgcttaaaccaagatgataacagattatcatcagagacagatttagaaactttaaacaaagctgtttagtttcagtttctccttgtcttaagagcagagcttttgctctttttaaaataaactccctgccttaccctcccgactcctcacccccagactctagaccaggccctgtcctgttcacgttcttccattctgagctcagcgggcctctgacaggcacccctttcttttataagcagagcctcactgtagaaaataaacagttttcagccaggcgcagtggcttacgcctgtaatcccagcactttgggcactttggaaggccgaggtaggtggataacctgaggtcaggagttcaaggccagcctggccaacatggtgaaactccgtctctactaaaaatacaaaaattagccaggcatggtggtgggcgcctgtagtcctggctactcgggaggctgaggcaggagaattgcttgaacctgggaggcggaggttgcaatgagccaagatcacaccactgcactccagcctgggtgacagagcaagacttcatttgaaaaaaagaaaagaaagggttttcttctttggtgtgtgtcagcagaacatgaagttcatcttctcctcattgaagttttatgaattattatcagccgtacctggtaacactggtttggcagaaagaaaactggcccggggtggggggcagaactagactcgactcttctagcctggttctgcctttaaccaagagtctcttatcggccggagcctggtttgttttcctgtaaaatggggtgggggtggaagaagcatcgacttaggggaatcaccaaggtgccttgagtttgttcattttataagggatattctgaaaggtatttttgcaccctttcctcagttacagagaacttctttccctggataccttttgaacttatgtgcacttattaattagtagcatcaagatgctttgtaactgtgcattggttctttcatctgagcatttacccgatgctttacccagtaggtataattaacttcattttataggtagagaaatggagacaggggaccgtctgggacagatgtcacagtcaccctcagagactggaccacccagtggcagcatgactggcagctttcggaaacaaatgttatgtttgcagcagtccatcagttatttaaaattagccaaaaacatagactctccttctacaacagactagtctctttatttgcactgtctacagcaaagcaaggacttgctttaagtcagtgtgggctcaggatgtcctgtgttttgttgccacccactttcagataatgctggaggaacctcccctcccttcatgtattcattcaaaacccatgagttgcagtgcgcactggcctctcctgcaggaatgcacacagtagggggactagacgtgtctgcacgttatttcagcccaggagtggggcgtcaagcggaagtttggatgaggtgctgcaagccctgagagccctgggtgttgcagcagagggcaagcttgtcagaggctgcttctcacagaggtggcgtctggagagaactggaacttccccagcaaacatggataggaaaggaatttgagcagaaagagaagcacgtgcattcaccatggaggaacagggctgggactgggctggcagggccggtgcacctgcagcagggacgagggcagggtggtacgtgggtcggagatgaccgaggccccaccatgccaggggacccctcagatcctgcttaccaatctgtgagatgttacctaactttggattgaattggaattttcagaaagttaccatagtaaagtgcagttatcatttgactgatttggactctcacacatgcatttttatgctttgagctgttaccgttgtttagttttgtgttttttgttttttttttttttttttttttgacaggccacagttgctggtttggaaggatccggtgatattgtgtctgtttcgtgcacagaaaatgaaatatttttcttgaaaggagataggaacattataagaatttcaagcaggcctgaaggattaacatcaacaggtttgtatttattataaaatgtaccatgtatatgatgggaagtactatactctgttgtttgtaattgcagttaataattgatcaaacttaccattgggccaggcatggtggctcacgcctgtaatcccagcactttgggaggctgaggtgggtggatcgcttaagctcaggactttaagaccagcctgggcaacatggtaaaaccctgtctctaccaaaaatacaaaaaactagccaggcgtggtggcatgcgcctgtggtctcaagtactcgggaggctgaggtgggaggatcgcttgagcctgggaggcagaggttgctgtaagctaagattgcaccactgcactccagcctggatgacagagtgagacctcatctcaaaaacaaaaccaaaaacttaccattattttgctaaactattgcaactttatttgaacttggaggatttggagggtttcctctgattctttttttttttttttgagatggagtttcgctcttgttgcccaggctagagtgcaatgaggcgatctcagctcaccgcaacctctgcctcccaggttcaagctattctcctgcctcagcctcctgagtagctgggattacaggcatgcgccattatgccaggctaattttgtatttttagtagagacagggtttctccatgttggtcaggcaggtctcaaactcccgacctcaggcgatccgcctgcctccgcctcccaaagtgctgggattaaaggcgtgagccactgtgcccggccgctcctctgattgttaaaatagcatttacagtacatttcttgaaagtcacctactttaaggcttacatcagatagtctcacatttagtggagttgctttcatggttgtggaagatggggagattgagaaaggaggaaggaaaaatcagaaaccactttactgatccctgctctccgtctgagacagtatgtgggattaatgctccaaaagacatagatttgcatagagttttagaatatttaaatctgtcatctgggacataccgtttacccttaactcagttcttccttgtaggatttatttttctctgtgcttttgacattttttggtaattcatacaagcccaaattttaatgagcaaagaatcctaatatgtgtcctcttgcggacatccacatgctttatatatttgggttcctcggggaacttgttcctcatggtggcaacaacagccatgtggaccccatcaccctcctcctcactaccattacctctgatgtcagagagggcaaattggggtgaatattccaaaacataatttgtataagaagtgaataagctctgactcttgagtttatgagctgggggcccctcagacagtgtcatcaaagggttagaatggctttcaggaagggtggtgacttggagccaccaggctaagctctggacctctgctgcccatagagctttctgcagtgatgaagatgctcccatctgccctgtctggtaggcagtccctgtccatgtgtggctgctgagtacttgcaatatagcaagtgcagctgagagatgaattttacattttgtttaatttttattttattttattttattttttgagacagagtcttgctctgtatcccaggctagagtgcagtggtgcagtctctggtcactgcaacctccacctcctgggttcaaacgattctcctgccttagcctcccgaatagctgggattacaggtgtgcaccaccacaccaggctaatattttgtattttagtagaaagggggtttcaccatgcaccatgttacccaggctggtctcgaactcctgagctcaggcagtcctcccaccttagcctcccaaagtgatgggattacaggcatgagccaccgcgcccagcctaaattttgttcaattttgatcaatttgaatttcaatacttacaagtagctggtggctgcctattggacagggagctctaggcaagatctgccattaagttatgtaatcttcagcaagtcgcttcacagcagagtcctcccctccagtctccagtgtacacttcattgcctgcagtctgcccctaacacatgccctcaatagaatgtgggtgcttcaagggcaggaattcctgtgtcttatggactgccatgtcccagcagctagccctgtgtctggcacacggaggatccccgataaagagaggatggcgaatggatcaaagtgggctgtggtcttgtgttgagggtactgtagctggaactgctctggccttgtgccctgtggtgtcgtgttgcagaaaagatgagtccactgcagtgggaagctcactggcccttgggcttggggacaggagacaggtactcacatgcctgttctcactctgcggtctactggccttgatgctgtgtggtaatggacttctctgtcttgagtttgttctaatggaaaattacctttccctcttccaggaaacttaattacaggtacacatgtatttttcaaatgccctttgagtaatcttaaagtatattcaaggcagagtcttagtatgaagtataactaagctgttttgttatacacaggcatctctcatttgtaaataatttgtaaattgaagcgagaaatgctgtattcttagtatttttttacttttttttttttttttttgagacaggtttcactctgtcgtgcaggctggagtgcagtggcatgatctcagctcactgcaacctccacctcccaggctcaaatgattctcccacctcagcctcccaagtagctgggactatgggcgtgcaccaccacaccctgctaaattttgagactccgtctcaaaaataaataaataaataaatataaaaagaaagctatggcaaattattttactgattttaatatatgagcttcttgaagaacaaaaactgtttcttagagtcttttgtatgattcttttagttttggtggattttttttttttttttttttgagacggagtctcactgtgttgcccaggctggagtgcagtggcgcaatctcggctcactgcaagctttgcctcccaggttcacaccattctcctgcctcagcctcccaagtagctgggacccccggcgcccgccaccatgcccggctaattttttgtatttttagtagagacggggtttcactgtgttagccaggatggtcttgatctcctgaccttgtgatccgcccgccttggcctcccaaagtgctgggattacaggcgtgagtcaccgtgcccatcctagttttgctggtttctatgaatttagaatcattcagttctttagctggctggtgcctctgtgacaactggtatttagggctagcaaacgtggataagtgcacatcagctctctcttggatcaccagtggtaaaaccagactcttctttcttagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacaggtaccctctgtagctggcacacacccatctggggttacagtctttccagattctctgggagtgctgctgctcactgagtgagcaatgctccatacatccaaaagcagagaacacatacatttcttccccaaaggagttttactgcaaaatacttcacattaacggaaaatacacacacacacacacacacacactgtaaggtctaaatgatgacagaacacctgtgtgtactcaccaccctgcttaaagggtctcagttttgtacttttcaatatttatttatgtatttatattatttatttattttttgcgacagagtttcgctcgtcgcccaggctggagtgcaatggcacgatctcggctcactgcaacctcacctcctgagttcaagcaattctcctgcctcagcctcccgagtatgcatgcccagcgaattttgtatttttagtagatacagggtttctccatgttggtcaggctggtcttgaactcccaaactcaggtgatctgcccgcctcggcctcccaaagtgctgggattacagcgtgagccaccgcgcctggcatagtttttagtatttaaattaaaatgtcggggccgggcgcagtggctcatgcctgtaatcccaacactttgggaggccgaggcaggcggatcacgaggtcaagagattgagaccatcctggccaacatggtgaaaccccgtctctactaaaaacacataaattagctgggcttggtggcatgtgcctgtaatctcagtcactcgggaggctgaggcaggagaatcacttgaacctgggaggcagaggatgcagtgagccgaggtcacgccactgcactccagcctcgcaacagagcaagactccgtctcaaaaaaaaaaaaaaaaaaagtgttggtttatccatgtataccattgattaaatcagagattctgtgagcctgggtggaaagttgtggaaaccagaagatctatgctggtaaatacttgggacattttatgtttagtgttgaatatgctaccaaatatgggatttaacattgaatttttttctttttttttttcaacttttattttaaatacagggggtccatgcgcaggtttgttacatgggtatacagcacccaggtagtgagcacagtatgcagtaggtggcttttgacccatgccgcctcctctcccgctctggaggtccacagtgtctgtccttcccatgtttatgtccatgcgtgctcagtgtttggctcccacttacaagtcagaacatgctgttggttttctgttcctgttgcattaatttgcttaggattacggccagcggttccatccatgttgctgtaaaggacaagatttcattctttatttttatttatttatttatttatttatttattttttaatttattggagacagagtttcactgttgtcacccaggctagagtgcaatggtgcgatctcggctcactgcaacttccgcctcccaagttcaagcaattctcctgcctcagcctcccgagtagctgggattacaggtgcccactaccacgcccagctaagtttttgtatttttagtagaggcaggggtttaccatgttggacaggctggtcttgaactcctgacctaaggtggcccacccgcctcggcctcccaaagtgctaggatggcttatgagcgtgaaccaccgtgcacagcccagatttcattctttgttatggctgtgtaacactgaatttttcaaaccttttactccttggttcctgttaatcctctctagctaagatgactgcaacactgaaggaaatgttattagatttctaagcattttaataattataaggaattggtttgtgacccaggtgaacatctcagtttgtcccctggtttttcttagctgccctcaaacccatggatttgttcagtacttgcatgcatagaaagcatctctttgttgggattatttgtacttaagaggtttattcttcattcaccaaatatcctttatttaaaattttttttcttgagccaaaaatatgtgtgcaagttagtctcttactaatcatatagaaccgtgccttattttgaatgttcttattctgaattagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcaggtatgtgggttcgggtggtgggaaaagtagctgaggcttctttcttaagggtaataattgtcaagactgattattttccttctcatggaaagaaattctattcctactgcaaaatccgtaggccaactctgttttcaagtctgggtttcaggggatttccagcacagggactatgaatggcttgaactacttctgacctgttctaccctgctcagtaacctgcctccccaaccaaggtagcgtcttgctgtttcctctgaccccacaagtgcaggctggtgtaggcacttactgttagccatcgtagggcagggctgaattggcctggggccatctcagaaaaccagtgggcagaggactgtccacctgtggagtagagaaagctctgagcagtttggaggcagggagtctcctgtccttctcctcacacccctccaaggaaccatctgcaagagcacgaggccatttccagaactgctgtctcctcaacctccgaacagtggctccaaggctcccctgcgagctgtacaggaaccagtttggagtaaccagtctttgtaggtccacccagcacatgtaactaggagatgacttttaactgtccttgagcattttatattaaaagtgatttttttaaaagtgcctacttcccttagcaagtaattattactagatatatttgtttcaaaactgtgtcttgccctgtctcctactaactgtcgatgtgaggtatgaattatggctgcgcacttacagccacgtgtgctttccacagtctacgctggcttctgtcagtgctagcagtgtgacgctttgtcagtgctcaccatgtgcaggtatcccacaaagcactttagaggtttaactcttttacttctctaaacacgaactataaaataggcactcttcttgtccccattttacagaggagaaaatggaagcacagaacagctagacagcttgcacaaggtcacatagcaaatgaagggcgggccccaggaccccctcactcaccctctgtgctgtcatgcctcagaagtgaaacatgctgcttacttgttttgagacaaaacgccataagtctggcttttttttcttctttctttcttttttttttttttttctgagacagggtctcactctgtcacccaggatggagcgcagtggcgcaatcatggctcattgctgcctcgacctccccaagctcaagtgatccacctgcctcagcttcctgagtcactgggactacaggcatgtgccaccatgcccagctaatttttgtattttttgtagagaaggggttttgccatattgcccaagctggtctcgaactcctgagctcaagcaatctgcctgcctcggcttcccaaagtgctgggattacaggtgtgagctgctgtgcctggccaagggtggccttttattcagtcatccggcatttatcttttcaacccagtggttcttgagtggccttgactgtcagcctctgtgattatgctggggaccacagtgcagatggcagctagttgtggattccatcttcctgagcctcagagtcttgagggggagccaggtacatgttcacatcctcgcagttgagtgggactcaggtgagggtactgagcaaagtacagggctgcaggaagcgcaagcagcatggccccctaatgtctgggcgttagccaggcagactgtcggtggggtggggtattggaattctaggccagaaatttaggaaagccctcacttaggtgacagggatcctggccctttgagcccctgactctctaacttcctcccttcctcatcccactccaggtagctgggaagccaagaaattttatggtgtgtttttatttggaggttcggtgtggaagtaagacttgccatggtgagcagggctggattgagaagagttgggcaccattttctttgaagtagttaacttctatgtgggtatctgtacaaatacatttatcttctttgcatttattgaaaagtattaaagtacaaagactttatttagctttgatttttaaaagaattctagcaaggtcgggcacagtggctcacgcctgtaatcccagcactttgggaggccaaggtgggcgaatcacctgaggtcaggagttcgagaccagcctggccaacatggcgaaaccccgtctctactaaaaatacaaaaaatagccgggtgtggtggcagatgcctgtaatcccaagtactcaggagcctgaggcaggagaattgcgacttgcttgaacccaggaggcggaggttgcagtgagccgagattgtgcccctgtactccagcctgggcgacagagcgagtctctgtctcaaaaaggaaaaaaaaaagaaaatatggtggaaaaaagaaagacagtggtagtgccatatatccagtgcctctgtaatgattagactacaaaaaattgacttgcatccaaatgttgaagaacctggctctttgtgtaaggtgaggtatgcctgcagaataatagcagctccttcgtaacgtgatgtgatgctctaagcgttacatttgcaaaggtgttagaacaggagaaaatgtcatccagggactccagggagtctttgtagggagacagcagcacgcgtctcagaaggtttgtagtagaggggtgtccacagatagcaggggttgggagaagggttgacttggcgtcttgctgacccgttttaccgtctcgtgttaatgatatcctctcacctttcttactgagaacagtaagccaaatgtggctgtgtcctctgccacagaactcactggctcttcccttgttagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggttcgcctccccgctccctgctcccgctccctgctcccgctcgccgctcctgctccccgcccccggggtgcagacatcttagtacagggctcccctgcagcagctctgggctcacgctgccgtgcgttcaccaggtttgcctcttcaggaacgtttgaggggttgtctccaaagaacgtgaattgcttcattggatgtcaattcgtagtgtaaatgggtgttcagtttgagtttttgttttctttattaattgcaatggtaagctctgatcgtatttttgtaagctagacaaaaagtttgaaaattgagggacttttttagggatattaatatactaactcttcataaaaataatacgtgtttctctttctcattgttgctttaaagcaaccgaactaacgaagacgggcctatggatatgttagatatattccaattatttggcttcctctttaggaattctgttttaatgagctctctgctgtgggtgaacagtctactccctgactctaaaaggaaagtccattcattctttcatgctgctgttaggccattgttagtgaactggagctggtgtttcctgaacgatgttctcctgagctggaagacctcccatatctgcatggaatcatttgcttgctttttctttctttctttcttttttttttttttttgagacagagtcttgctgtgttgcccaggctggagtgcagtggtacaatctcagctcactgcgagctccacctcccaggttcgcactattctcctgcctcagcctccccagtagctgggactacaggcacccgccaccacgcccagctaatttttttgtatttttttagtggacacggggtttcactgtggtagccaggatggtcttgatctcctgacctcatgatccgcccgcctcagcctcccaaaatgctgggattacaggtgagagccactacgcccggctttgcttgttttttcttaaggttgtgttggccacgtcggcacctacgccagtggggacacttttgccttgaagcagcctggtttactgtcaggacattggaatagaagtcagacgaagccgaagctgagtctgtggcttgggacctgtctgttctctgtaacttcactgtgtttcgggatgaatttcccttaattctccctggtctctgtcactgtttaaaatattagtttgttcagcgttgtttttcttgcttgctttcactgtttgtttgaaaaatatttttctttagagactggctaacaacccactccacaagctgtcattacacagttgtgtgttttaattcatttctcgttggtatcatttaccttcaggtttgtctccttagccttttagaactttggttctattcctgactatattagttacttgtattcccaggccccttggtccctcactgtgctagcgggaactctgtatctccatgagattcacctgctcagttgaggcgtccttcagggcccagtcccatgtccttggtgggcagcagagcccttgtgccgggggcaccacaggcagagatgctcgacaggccctctagtccagcccagctgacactcggtgatcactggtggccccttgccttgcctgcgtcggcctgctccaggcctccagctgcagcgctatcctgccttccctttcctctctcctcctccatctcttcatcaaagtcctcttcacagtgaaaacaggccaactcagtgcaagtgtgttccttctgtgcaccttttccattcagctcatccagaactgatccttctctttgaatccctaaaggactttttcagcctctcctagggcactagttgtgcttaggatgtttatttggagacttatcaaacctaataatgtcatcagtgtttctcctcccgtgtgaggagcgcctgtcatgtgcccagctctgtggccatgtggttgatctgcttccgtctgcagtctttagagcagccctgtaaggtggagatgatccccacggcccaggaggaaagtgaagcttggagacgggcggtgacatggagcctgaagctgcatagccactgggtggtggccaagggcccaaacctgggtctggtggcctctttccccacttggggggacagaacaggatgtgttttagaaatctttctcccctcaatgcccagcatgaagacttttgtatagaaatatattctagtatttattggacagtgaatagaatttttatttccataggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtaaccgcgggccacgcttagaggcctgccagctctgccgtcactgcctctgctgcaccctgctttgctagtaacatgcttaccacaatcgctatgattaagaggctaaatccattcgaattaagacacttctgggaagagagtatttgccatttggcatgtattagcagtttcctgcattgacacaaactcaacccaggacaaatttagggcaaaaatgaataggattatttggtgagatacagaaacagaatcttattctcctatggccaaccaccgcatatcacgtatcctacaatgttagatcttaagaggtaagaatacagaggaaggacataaaattcatttccccctttaagctaaagtttaagtggctgcattttttttttcagccatatcaaagcccggctcctatatacttacttacccgtgggccaggaaaaaaaaagaaataatttgctcttttttattttgagacggagtctcgctctcttgcccaggctggcatgcagtggtgccatcttgactcactgcaacctctgcctcctgggttcaagtgatcctcctgcctcagcttcctgatcacaggctgggattacaggtgcccatcaccacgcccagccaatttttttgtatttttagtagagatggagtttcactatgtcggccaggctggtcttgaacttctgacctcaagtgatctgcccgcctcagcctcccaaagtgctgggattacaggtgtgagccaccacaccaggccataatttgctctaaatagcagttcaggccaggtgtggtggctcatgcctgtaatcccaacactttgggaggcctagacgagcagatcacctgaggtcaggagttcaagaccaacctggccaacatggtgaaactctgtctctactaaaaaaaaaaaaaaaaatacaaaaaattagctgggcgtggtggcgcttgcctgtaatcccagctacttgggagcctgaggcacaagaatcacttgaacctgggaggcagagcttgcagtgagctgagatcgcgccactgcactctccagcctggtgacagggcgagactccgtctcaaaacaaaacaaaacaaaaatagcagttcagcaagtcacaggaagctgccctcagggaagtttttagctgatggaagggcacagtgggacttgcttattaaaaataagctgtaatgacagtcagtgtttactgtcagcagaatggggaaggatcttccaccagcaatgtgatttatcagtatctggaaggactgtggggcaggagttatcgtcagttgtccagaggccacgttggatttatgtaaagatcagtcttccaggcgtttaatgttgttgattccaggagaatgttgttgttgttgttttgagacggaatctcgctctgttgcccaggctggagtgtagtggcacaatctcggctcactgcaacctccacttcctgggttcaagcgattctcctacctcagcctcccgagtagctgggactacaggcacatgccaccatgtccagctcacttttgtatttttagtagaggcagggtttcactatgttggccagtctggtcttgaactcctgaccttgtgatccgcccgcctcagcctcccaaaatgctggcattataggcgtgagccaccggcctcaggagcatgttttaatcactgctgtgagtcgtcagctggggatgagtcttcaggttgaagctcttgcacagctggctctctcctagctgtgtaagaacctctggcctgggtgcacagccatgctggcttcataggccatatgctggcccaggtctctccagcctagttcctgtgtctttctttaaatgaaagtagctctgtcaaggcacatgcacatctaagctgccaggacatttgagctttggtcatggggaagacaggaggtgcttctggcctgggggtgaggagcgagtgacctctaaaccagtagtgccagaggaatcaccaggacagtgatttcacatgaggtggccccacccagacctgttggattaggtccaatccctctggagactgctcaggagtgtgtcgtgtaagaagtcctgccggtgattcccacctagtttagtggaaggaaatatcacccaaggactgcaatactataggtgcgtctgtgattagtcacggagcatatttgagtactgagacctaattgcaggcctaaggtcaaggaatacagggttgtaggcgacagttggtctgtctgctcccctgggaatagcctttgagctcatttagacatactttattgacagaacacaaggaggcaaggggagagccctggacagggagccagggaccctgagctttggcctgccactgccttgcagtttgacagacctcagatttcatctgggaaattcggggtttcattttattagtggaacctcgcacccagtcagagcagagaggagccgccgtgctggagctctctgcaggaacgactgcaggcctcaggtccctgccaactccagcagcgctgcagccctctgcctggaagagctgctctgccctgcagcctttgggcctccatctggccactctcctgctcttggcttttgtgttcttctcttagaacttcttaagctacattgggacaccagataattctgaattgttcagttttcaaagagtgtctaaaactgttttcagatagatgttacatttaggcagaatttaaccactttatgttgattaaacttgacaacaaaaaagcggccggacagggcagctcctgcctgtaatcccagcactttgggaggctgaggtgggaggatctcttgagcccaggagtttgagatcagcctgggcaacgtagaaaggccccgtctatatttttaattaattaattaattaaagtttttttttaaagcactcatcataaaagaatatagcaaaataccaaaaaaggaaaaataagccaataaccaagtcaaaatgaggtgtggagttctgactgtgtgtctttggggcttcttcccatcttcctggcaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcaggtactggcgggccagagactcctttcacatcgtgcttgtcctacccttcgttcttgtccacttgacaccacaaggcaccatgaggccgttcctgggaggcagcacctgcagcctccatggctataggctaagcttgaatctctgcctaattctgaccggcaaactggacgttgagtcagagctcgctttttaaaaatgctgccgccctctgcgcagccctgagcatcacagcgtcatgagtctgtcatgacggtctctattcagaattgcccaccgtcaggtagttctggtttagtgtctgtgacggcttaggtccaaatatttttctttattttcatgctaatcgaagttgatctctgaactgtagcttttttttttttttttgatacaggttctcactctgtcacccaggctggggtgcagtgccacgatcacggctcactgcagccttgacctccgggctcaggtgatcctcctgcctcagcctcctgagtagctgggactacagatgcatgccaccatgcccagctaatttttgtattttttgtagagatgagttttgggttttcatcatgttgcccagactcatctcgaactcttgggctcaagcaattctcctgccttggcctcccaaagtgctgggattacagacatgagccactatgcctggcccgatctctgaactgtaatttattaagctatttttttttttaccattcaagatgttagttatagaattgccatcagatcattttactagtatggaagtattaatagtcctttgaaaaactagattaggatattcttggtttgaatttagcaagccaataaactttcagtgaatacctattaagagccagaatggtccaggtgtggtggctcacgcctgtaatcccaacactttggaaggccaaggcaggcggatcacgaggtcaagagttcgagaccagactgaccaacatagtgaaatcccgtctctattaaaaatacaaaaattaaccgggcatctcaggaggctgaggcaggagaatcacttgaacctgggaggcggaagttgcagagagctgagatcgcaccattgcactccagcctgggtgacagagcaagactccatctcaaaaaacagacagacaaaaaaaagcaacaacaacaaaaagccagaatggtgctaggggctgggtgcgccaagagggctgagactggccctgctctcatcagttccaagtctcatgggggccccgtgcatggatggacacccattagcacagatggccctaaacaggagtgtggagcatgcagcactgagggaaccatggactccatgcagagatcaggaaggcagcatgcagagtggaccaacagctaagccttgaagctgacgaggacttccccatatggaaggagggggagggcgtctccagcaaagagggcagtgtctgcctaggtccagctgcacagaatagcctggcacatcgggggagtttacagtcattcccttggtgagggagggagtagagagatggaggcgctcaggggccttggattggcgggggaaggagtagagagatggaggcactcaggggccttggattggcgggggaaggagtagagagatggaggcactcaggggccttggattggtaggggaaggagtagagagatggaggcgctcaggggccttggattccttttgtgcctactcgcttttttcttaggttattttctctcttaagagtgttcccagccattctgggtcatcagtgtgtctttcaaaagctgccacccacttgaaccatatctcttgcacagtaatttaactcagacccaaacttccttccctggcacctgctgatccgctccagggccacgtctcttctcccagccacgcctgccgggagaccctggatgtccgcagtccagacacactgggcactctgcctatgggtgctgacccccctgttctcctccttattttcagcgaaaggcaagctttagaacccgtctgcataacgctcggggatcagcagactctctgggccctggacatccatgggaacctgtggttcagaactggcattatttccaagaagccccaaggagatgacgaccattggtggcaagtaggtgttcagctctgcgccacgtgccgaggtctcccgaccttttctgcttccccttttcttacttctctcttttccttaacgatactagattaaatttaaaatactcacttttttattatttgtttgtttgttttgaaacaagatctccttccgtcatccaggcggaagggcagtggtgcagtcacggctcactgcagtcttgacttcctgggctcaggtgattctcccacctcagcctcccaggtagctgggactacaggcgtgtgccaccatgcctggctagttttttgtatttgtttgtagagacagggttttggcatgttgtgcaggctggtctcaaactcctgagctcaagagatccacccagactgggcagagtggctcacacctgtaatcccagcaatttgagaggccaaggcaggcagatcactcgagtccaggagttcaaagccagcctgggcaacatggtgaaaccctgtctctaccaaaaatacaaaaattagttggacatggtggcacacgccgttggtcccaactactcggaaggctgaggtgggagaatagtttgagcccaggagacaaaggtttcagccaagatcacaccaccacactccaacctgggcaacagagctagaccctgtctcaaaataaataaaaataaaaaagagagagagagagaaatccaccctctccgcctcccaaagtgctgggattacaagtggagccaccactcccagccaatagtattccttttttctatttgatggattagactttgctgtgtttgagtgcattagaaacataaaggacttttcatcataggaaataatttgcaaactctttgtgtaaataatgcacttaatttatttattttgatattgtttatatatttattattataggctaaataaacccagtgacatccatttgaagacctaggtaataatgatgtttaattatgaacaaatgtgctgagaaaagagcccagataataggtttgaaagcccaacccagaattaaaattgagctgtctctgcttattcagaaggcctctaagtagatggtatttcagcaaagacaggagaattttcccacgtgcttccagaaaaggaaacactataagaaacaggatgagggtataatcaagctcactgtgtgtgatttggtcccagcaagagcgcctagaatgaatttctcttttctttttcttttctttttttctggggcagagtctcactcttttgcccacactggagtgtggtggcaggatcacgacccacctcagcctcccaagtagctgggaccacaggcacatgccaccatgcctggctaattattttggtagagacaaggtcttgctgttacccaggctggtctcgaactccttggctcaagcaatcctcccaccttgacctcccaaagcgctgggattacaggtgtgaaccaccaccctcggccctagaatggattttcaaaggagtgtctactttccccttctttggtatagtttagtgttagtgttgctcccacagtctcccactgtggtaggtaagatttcactgatagtcgatggtcgtgaaatatttgatgtttcttttttttgagacggagtcttgctctgtcacccagtctggagtacaatggcgcaatctcggctcactgcaacctccgcctcctgggttcaagcgattctcctgcctcagcctcctgggtagctgggactacaggcacgcaccaccaggcccagctaatttgtgtatttttggtagagacagggtttcaccatgttggccaggttggtctcaatgtcttgaccttgtgatctgcctgcctcagcctcccaaagtgctgggattataggcgtgaaccaccgcgcccggccagtatttgatgtttctgaagtatcttgccccattggtttatgttttattgtcacctcagacttgctttgttgaaggcttgtcttgcattgactgctctgaggtctttcagatgagaatgtagaaaaatgagttgtgtttactctttgataaaatatgtattctatataatatgtacattatatacagatgtatctaatttatatactaggtaatatttgatagtcatgcaaatgattttaaaataccttttgtgtacttgtaaccatatatatacatatacatgtaaaaatatacatatatgtatttttgtagagacagggtttcaccatgttggcaggctggtctggaactcctgacctcaagtaatccacctgccttggcctcccaaagtgctgggattacaggcgtgagccactgtgcccgaccaggagtagggcatttatgccagtgatgttttatgtaatcaaacccagcagggcagaaatgtgagtgaacatcatggagaatcagattttcactcataaagaatttgccttatatcaagctgcccaagaagagaagagcttcctgcagggaggggtggttggagaaatgtctgaggtatatgaatgcttttcaggaatgttatagaagcaagctacccttctgagctagggttagagtctagatacccaggatggtcctagttgatgctcttgccctggagtaattattagtagtcccaattcagatcataaattagttcatcacagccttgcatggtggctcacacctgtaatcccagcactttgggaggcctgggcgggcggatcacctgaggtcaggagttcaagaccagcctggccaacatggtgaaaccccatctttactaaaaatataaaaaattagccggctgttgtggcgtgcgcctgtagtcccagctactcgggaggctgaggcacgagaatctcttgaacccaggaggcagaggttgcggtgagccaaaattgcaccactgcactccagcctgggtggcagggcaagactatgtctcaaaaaaaaaaaagttcatcactctacttgtgatacctttttagatgcatattatgtttctaagtaccgtatactgttgtccattggaaatacctgatttaaaagcaaaattaaagctgggcatagtggttcatgccagtaatcccaacactttgggaggccaaggcagggagatcacttgagcccagaagttcaagaccagccctgggcaacacagggagacctgtctctacaaaaaatttaaaaattggctacatgtagtagcattcgcctgtatttgggaggctgaggtgggaggattgcttgatcctggaagtcaaggctgagtatgattgtgccactgcattccagcctggatgccagagcaagactgtctcagaaaagatggcaaaattattctttctcactctgattagaatgaaagtcttcttagaaggggtgtgagggggtgataatcacaaaagtaatacatgcttgtaacagatccatgttgtataaaagtatataaaatgtgaatatattcttccatacctttaaatccaaccctacgaaggagctggagttagcattagcagtttgatggcatcctgccacatttttttggtcctttcacaagcgcacacgtgcacatttgtgtttggatggtcatcttgttactagaaatgcagaggtgtggacctgagctagaaccttccctcaaggcagagagtctacacttgtaactgctctgacagcagggcttttgcttgtctcctccttccaggtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggtgggtgaattgctgtaattttcacactggctttataggcagcctcactttaaagccaacatttaaagaaaagctttaagatctcaacttgaaaagataatttagtgccagtggtatgaagtgtctagtggaggcactctatgctttgtgatcagtttctctcctttttaaaaaatctgtcattcctaaaactcgtatccctgtgtctggatagtgtttcccctggaaaccttttatgacataagaaaagcaaatggaggtcatttttatgttaacaatttcacattttaaatgaaaaaatccacccaaacctagtgagagagaatggtccacttcctggagggaaggtgatcgccactgttggaaatgcaaggctctggccaggtctgtgaatgtagatgccagtctacacatcctggggtttgtttctgtgagtgaaccccttgcttttctccagccctctccctgctgcatggcctccacgaccctggactgggtgtggctctgcctggcagtattcagagggagatgaatgttaggctgtgattgctcatgtcgctttatttagggacactctagaattatctggagaaagggtttgaaggccagctgtcgtccagaactaagatctgaagtggttttgtctatgctttctttctttaacacattcttcctatttactctttccaggcacctactggaatcatgtggttccccgtgggacagcttctgctacaaaatgggcctttgtgttggcttctgcagctcccacgaaggaaggtgggtcagtcttagcctcactgaagaatctagagcacagcttggccattggaaaggttcaaaccacagtcggactgtggccttgttggttatggggcatgcctcggagactgaccacgtgagggtgtcagaggccagtagcccttgttagctgagccgagggccctgaatcgggataggcctgaccaggagagcctctgagagggaccgagcgtggtgaagatgagggaaagtgtccttctgaaggaggggctcacacagtgcagccaccggggctggcagctggtgacttccagtggcacatggcaggggccacagcttctttgggcaccttcccatctcccctcgagaatccttctgtcacctcccagcaacttccttccgtcttgttcacagcctccggataacctaagtccgacatttgcaccgcattaggcagacctgccctgcagcggggtgctcctgccaaccacattctgggcagaactcagtgtccctgcggagtacagggtttgtgagggagccagggcaccagagggtgagggagctggcatctgcggccgggaggggcacttcccccacccgcttagctgggagccccggcagtcaggcgacctctctgggaagtagctgtacctcctcccaggattgcctgaggatgaaatgcaaagatgctgtgaaatctgtggtgaagagggaatcgtttgcttagttcaaaccattagtcccactaggatgcaggtgactgggtcagtacaataacttcttactcaccagattgttcggaccacagttctggaacccagaaatctctgaaaacaatgttatttcttgagtctggcataaattaatttggcagcaaaacctgaccggatctcacatagctgcctccagccttggttgatctgttggctgtgaccgcatccatgttgcagggatgttaccgcacttcaccggggagcgcctggcccctccgtggttgttttgtaaacctctggcatacccattagcttaggttttcaaaaatccagaaaaagtttgaattccaaaacgtggccacaagttgtagataatacttcatataacgtactgtgaccaagattttaactgccctaaggattatttgcattttaaacagaatctgttaaacctaaaggacttttttaaaatgctgtagggaatgaaaggacatgattttgaggcaagggtgggaagagaagcacttccagcttcctaagccttctccagcagctgccccaccccccggccccatccccagaaggtccgggagagcaccatggcgccatccttcctaggaactgccaaccctccctccctccagggcaccgagttgatagtcttctcctcttggtaaaattaactttctacattaaaaatgctttggtgcctttgttcaagtgaaaaacttctcagcccatgaaaaatgggaggtcaaagccactaagccaacattatggccttcataaaatctcctaagccttgccttctttccatttctttccaacatctcaggcgtgtttcttgttagtcacggtgtttccctctgccttctaccttaaagtgctacaccgctcctgcccgtgtgggaatgggcaggtgagtgagctggcatctgtggccaggtggctagcgtctgctgaaaggcaaaggctgccttgtgcatttagggcaggcggcttggtgcagacaacacctcgatgacaaacatgacccctttctgcaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggtacggccacctcgtgagtacacctgccggtgccctgactgccctaaaccggcatcacaacgtgatgtcggacaaaactgcccggcctgtgtccaacctgtgagagttctgagggggtgtttataagctgctgaatttcaggagctcagttggccactctttcagactagacaggctctgggttttgtcccttcccctgccccttagagtttgcagggctgtcagaacccgaggagggtgtgcgtcctcaggtcaaggggccactcgctgcgagcggcttgaaggatactggtgatgcagctgccccgtcagtctttctgaatatggaacatagctttatgacctgaaaagctgaaaagatgggtgttccctatgacaggatcagtgccacgtttgtctatctcctcaggacagtacctggcggaggagagtggctcagcacacaggtgctagctctccttcagctcagccagatataggaggacctgcatccactagctcctgcttttctctgaatcttctatcaaaagccgtggagtaggctaagaaatgtagtgctatttgtaggccgggcgcagtggctcacacttgtcatcccagcactttaggaggctgaggtgggtggatcacctgagatcaagagttcgagaccagcctggccaacatggtgacaccctgtctctactaaaaatacaaaaaaaaattaggtgggcgtggcagtgcacgcctgtagtctcagctactcaggaggctgaggcaggagaattgcttgaacccgggaggcgggggttgcagtgagccgagatcatgccattgcactccagcccaggcaacagagcgagattctgtttcaaaaaaaaaaaaagaagaagaaagaaagaaatgtagtgctgctatttgtaaataattcattcatgttccaagaaataataacataagcccacaacattagatttctctctgagtagattcttggtggatcaggcagcataggtgtggtttgcctgaaggtggagttgtgcagatggcccccagggcccggatgagccctgcacttgcagcaggactgacttaggaacttcctggctgcaaggcttcccagtttttttaacttagaaccagcatttggttatgtggtagacttgaattgtataagcatttaatgtttgaaaactcaatcacatgtactcaccaaaaaaaaaaaaaaaaaaaggatggggagaaagaaagcaagaagagggctgggcacagtggctaatgcctataatcccagcactttgggaggccaaggagggcggatcacctgaggtcaggagttcaagaccaacctggccaacatggtgaaaccccgtctttactaaaaatacaaaaattacctgggtgtggtggcacatgcctgtaatcccagctacttggttgggaggctgaggcacgagaatcacttgaacttggtaggcagaggttgcagtgagctgagatccatgccattgcactccagcctgggtgacagagcaagactctgtctcaaaagaaaaaaaaaaaaaagaaagcaggaagagaagggcttgttccccttctccccaagcccctggctgcattgcagtctgtatgctaccagctgatgagagcctcttgccattccgtaaagcaagcatcgtcctaggctgcctggcagtggttggtgtgctcagccccgggggctcctacagggtgctgagtagacatcacccattcttttgcctgaaaaggcccctgaacactaactcagctgaagaagcaagttctgttccaaggcttggggactgaaggtttgtccagggcaacttttgttctttatgctttgggcctccccacctgccttttggacccaccagtcaccatctagctttttgagaacacccgcctctccacatcactgacagtgactgatagacaaggctgaggctgagagtggcctgaacattggtgctgactgacctgccgcctgccctggaaagcctttcatttgttcagagaccctactggtcctgagccattctccagcagctcctacccagactaactggaaaatgccgctagttccctctgagggtaaaaagtccagggcttggtgtgtattctccctgctcctgaatcttgagcactgtgggaggctgtgttcacctgcaccatttgggtgagaagcagaactgcttcccttgcacgtccccttcccagcccctccaggaaggctgctgcaccgtggtgggattcagagtgaatgggcatcatgccaggttctgcactgctggagccagccctgcctgggcctcctgcctccagcacagctcatgcctccctcctggctcgatccagtcctcccagcaccggctagctggccaaagtggtgcaggtctctaaggtgtgtatttgggcttcactgggaggtttctctcggggagaaacctggcttgagtgggattgagtctcaagagtgtgagggaaacaggaacaagtccatcctgagtccaagatggccttgggccatctggtgttcagcagatactcattgaggggttgggtgtgtgaacagagggatggcctggggatcctggtcgctgtggatgggcaggttttcactgacctcctgtgttccgcctgcaaaatcattagcaaatcaatgtcagtatccggctgaccccgaaatgaatcagacagcagtgggtgcaaggaggtcacaggcagaggtgtggggactcatggcagaggcaggacagagctgggccccaggcgggctctggactctgggcaagctgctgtcaccttgaaccgcaatttcctctcctttcttttttttccaggtggggtctcactctgtcatccaggctagagtgcagtggcacgatcttggctcactgcaacctctgccttcccaggcttaagcaatcctcgcacctcagcctcccaagtagctgggaccacagacatgtgccaccatgcccacctaatttttttgttttttgagacggagtttcgctctgtcgcccaggctggagtgcagtggcacgatctcggctcactgcagcctctgcctcccaggttcaagcaattctccctgtctcaacctcccgagtagctgagattacaggcacccaccaccacacctggctaattttttgtatttttagtagagacagggtttcaccatgttggccagtctggtcctgaactcctgacctcaggtggtccgcctgcctccgcctcccaaagtgctgggattacaggcgtgagccaccacgtacagtccctgctaacttttgtattttgggtagagatggggttttatcatgttggccaggctagtcttgaactcctgacctcaaatgatccacctgccttgtcctcccaacgtgctgggattacaagtgtgagccaccatgcccggccttggtttcctctcctttctaatgggagcagcaacccccaagcccaaccccctggaggatgcacggggcatcccgtctaaatgttggccatctccgggcggtgtggtcatcctaaggctgtgacacgtcttgcttgggggtgctctctagtctttgttagctgctggtggtggggcttttgcttgtgttgccccagtttgtgccacagggaggacaaatccagcatctcttgttaaagcaccacctcgcttagtccttatcctgccctgaactttagattttgtttatttgagttatctggttgatcttgaaatgtcagattaagactcctttcctgtttcctacacatcctgagagaatgcagcaagtccagggttggcagctttgtgttggggcaagggaggtgaacaggcaaccgggactcccaggctgttcctctgcacacgcacctatcccctcaacgagtatctgctgaacactggagggctcgaggccatcttggactcagggtggacttgttcctgtttccctctcgctctttttttttttttttttgagacagagtctcgctctgttgcccaggctggagtgcagtggcgcaatctcggctccctgcaagctctgcctcctgggttcacgtcattctcctgcctcagcctcccgagtagctgggactacaggctcccaacaccacgcctggctaattttttgtatttttagtagagatggggtttcaccgtgttagccaggatggtcttgatctcctgacctcgtgatctgctcgcctcagcctcccaaagtgctgggattacaggtgtgagctaccgcacccagcctccctgtcactcttaagttgagactcaatctcactgaagctgagtttctcccctagaaagaacagccacctccccagccttcactatgccagggtaggggcagtgagcatcaggccaggggcaccaggtgttcagttattaggctctctccaggtatggtctgtgtcctgcaggaaaagcaggtaggtcaagagacttctctttttgtttgtttgagacagagtcttactctgttgcctaggctggagtgcagtgacacaatcttggctgactgcgacctccgcctcctgggttcaagtgattctcctgcctcagcctcccgagtagctgggatgacaggcatccacagccatgcccggctaatgtttgtgtttttagtagagacggggtttcaccatgttggccaagctggtctcgagctcctgacctcaactgatgcacccgtcttggcctcccaaagtgctgggattacaggtgtgagccactgcgcctgacccaagagaccttttaataattacttatttaagtgaaaattttgaatgcaggtgtgctgtctgcccaggagcccgtgtatgactgtgcatggcggctgtcatcaggtggcatgcattgaatggggattattgactgtaaaggagagtcatcaagctgacatggctgctgcctgtgttacttatctggaattaattggggtgcttcatttattttttacaagtcagcagtgggccgggtgcagtggcttacacctgtaatcctagcactttgggaggactgcttgaggccaggaatttaaaaccaacctggccaacatagcaagaccccatctctaaaaatatttgttaaagtcaacagtagggggtgcacacagcaatgaatggaaacacagtgactgcatttgaggatgttgttcaatatcaaatttagcctcccccaattgtgctcttcttcctaacttcgctcctctgctcccactaaattccctttttttttttttttttttttgagatagtgtctcaccatgttgcccaggctggagtgcaatggtctgatttttgactcactgcaacctccgtctcctaggttcaagcgattctcctgcctcagtctcccaagtagctgggattacaggcctgtgccaccccgcccagctaatttttgtatgtttagtagagacggtgtttcactgtgttggccaggctggtctctaactcctgacctcaggtgatccacccgcctcagcctcccaaagtgctgggattataggtgtgagccactgagccctgctgctcccagtaaattctgctggaaagaccagagtgctcttttggccagtcgctcagcagtgtcctggccatctacccgaggatctccctgcttctggacctctgcttccctcccaccactgtcagggtggagccccctcgtcaccaagttgctgtactgcagtagctgcctcctggcaccaggtgtgcccacctcccaccacggctaccagagctgtcttcctcaaacccagctcagatggtgttgccctccacgttacatggctccacgctgccactagaatacagctccagtctttggtgtggcacccagggtctcgcagccagacccggcctgctgttccgaggcctcgtgcgttggggactccagccactcctggcctttgtgttggggccctggctaactttcatattttgggtagagatggggtttcaccatgttggccaggctggtcttgaactcctgcccttccctaatgtgtggtgcatgttcatgccacccatttgcttctcttcctggggcctagcattccttccgtgggctgctttccttcaactcttcttccttcaggactcagttgagatcgcacctccccaccagacattcttcattgactgtccccatcatagcactgtgcttctacctgtcatttcagagccaagcacggtggcgcacacctgttgtcctagctacttgggaggctgaggcaggaggattgcttgagcctgggaagctgagcctaatctaggcaacagagcaagctcctgtttcttaaaaaaaaaaaaaatacacacatatatatatatatatatatatatgtaattttagtttgactcacattatttttgttgaaagtttacacacggagtgtgtagggactttacaggcagagaccaattgcttggtgacagtacgtacccaacaggatttttgttttaatttgggatggggtctcactatgttgcctaggctggtctcaaactcctgggctccagtgatgctcccacatcagcctcccaaagtgcggggattacaactgcatgcagctgcaccagcaggatttaaaatgtcagggaaagtcagtactgtttgcagctccatttctgagtaactctgggatgtgagttttgatcctatatttggccatgttactggtagtcaaagataaaactgccttccatgcaagtacaggatgtcatcacacacagtagcctggtggatgatgtgactcccaccctcccaggaaaattctcatctcttgctctaagttgccatcagccttcccagggcatgaggcagaagatgttaggttataaaaacttgtcggccaggcatggtggctcacacctgtaatcccagcactttgagaggccaaggtgcgtagatcacgagatcaagactatcctggccaacatggtgaaaccccgtctctactaaaaatacaaaaattagctgggcatggtggcttgcctgtagtcccagttactctggaggctgaggcaagggaatcgcttgaacccgggaggtggaggttacaaagatcatgccattgtactccagcctgggaacagagcgagactccgtctcaaaaaagcaaaccaaaaaatcttgttagagatacatttacatgtgttctcccttcagccctggtgttttctttacaagtgtcttcctggttgtatgagtagcaagcagccttggacagcatgacctctgctccctcggggacagtgttgaccttgggcagcactaactcattgttaggtcaggaccatcatcagtcttctctaaaaggcaagcagaaattttaatttcagactgggtgtggtggctcacgcttgtaatcctagcactttgggaggttgaggcaggaggatcacttaaggccaggagtttgagaccagcctgaccaacatagcaaaaccctgtctctacttaaaatacaaaaattagctgggtgtggtggtgggcgctgtagtctcagctactcaggaggctgaggcacaagaatcgcttgaacccgagaggcagaggctccagtgagccaagattatgccactgctgagccaagatggtgccactgcactccagcctgggcgacagaatgagactctgtctcaaaaaatactactaataataatcaattaattaaaaaacaaggccaggtacagtggctcatgcctgtaatctcagcacgttgggaggccaaggcaggcagatcacctaaggtcgggagtttgagactagcctggccaacatggtgaagccccgtctctactaacaatacaaaaattagccaggtgtggtggcacatgtctgtaatcccagctacttgggagcctgaggcacaagaatcccttgaacctgggaggcagaggttgtagtgagccgagatcacgccactacactccagcctgggtgacagagcaagactctgtctcaaaaaaaaaaaattaaattttaatttcaaggatgaggatgactttagcgaagtatcaaataatgaacatgatttctacctttaatttttttttttttttgagacggagtctcgctctgtcgcccaggctggagtgcagtggcacgatctccgctcactgcaagctccacctcccagcttcacgccatcctcctgcctcagcctcctgagtagctgggactacaggcacccactgccatgcccagctaatttttttgtatttttagtagagatggggcttcaccgtgttagccaggatggtctcgatctcctgatcttgtgatccacccgcctcagcctcccaaagtgctgggattacaggtgtgagccactgcgcccagcctcaattttttttttttaaatacagcttccctcttctttctacccctatacaaattaccagagcaattactgctataggattaaattaaaggaattcttaaattaaatggttggctgctgaaccaagttgtagcagttgaatatggaattttgtagtgatttattataatcctagtttttggaagaaaatttgcatcacttagcagatatttaagatgcttgtaacatttcatttcccagtacacataaatatgcattatgtcaggcattggaatgtttagcaaactaatgaaatttgtaatttaatttatcaggtcacagcatttaatgaagaactattcagtgtcagtttatgccgttaggtaacaaacaggattgtgttacgcagtaatttatacagaaaagtattttataaataaaatgtcaaataaatgccactttttgttttaaaatgatatgtttaagaaataatcctaaagggaaaatgtctgctttgtcgaataaagtaattaaagcatttttttaaaacaagagaaaaaaataaggacaaagcagggacagacaggaaaatgtcagtgtgtttgcatcagccaggctgggctgtgcttcggtagcaagccccagatatcagcgacttcacacagtgaaccgtggcccccgctccacgaagctggccctgcatctgtcctcttctagggcagtggtcctccaggtggtggcttcctgatcctgcctgctttgctctgcggctccaccatctcggttccttctgctcagagcctgttgccagtactggtcgtgggtcctgcctaactctaagggaatgtgagggagccatggagtgcttggggagggctgtggtctctgccaccgcgttcaccacatcctgaccacttcttccatggaacaggttcacaaacctcattcatccaggcggcctgggtgacactctggggtaaaagtctgcaggaaagccctcagttcaactttgtcatctttcacctgtctcttcaattcggaataagctggtttatgcactggaagtacatcatctagtagtcttttatatgtgttctgaaaggttgttcactgtgtaatgtgaactccgtgttctgtgagcagtgttgttgctgccaactctgagatgctggcctggtgtgtttttgtcaccatgtgactctgttagcatgatcactgctgcctgtagtttctcttagaggcaggttgaagactctaatgtaaaattgtcttttaattagcatttgtttctcagctatttctagagttactgttgaaggtactttattttgactggtacagatctttgcatatgtaatgttagagttccagggaattctgtttaaactccccggtaaaacattctgtacaagatcaaggaaggagaaaatacagttaatttttggaatagagaaattgtcatctttagaaaatgcaaagaggaataatgataattttttgtgtagcagtgaatgaatagctttaagttgatgtcataactgaagacacatgagattttcacatggcagagtcatgcctctgtgttttgctacactccgtgggctgtcatctgataccagtgacaactgtgcaagggtggtacctcccgattctgcacccagtgtggggcgtcctccacctgcccctctccagcagcaccaccagctaatggagctgcacaccttttattccccggttgaaagtcaaaataacccatcaaaattaaaaacttctcatccaaaaacactattaagaaaatgaaaaagcaaaccacagactagatttacaatgcacgtatctgacaaaagactagtacctacaatgtgcagagaactcctctaactcagcagtcaggagaaagttcattttaaaatgagcaagacttgaacaggcacttcacaaaagaagatatacagatgtccataagcatattaaaagattcccagcatcattccttagcaggaaatacaaattaaagccacgacatgatacaacttcacctctcctagaatggctgccgtggaaaaggttcaggggtgcgggcagccagaacccgcagacacggctgtgggtgtggagcacaggatctccattggggaaactggcggtttctttaaaaatgaaacaggccgggcgcagtggctcacacctgtaatcccagcactttgggaggccgagacggatcacctgaggtcaggagttcaagaccagcttggccaacatggcaaaaccctgtctctactaaaaatacaaaaattagctggacgtggtggcaggtgcctgtaatcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaaaaacaaaaaaacaggaggcagaggttgcagtgagccaagatcacgccactgcactccagcctgggcaacagaacgagattctgtctcaaaaaaaataaaaaagcagtcagttcagcagttacctcagggtagagggcattggccagaagggagttgagggaactttttggggtgactaagttgtttaaaaccaattgggacaggcgtagtggctcacacctgtaatcccagcacttcgggaggctgaggtgggtggatcacttgaggtcaggagttcgagaccagcctggccgacatgattaaactccatctctactaaaaatacaaaaattagctgggcgtggtggcacgcgcctgtaatcccagctactcaggaggctgaggcacgagaatcacttgaacccaggaggcagaggttgcagtgagccaagattgcacccctgtacaccagcctggatgacagagcaagactccatctcaaaaacaaacagaacaaaaaacaaaaacaaacaattcaacttagccctgaagatctgtgcattgtgctgtaggtaaagtctcagaggtcagaggttgctgatgcagaggacccaggctgacccaggtccaaaccttagatcctcctttgcctcctggcctggccacctcctgccgtgtggccctcagcagatctctttctggctgagtcccgacggtctcatgggtgaagtgggatgatactaatcgtgtatcattgttgtgggtttgagatgagtatatgaagacctggctgacagcctgtccacagcagctgctcaggaactgttgactgctgttcttttagccagactattatcaaatgtaatttctatttttaaaaaactcttcccatttcctttcctcttgcaatcagtctcaatagcagtaagaaataaataaaaatgaagattctttgggagacttagttttgtttttttttgtttttttgagatggggcctcgctctgttgcccaggctggagtgcagtggcaccatcacaggtcactgcaacctcgacttcctgggcccaaccgatctcagcctcccgagtagctgggactacaggtgtgtgccaccacacccaactaatttctgtgtattttgtagagacaggatctcactatgctgcccaaactggtcttgaacttctgggctcaaccgatccacccgccatggcctctgaaagtgctaagattacaggtgtgtgccactgtgcccagtcagtttaattctaattaagatcaagattatctgtaaatacgagttccctctctccaaatctagaatttgctggcattagtcacatgtctgaggaagctgacgatgggacccacattgagatactaatcccagggctcggtggttcagggcactgtactgacagcatcttgactgctttgcctgttgcctggaaggggtgccgtgtggcgcctggcaggtggcagagtggccagaggccattattactctcttgagttacggtgttctcaagcccagctgagtccacacagccgatgtggatggactaggacagatccgatgacttagtgtccaagttcaattgcaaatgcagcctcatttctttctttgaagtagaaaatcaaagttcatagattagatgaaagaatagtcattgtacaaaagtaattatagtgtgtgtacttttctttatctacaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccaggtaagcagaagttagctggtggaactcactcttcagtaagacagaaactgtgaggatgctggtactgggaaaaaggatctgcacagcctctagaggcctcccagcaaatgcggggagccatgcccccagggtctacacactctcgttcatcaacatcacaactggaattcgggatttgtgaagtttagagctgaacagactgttacagattatgagtcaacacgtatattttctctttcaaaataataatatttcgtttttgactttttactaagtgaatattattttttaaatctgcctatatattggaacctctattttataataataatgataataaatcagtacccagaagtataaagaaggtaaaagttactttgaatcttgtcatggagaaaatgctgagtgcctctcctggtttgttgaagaaattccgtttcctgtccagcccactgctggccagctcctgccatgtttcagctgaccgtgcatcccaacacagagtctgtgttctcctgacctccagcactcagctcacaaggagaagtctgatttgaatgtactatctagttacccttaaagatcccacaggcttggttcctgtgctgaatagatttctgttgaagtttataactgggggctgtggttttttgagacttatttgcccagactcctgccagcccccatttggtgactctgttgggaaacaggtgaagttgccaattgtggaggcagcagtggggcaggggggatggttcgttgttgggcagagaaaccttcagtggagtcaggaaagaggtaaagagtagggtaaatgcctttgtgcataactgtctacattttggtcatggtgaggcctcagggatgaggacaccagtggtgtccaccagccctggggagtgtggtggtgggagaacctttactgaaatcagcattcggctccagagctctgtggaggccaccactagcggtcatggccacagggaggcttctcgtcctccttggtgggtcttcctcctccagagggtgatggggatgatattgtctatgacaacactttgtgaatgatacggcactgtcaaacatgaggttgtacataatgaattataacacatgctctgttttccctctgcacacggtgacgtactcatagtggcacagagggagagtccaccctgcagagaggagccttcctcactgccatgtttagcactgctggggcacagtgattatgaaaagcaagccgcctgtcgttagtttcattattgtccttaaattctctggttgcccgcacccaggtggactcctttgacacaccactgtcaatacgttcctttttttccttctaacaactttatatttttccttttaagttacaacccgcataacataaaatttcagccttctacagtgtgcagctcagtggctttagcatcagttagcagcagttagcaccatccaattccagagggttcccatcactccaaaacagagagaacacccttacccattagcagtcacttcctgttctcacagaaccagcccctccgcccatggcagccactcatctgctttctgtttctatggctttgcctattctggacattttatataaattggatcatataatatgtggccttttttatctgacatctttcactttgtatcatgtttcggagttcatccacgttgtaggtgtatcagttcttaattcctttttatgactacatcacagctctgttgtatggataggccacattggtttatcatttcaccagtggatggacatttggattgtttctgcttattggctactgtgaataatgctgctgtcaacatatgtgtgcaagtctttagggaggatgtatgttcccagttctattgggtatctgtctgtaagtggaattgcaggtcatgtggcgattctgtgttgaactttttaaggatgtcaaagtgtttttcacagtggctgcaccatttgtgttccaccagcaagatatgagagttctagtttttcccatcctcaccaattttttttttttttttttttttgagccagagtttcgctcttattgcctagtctggagtgcaatggcgccatcttggctcactacaacctccgcctaccgggttcaagcaattatcctgcctcagcctcctgagtagctgagattacaggcatgcaccaccatgcccaggtgatttttgtatttttaggagagacggggtttcaccatattggtcaggctggtctcgaactcctgacctcaggtaatccaccctcccccggcctcccaaagtgctgggattacaggcatgagccactgcgcctggcctttccaattttttgttgttattttatttttctggtctcagaaactgcctcatatgtctaattttttaatactagtcatcatagtagttggaaagtggtatctcattgtgggtttgatttgcattgacctaacaactaatgatattgaacatccctcttttcatgtgtttattggttatttgtgtatcttctttcaagaactgtgtgttccttttttcttttttttttttatgatggagtctcactctgttgcccaggctggagtgcagtggcgcaatctctgctcactgcaatctctgcctcctgggttcaagcgattctcttgcctcagcctgctgagtagctgggattacagacatgtgcctccacgcctggctatttttttttttccatatttttttagtagaggcagggtttcaccatgttggccaggctggtctcaaactcctggcctcaggtgatccgcccacctcggcctcccaaagtgcttggattacaggcgtgtgccaccacgcccagcctcaaatcttttgctcatttttaaattgtgttatcttttactgagtttgtttgtttgttttgagatggagtcttgctctgtcgcccaggctggagtgcagtggcatgatctcagctcactgcaacttctgcctcctggattcaagtgattctactgcctcagtctcctgagtagctaggattacaggcatgcaccgccatgcctggctaatttttgtatttttagtagagatgggggtttcaccatgttggccaggctggtcttgaactcctgaccttgtgatccgcctacctgggtctcccaaagtgctgagattacaggtgtgagccaccgtgcccagcctgttgagttttatatatgagttctttatgtattctgggtactagacctttatcagacacatgatttacaagtattttcttccattctgtgcattgtcttttacttttttatgatgttctttgatgcacaaatatttttattttgatgaagtccagtttattaattttttcttcatttgcttctgcttttagttgcctaatccaaggtcacaaagatttacctctatgttttcttctagcagttttgtagttttagctcttacattaagtgcttcatccattttgagttgatttttgaatatggtatgagataggtgtccaaatgcattcttttacatgtgggtatcgaattgtaccagcaccatttattgaaaagactattctgtccacattaaattatttcaacacccttgtcaaaatcaattgattgtaaatataaaggtttgctactggactcttagttatatcccagtgatctgtgtatctatccttaaactacactgtcctgattacttagctttgtcgtaaattttgaaatcaggaagtatgaatcctctaactttttctttttcaagattttttcagctacatggagcccctcctacatccatgtgaattttgggataagtatgtcaatttctgcaaaaaaaaatactaactggaattttgaaaggaattgtgtcgaatcagtagataaatttggaaaatcttccagtctgtgaacatgggatgtcttcccatttatttagatcttctttactttccttcaccaatgttttgtagttttcagagtatatgttttatactgcttttgttaggtttatttctaagttctgtattccctttgatactattgtaaatggagctgttttcttcattttcagattgcccattgctagtatagatttttgtatattgatcttgtgtctggcaaccttgctaaacttgtttattgggtctaacaggtttttgtagattcttttgcattttctatagatgagatcatggcttctgacatggtctgccaatagagataattttacttcttcctttctatctgtatgtcttttattttactgtcttgcctgattgccctggctggaacttctagtaaaatgttgagtagaagtggcgagaatgggcctcctagtcttgtttctgatcttaaggggaaggcattcagtcttttaccattaaatatgatgtgagctttgtgttttcttaggctccctttattaggttgaacttcccttctactcctagaaggaattctaggagttctttctgttcctagtttgttcagtgtttgttatgatgaaagggtgttgggttttgtcaaatgctttttctatgcctattgagatggtcatctggtttttttcctttattaatatgatatattatactgatggagttttatatgttgaaacacagtttcattcctgggttaaatcccagttggtcatgatgtgaaatcctttgtatgtatatgttgctggatttggtttgctaaagttttgttgaggatttttgtgtctatattcatgagagatattggtctttggttttcttgccatgtgtttgtctggatttggtatcaaggtaatgctgctggcctcatagaatgcactgggaagtgttttcttcttttctactttttggaagagtttttgaaagattggttttattttttacaccccatttgttagaattcgtcatcccatccatgaattcatgtagccatgtaggcctgaactttttttgtgggaagtttttttgactactggttcaatctctttattcattataggtctattcagaattttttttttttttttctgacatggagtctcgctctgtcacccaggctagaggatgttggcgcgatctcggcccactgcaacctccgtctcctgggttcttgcaattctcctgccttggcctccctagtagctgggactacaggcatgtaccaccacacgcagctaatttttctatttttagtagagacgaggtttcaccatgttggccaggcttgtcttgaactcctgacctcaaatgatccaccctccacagcctcccaaagtgctaggattacaggcatgagccactgcacccagcctattcagaattttctatttcttcttcttcttctttttttttttttttttgagatggagttttgctcttgttgcccagactggagggcaatggcacaatctcagctcactgaaacctccacctcccaggttcaagcaattctcctgcctcagcctcccaagtaactggggttacaggcgtgcaccaccatgcccggctaattttgtttcttgtgttttttttttttttttgagacggagtctcgctctgtcgcccaggctggagtgcagtggcacgatctcagctcactgcagcctccgcctcctgggttcaagcagttctcctgcctcagcctcacgagtagctgggattacaggcatgcaccgccacacccagctaatttttgtatttttagtagagatggggtttcactatgttgaataggatggttttgatctcctgacctcatgatccacctgcctcggcctcccaaagtgctgggattacagacgtgagtcactgtgcccagcctaattttatatttttagtagagatagggtttcactatgttggccaggctggtctcgaactcctgacctcaagtgatcttcccacctcggcctcccaaagtgctgggattacaggtgtgagccactgcaccctgcctctctttcttcttgagtcaatctaagtagtttattctttctaggaatttgttcatttcatctattttatctaatttgttggcatccaattgttcacagtattcttctgtaatactttttatttctgtgaaattggtagtaatgtctcctctttctgattttataatttgaattggctgggcacagtggctcatgtctgtaatcccactttggaaggttgaggcaggaagaccacttgagcctaggagttcaagaccagcctgggcaacatagcaagacatcatctctaccaaaaaaaaaaaaattacctggacctgatagtgcacctgtagtcccagctactcagaagactcaggtaggagaattgcttgagcccaggagttcaaggctgtagtgagctatgattgccagttttattgccaattgccactatactccagcctgggcaacagagcacaacgctaataataataataataataatttgaatcttctctcattttttcttagtctagctaaaggtttgtcaattttgttgctcttttcaaaacacctccttttggttttcttgctttttctgtgttgtttttctatcctctatttcttctatttccactctgttacttcctccacacattcttgtgcacagtgctttgcttgatagtgatattcctctggtagctccaaggaatatttgtcacaattatcacgtacatgtggaagacctgtggtaacattggactgtaaagtttgtaggatcccagtgcagaggcaggctgctgagtgcaagagcgagatttgcaggatgtgttgtagaaagaacgtccttgagtgggttgagcgcccatgtgccttgcctcctccttttcccagcaagccagaggccaggatgctggagagtagggcaagcaggaagctgccgatctcagtcctcagtggggctggagccacccttgcctctgctgtgtgcacctctctgcagccatggggccacacaggtacctggcaaaagggttacatggagaacggtgtgcaaccacaatttcctgttcctgtctccatgtagactctagaataacctctaggaagcaaagctaaaatggggaagagagctttgcttaaagtgctctattgactgtggtgatcaacagctttgccaggaaaatggccaaaatagaacaaattcacatgaaaggacctcaaagctctgctctgaataaagtagtgattgctaaatgggatgttaagcatgaactatttcaagtagttctgctgaatagagccacattttctcattgagttagcttttagcatgctatggaagacattcagtttgccatggattctgtagatacaaaatgcttttcaagttggtttctgtgggaaagaaatcaggcttcacatgtacacaggcctttctactgcactttgccaagcactgccttatccttaacccttttattgccccaggaaatagaaaagtccgtagttccccctactttacgaggaaatctgttacccagaacagttgagcaatttgcccaggatcccaactctggtgtgtgccaagcccaggcagggacccaggcccccagctcccaggtgctgcccctgccgaggctcccctgggctgaggaaggcgcttctcccgggctgctggcactgacgattgtttgctgagatcagaagtgaagacaagctctgctgccaggcgctcgccttgtgccaggctaatgcctgaagcacatctttccctcagtcctcacaacaacctgggaagtgactgcgtctttccccatttgacagaggagaaaaccctagctcagaggttcagaaagttgcctgaggcctcatagcgggcaggcggcaggggtgggacatagacccaggtgtgtgacacccgcctctgcctctcctgtggctctgaggtccaaggcctgggccaggaccaactgcaggatggcagcaagcaccaggttgtggcgacatgtcataggcttagtggcctcacacgtcgtattttaggacaaagcctacacatgcgaatctttaaatcgcagagggtcctgcaaatgagcccaggagtgaggggagatgggggttcactctgaggactggaacgtcagaagagttggttgaatctgaggattggagaacaagcggggtttatgtattttgattatgttctacatctttccactttgttttatttgttcttcgacttgagcttcttcatctgcgtagaggatgtatttgcagtggaaaaggaaatggaggcaggggatagatgctcaagggcacatgaagtgaagccacagaaatcttttaaaattagcatcagcttctctatttagttctgttgtcctattctcttctctgggaagatacccctcctgtagtagttttgcggtaaagttttaacaaagtactcaaaacaaatgactcagttttcagatttgctaacacttgcaagggtttggagaaaatatttatagttgtgtttagcatcttcatagtctggagtttgctgtttgagttagagaattttctgtctgtgttagaggtacctctaacgcaagcatagttggtgtgaagtttcacattctgtgtgccccatgtgcttgagtagaagaggtgtctgttcttactgtgcttacagtggactctgaaatggtgtctatggtgtggttccagttttgtaaaacaaaactataaaatcccactaggctgggtgcagtggctcatgcctataatcccagcactttgggaggccaaagtgggaggatcacttgaacccaggagttcaaaatcagcctaggcagcgtagtgagaccccgtctctacaggtaattttttaaattagccaggtgtgttggcgtgcacctgtggtcccagctactccagctactcaggaggctgaggtgggaggatcacttgagcccaggaggtcaaggctgcagtgagccatgtttgtaccactgcactccagactgggcaacagagcaagaccctgtcttaatcaattaataaaaataaaaaataatttctcactgaaaacctagaagaaactacaacaaaggtgactgttatggggccgggcacggtggctcatgcctgtaatgccagcactttgggaggcccatgtgggcagatcacctgaggtcgggagttcaagaccagcctgaccaatatggagaaaccccgtctctactaaaaatacaaaattagctgggtgtggtggtgcatgcctgtaatcccagctactcaggaggctgaggcaggagaattgcttaaacccgggaggcggaggttgtgatgagccgagatcgcgccattgcactctagcctggacaacaagagcgaaactccatctcaaaaaaaagactattttgatccagggattataagtgattaaaatttaccatgttttcccataatgggtaggaaaactttttcatgatcagggagaaaaataggtatattttacaagggacccatcttttgtgggtcagtgagcaacctttcttctccgaggcacgtctctgacctacccagcccatataaatctgaaccccagtaggttgtccccccttccccctgccccacacaaagattttagagctagaaggagactggaaaacacataaccttgccacttccttctgcagatgaggaaagcaaggcctggcaaaagcaaggttcctggtctcagggtagtcagtggttgtgccgggcctcctcagcccctcatcctcaaggcccacaacagagcagcggcaagaacagtcccatccagggacactcacaggctaccgtagagacacacgcaaaccactggcgcctgtgcttccagagctgtgggcagagtgccatggagccagctggagagggaagtgctgtcagggccttggagtggtcagaggatctcacaagaggtggcactggtacaagaaaggcaagtaggagtgtagcaggcaggcaggacagagggtgttctaagcagaggggacatgaagtataggcactgagcagaaggcacccttgcccagggtgcagaaaggggctgtattgggagactggcacaggccggggcagggagggctgggctaaggcattggcatcattcttgaagagtttgaagccaggcaggtggcctggtcagaccatgtttgaggaaggagcctgtgtcacaattccctgtgaccagtcagagggtcttctgctggacagatcacatgcacccataagtaggtcagatgcccaggagtgttttgcctcagatatggagcaaaattagcctgacagtaaatgcagctctggtcctacctactggagcttaaagcaagactccgaagaatcaaactgtttcagagtaacttaccagcatcttagaacaaagctcaagaatatttacagattgcaaaaatatccaacatcagcaagataaaattcacatgggcaaccaattaacatttacccaacaagcagagaagcaggaaaatacgacctgcaatgaaaggggaagaaatccgtcaataggagctgacccagaaatgatacagatggtaaaattcatagacaggacattaaaacagttgttacacctttatgtgttcaagaagctagtagagagattcagcctgttaagtagaaaatgagagatagaaaaactccaggctaggccaggcatgcaacggctcacacctgtaatcccagcacattgggaggctgaggtgggcagaccacctgaggtcaggagttgcctggccaacatggcaaaacctcatctctactaaaaatacaaaaattagccaagcgtggtggcacacacctgtaatcgtagctactcaggaggctgaggcaggagaatcacttgaacctgggaggtggaggttgcagtgagcaaagattgcaccactgcactccagcctgggcaacagagcgagactctgtctcaaaaaaaaaaaaaaaaaaaaaaaaacaatatcaaaaaactccaggctgggtgtggtggctcgtgcctgcaatcccagaactttgggacgctgagctgggagaattgcttaagctcgggagttcaagatgagcctgggcaagatggcaagaccctgcctctaaaaaaaaaaaaaaacaacaaaacaaaaaacaacaactcaaatcaaatttgtagggattaaaattgcaatgtctgagctgaaaaatatcactggatgagattaatggcagcatagaaattgcagaagaaaagactagtgagcttgaagacacagcagtgaaaaaccatccacactgaagcccagagggaaaacaggctggaaaatgttcagagaatcagtgagcacagaccccttcaagtggcctcacgtaaatgaaatccaagtcttaagagggaagaagggtgacaggaaaaaaagatgtgaagaagaaatacaactgaaagttgtccaaatttgatgaaataattatgctgagtcaagaagccaaagaatacatactgttatcatttcatttatataaaatttggccaggtacagtggctcatgcctgtaatcccaacactttgggaggctgaggcgagcagattgcctgagcccaggagttcaagaccagcctaagcaacatggcaaaaccccgtctgtacaaaaaatacaaaaattagctgggtgcctgtagtcccagctgctcaagaagctgaggtgggaggatcccttgagcccaggaggcagaggctgcagtgagccatgatggctgccacctcactccagcctgggtgatagagcatgaccctgtctcaaaaacaaacttatttatataaaatactagaaaatgctaacacaggccaggtgctgtggctcatgcctgtaatcccagcactttgggaggccagggcgggtggatgacctgaggtcagtagttcaagaccagcctggccaacgtggtgaaaccccgtctctattaaaactacaaaagtcagctgagtgtggtggtgcacacctgtaatcccagctacttgggaagctgaagcaggagaattgcttgaacctgagaggcagaggttgtggtgaaccgtgatgacgccattgcactccagcctgggcaacagagcgagactccgtctcaaaaaaaaaaaaaaggaaagaaaatgctaacacagatcagtgcttactcaaggcctggcagaaatttcaaaggggaggtgtggcagtggcttcaagagtgtatgcatatgtcaaagcttacccaattatgtactttaaatgtgtgcatttcattgtatgtcagcatacccctgtagagctggtttttttttttttttttgagacagaatcttgctctgtagcccagactggggtacagtggtgcgatctcggctcactgcaagctccgcctcctgggttcataccattctcctgcctcagcctcccaagtagctgggactacaggcgcccgccaccatgcccggcaaattttttttttttttttgtattttatgttgatacagggttttaccacgttagccaggacatacaaaaaattagccaggcgtggtggcgggcgcctgtagtcccagctactcaggaggccgaggcaggagaatggtgtgaacccaggaggcggaacttgcagtgagccgagatcgcaccactgcactccagcctgggtgacagagcgagactccgtctcaaaaaaaaaaaaaaaaaaaaaaagagttagccaggacggtctagatctcctggcctcgtgatctgcccacctcccaaagtgctgggattacaggcgtgagccaccgcacccggcctgtttttgttttttagagacagagtctcactccattgcccatgctggagtgcagtggagtgattgtggctcactgtaacctcaaactcctgggtcaagccatcctcccacctcagcctcccaactagctaggacactacaggcatgcaccaccgcacctagctaatttttaaaaaaatttgtagaggcatagtcttgctatgttgcccaggctggtcttggactcctggcctcaagcaagcctcccaccttagcctcccaaagtactgggattacagatgtgagccaccatgtctggcctctgtagagttgttttaaatattaaagtgtacaaaaaaaaaatttaaatgggccgggtgtggtggctcatgcctataatcccagcactttgggaggtcgaggcgggtagattgcttgagctcaggagttcaagaccagcctgggtattattgtgaaatcccatctctatgaaaaatacaaaagttagccaggtgtggtggcatgtgcctgtagttccagctactggggaggttgaggctgcagtgagctgtgatcatgtcagtgcgctccagcctgggtgacagaatgagaccctgtctcaaaaaaaaaaaaaagttttaaatgaagattatagggtaccctacattgtgtttggtttgcagagggaacagaaatgagtgaagctgcctaagcatggtggctcacacctgtaatcccagcactatgggaggccgaggcaggtggatcacctgagctcaggagttcaggaccagcctgagaaacatggtaaaaccccatctctaccaaaaatacaaaaaattagctgggcatggtggcacatgcctgtaatttcagctactcgggaggctgagatgggaggattgcttgagcccaggaggcggaggttgcagtgggctgagatcatgccactgcactccagcctgggcgaaagagtaaggccctgtctcaaaaaaaaaaaaaaaaaggaaaaaaaaaaggaaatgattgaagctgtttttggagttaactgaccaaaagttaaatgactaaaagaagagcgaggcaggaggttatagaagcaatcatgaaaaaaatacagatccccagggtcccaaacctggtttccgaggatgggtagtgtttgaacttggacttgagactcaatgggcattttcagtgaccagcaggtaaagaggcttggcctagtgtttctgagtagggaagagtgctcctccctgctgccttgggaggactgtctgctgctggaccaccctgaggactgtgagacattagctctgtgggcttctaggctcctggcagtgaacctctgggagtgaaggatgcacaaaggatgttgtgggaaagagaagatctgagatgtcctttgggtcatctttggaggatcttgactctgaggctggagggtttgtggctaattccatgggcagtgggggctgttggaggctcttgagcagggccggacaggacccaaatggagaaggtctgcagtgagctgtggaaattctttggcctgattcgctggatttgtggtgcacatctgtgagatgtgagattgggatggagtggacatggggactctgacatggattgttttggggcagaagaagccaatccatgctggcgtcccagcctgggtctgtaatctcattaatctccttttggtgactggaccagttgcctgtacaagtgcctcttggtctccttgatccaacctcactgagccagcgtcgcttgtatgcatgatactgcaagacttccttcccagctggcctgcacgcaggtgccttggagaggcattgggcagatggcatgtggccatttccagcagtggggcgcagtgctcagggagactgcagcatcctggagccctgccagccaggagggactgttcccattgcgggcagaatctgttacttgcaatcagaagaacttcaactaatacttgttttttgcctgtagattcaattgaccttgggaatgttgcttaaactcgcctttcactttcattttcctatcagtaaagtgaagggtcatatccacattagagccatcagaggagcttattaaaaatgtccaggcctcggccctccctggagatatgaattcagcaggtctggggtgaggcccaggcatcttggttggtttttttttttttttttttattgatttatttgagacggagtcttgctctgtcgcccaggctggagtgcagtggcatgatctcggctcactgcaagctccacctcccgggttcacgccattctcctgcctcagcctcccgagtagctgggactacaggcgcccaccaccacacctggctaatgttttgtgtttttagtagagatgggttttcactgtgttagccaggatggtctcgatctcctgaccttgtgatccgcctgccttggcctcccaaagtgctgggattacaggcgtgagccaccatgcccggcctattttttatttttgagacagagtctcagtctgtcattcaagctgaagtgcagtggtgcgatcatagctcactataaccacaaacccctgggctcaaacaatactcctgcctcagcctccaaaatggctaggggtatgcaccatcacacctggctcattttttaatttttattttgtagagatgaggtcttgctgtgttgtccaggctggtgtcaaactactggtctcaagtgatcctcccacccctcagcctcccaaagtgctgggattgcgggcgtgtgccactgtgcctggccagttttgttttttggttttgggtttttttttttttttttttttttgagatggagtcttgctctgtcgcccactggagttcagtggggtgatcttggctcactgcaacctccgcctcttgggttcaagtgattctcctgcctcagcctcctgagtagctgggagtacaggcacccgccaccacgcctggctaattttttttttttttttttgagacagggtctcactctgtcacccaggcgcgtagtgcagtggcacaatctcagctcactacaacctctgcctcctgggttcaagtggtcctcccacctcagcctcttgagtagctggggctacaggtgagtgccactatgtatttgtatttttagtagagacggggtttctccatgttggccaggctggtctcaaactcctgatctcaggtgatctgcccgcctcggcctcccaaagtgctgggattgcatgcgtgagccactgtgcccagccacacccagctaatttttgtatttttagtagagatggggtttcactgtgttggccaggctggtctggaactcctgacctcaagtgatccacctgtcttggcctcccaaagtgttgggattacagataggagccaccacaccgagcctggtttttatttttcatgaaagtcatacatgaaatgccaagtgtggtggtatgtgcctctagtcccacctactcaggaggctgggtgggaggatcactggagaccaggatcatccaccgcactccagcctgggcaacagagtgagcctccatctgtaaaagaaagaaaacagagtcacatgtgaaaatcagtaggttgacatgtcagtgggttctataagatgtgctataagaaacatgtctctcctgccaattttgccctctctggagagttcctttcagttcttttcgctgcctgtctctgaatgctgcttcgggagctgtgtttggtcccctgacttcaggtgtttctggttgactctctgcgggaagagaagcatgcagagctcttgcatcccccgtcccccattcccccagccacccacctcccttcctacttccaccctgccagagctgcagtgcttcctgggcacgggccttgctgtgaggacagaggagctcttcacagcggaggcaggggatgaatcacacctgcagttccttgtctgtgtgactctttgttttccctggacttgataatcatcttgtttgctcatctagttttttttctttttttttttgagacagagccttgctctgttgcccaggctggcgtgcaatggtgcgatcaatctctgctcactgcaacctccaactcctgggtccaagtgattcttctgcctcagcctcccgagtagctgggcttaacaggcgtgtgccaccacacccagctaattttttgtatttttaatagagacagggtttcaccacattggccagcctggtctcaaactcctgacctcaggtgagccacctgccttggcctcccaaagtgctgggattacaggcatgagccactacacccagcctgctcatctagttttctaagtgcagttccacacattcaatcccaaactctctgccagttgtctcacacattaggaatgtgtcctctccatttcttccccctgcagagatctctcctgcaccctcttggccagctccagtctggcctcgttcctctctctacccgggacccagctgttgtcctagcgtcacctttgacctcccctcatgttagagcccctttctcccggatcccgggtcttcctctctctgtgtctgtgtttgtttgggtggagtttatcttccagtcggttcccaaggaagggttcatggttggtgactttttggaggtattgcatgtctgaaaagtctttcatctgtgttcacccttgaccttgctggatatagcagtctaggttggaaaccattttcctttaggattttgagggtctttctccattgtctctcggcttccaggattgctactgagaagccagaagcctttctttttttttttttttttttttttgagacggagtctcgctctgtcgcccaggctggagtgcagtggcatgatctcggctcactgcaagctctgcctcccaggttcacgccattctcctgcctcagcctcccgagtagctgggactacaggcgcccgctaccacgcctggctaattttttttttttttgtatttttagtagagatggggtttcaccgtgttagccaggatggtctcgatctcctgaccttatgatctgcccgtctcggcctctcaaagtgctggaattacaggcgtgagccacctcgcccggcccagaagccgttctaacacctgatccttgatacttgacctgtttttctttctgaaagtttgtaaggtctctttgttcctagtgttataagaacagatacatagtggtatgccttggtgagggctgtgttcatccttgcagccaggtggttgcagcctatgtgctggtgggtgtctgggtcctctgctggggtcctcttctgccccgcctctcttgttttcctttttttgttgttatgtttttgtgtgttgttgttgttgttgtagggttttttgttgttgtggggttttgttttgttttgttttgtttttgagacggtctctcactctgtcacccaggctggagcacaatggcgcaatcacagctcattgtagctttaaacttctgggctcaagcaatcctcccaccacagcctcccaagtagctgggaccacaggcatatgcaccatgttcagctaatttttttattattttttgtagagatggagtctcactatattgcccaggctgcttttgaactcctgggctccagcaatcctgccaccttggcctcccaaagtgctggattccaggcatgagcaactgcacctggcacccctcctgttttctgtctgctctggctgaaggcctccttttccttttctttttttttttttttttttttgagttggtgtttttgcccttgttgcccaggctggagtgcagtggcgcaatctgggctcactacagcctctgccccccgggttcaagcgattctcctgcctcagcctcccacgtagctgggattataggcacctgccaccatgcctggctgattcttatattttcagtagagacaaggtttcaccatgtttgccaggctggtttcgaactcctgacctcaggtgatccacctgccttggcctcccaaagtgctgggattacaggcattagctactgtgcccagcctggaggcttccttttgtattgtggactttctaagctggcctccacttttcctttctctcctgtttctgtctttttatgcttttatcctgctttctagaagacattctcaaccttatttctccaaccctctgtcagattatttccatgatcacatgtttaatttctgaaagttcctgttgttgtttgatggctgtagagtcagtcttctctcatctccctaaggatgttttggaagtttcttctccctgcctggtctttgtatgtcccaagttgtgtgttttctgtctagttcgccttttacatggcagaggctttcttcagatgttggcagtcccctggttggaagagtgaggcccagcaaggctgactggaagccctgagcacatgcatggagcctgtgggccccgcgggtctctgacagcaatctggctgggctgctgggtggggagtcgttgcttttagccttccagggcccgctgagtccttgccatgcatcccccactttccagcttccagaattgtatggctgcttcctcccctcattctctctgtccttaggagatttgaaccttttttctttgagatggagtcttgctttgtcacccaggctggagtgcagtggcccgatctcagctcactgcagcctccccctcctgtgttcaagcaattctctgcctcagcctcccgagtagctgggattacaggcgcatgccaccatgcctggctaatttttgtatttttggtagagacagggtttcgccatgttagtcaggctggtctcgaactcctggcctcaggtgatccggtctgcctcggcttcccaaagtgctgggattacaggcgcgagccactgcgcccgccccgtttttctttgtttaacccattccctctcatggtagtggtgcttgagaagggagtgaaagagtaattgtgtgctcattatcatcactgcccagaagcttctggcttcttcagcgccctgcaggtgactcttgcacatacccagcgctgagcaccatggtgcagctcatccccttcacctccacggttctggtatcacagtcttcagagtatagccactattttcctctaagcctctgaacatctttgagtggtatttaggtgctggtggggctgcctgttacactgtaagttgttccgtcagcacaactatgctgcctgcaaatgaaggtatgaaacctccccaaactgctgtctaatggtgtgggatggaaccagctccctttgagagaaactaaattgttttttgccacttcctttaattttttccatgttgcctttttttcctatacctccatttaaacatctattgtttttgagctctcttcttcaaaacttgcttctaggaactattacccctcttcaccatattgaactctaagtcttttctctcattctggaaggccatgatacctagaagtagaccacagggttctaacggggtgccctgggtcctgcagcagtcccctcatcgtgctttaacaacttatgacccagtagtttaaacaacgacctagggaagcttgtcccagcctgccctgcgtgtgcccccagtaaaaccatgagcggcaggaaggggagcccctcgcgatgcttgccatgaccctagaggagcagagcccagagatcatctttagggacctctccctctgggctgcactcatccagaaggtgcttccccgagcctgtctgtagagtcagccacagagcagggcgatgagctatcagagaccagggtgtgtgccactgggtccagcttctgctcttcttgtctcacagcaatatttgagtcctggtgctagccatggcgcagtcgttgggctggtatcagtgacaaggtctggagggtagacaggaagagtggccagttggctccaccagcccctgctcaggaaggacagaatgtgacaggcacccaggaaacctgcttctgagcgttttctttagcgcaccccctacaattagcagatgcagcttcttgctggattctgaggtcacacctcagaccagatgtagaggcccagcagtaactggagtcagtgcagaaggacccaccacggagagggagaggcctctgacaggccagaagagagcagcagtggagcctgtttctgtctggagccctgctctgctgggccagaagtttccaaatgttttttagcagtgggacccattcttcaaattaaaaaaaaatttttttgagttaggctcttgttccgtcacccacgctggagtgcagtgacacaatctcagttcactgtaacctcaacctcctgggctcaagtgatcctcttacctcatcctcctgagtacctgggactacaggtgtgtgtacaaaatacaaaaaacactcccagctgtccagccttaaataaaatcttgtacataagccagatgtgttcaacaagtaacagcaaaactggtcccatgaaactgccccttccacaggggccctgaggcacctctgcaaggccagggccccacaggcgctgctggaaaactgctggtcttcgggccagtgaggacagagagagagctcagcacagcaggccccgggcagccatacccacctcgtaccacggtcagagtctcgaggagcctcagagatcatggtccccggctcctccagctaaggacacagaccacgaagaggaggtcctcctagtgtgtcagccctggctctgagaatttacctttaatttaattctagacctattaacatgggtatcgggtttttaagcccatctgaaattgggaagaatagaccagaagcaggaagagggtctgctacagggaaaaaagaactagaaagaccaaacagaagtcagaaagtacagctaccacggggccatgtgacaaatggcccaaccaacccacacgcctcagcgccccctgaggctgcacggatagacggacagacacacagcagcaccatgaatccttgagggaaagtaaagctcagcatgtgtcagtctttacggggattcaaggttaaaacagggagggagagagacttggagggaaaagaaaaggcagtgtggaaagcacaaatggccgcctggataaccgtggtttgtttgggttaggattatttccagaggcgtctttcctggggcatttgtgctgccgcttcaaaaaccctcggtccaccctggtattcctgaaacattcctgctgaatttcttccaagttctgataagtccatgccaaaatggtctgtctagatacatgtttcctttggctgtgaaatcttcagcatgtttttgtttttcagcctgggtttaccacattctgactgaggaacatgtgtgagtgtgtgtgtgcgtgcgcacacgtgtgttgataaaagctatgataaaagctcagctacaagaagtttgaagaactgtggtctgagccccagacacttgtgttttctttttcttttcttttctttttttttgagatggagtctcgctctctcccccaagctggagtgcagtggcgcaatctgggctcactgcaagctccgcctcccaggttcacaccattctcctgcctcagactcccgagtagctgggactacaggcgcccgccaccacgcctggctaattttttgtatttttagtagagacggggtttcactgtgttagccaggatggtctcaatctcctgacctcgtgatccgcccacctcggcctcccaaactgctgggattacaggcgtgagccaccacgcccggcctgtttgttttttttttttgatacggagtttcactcttgttgccgaggctggagtgcaatggcgcgatctcggctcaccacaacctctgcctcccgggttcaagcgattctcctgcctcagcctcctgagtagctgggattacaggcatgagccaccacacctggctaattttgtatattttttagtagagatggggtttctccatattggtcaggcttgtcttgaactccggacctcaggtgatacgcctgcctcagcctcccaaagggctgggattacaggcgtgagccaccacgcccagcctcttttgcatttttatgaagtttttaatatgaataagccaaaattttagatcacctactactttttttttgtttttttagtagagattaggtctcgagctactgggctcaggcaattctcctgcctcagtgtctcatagagctgggattataggtgtaagccactgtgctcggccttttttttttttttaattgaatttttttttatttttttgatacgtagtttcactctttttgcccaggctggagtgcaatggcgcaatcttgactcaccgcaacctctgcctcctgggttcaagcaattcttctgcctcagcctcctgagtaggtgggattacaggcgccccccaccacgtccggctaattttgtactttttttttagtagagacgaggtctctccatattggtcaggctggtctcaaactcccgacctcaggtggtccgcctgcctcagcctcccgaagtgctgggattacaggcatgagccactgcacccggcctaattgaaatttttattgagataatggtcactgcacttgtatttataagaaatcctgagtaccctttacccagttcacagcaatggtaactgcaaaactatagtacactgtcacaaccaaggcttgtctacttttttttttttctaaattgtgataaaatacacatgagatttaccgttagtgacagtacatttgcaatgttgtgcaaccattgtcactatatagttccagaacattcttttttttttcttttttgagatggagttttgctcttgttgtccaggctggaatgcagtggcacaatctgggctcactgcaacctctgcctccccaggttcaagtgattctcctgcctcagcctcccgagacactaggactacaggcatgcgccaccatgcctggctaattttgtatttttagtacagatggagtttcaccatgttggccaggctggtctcaaactcctaacctcaagtgatctgcccacctcggcctcccaaagtgctgggattacaggcatgagccactgtgcccaacctagttccagaacattcttatccctcaagaaagcccctagcaatgtgaagccactccccattcctcctccctcctctctcccagcctgtagcagctgctcacctgatttctacctgggattttcctcttctggatgtttcatagaaatggaatcctggctgggcgcggtggctcacacctgtaatcccagtactttgggaggctgaggtgggtgggtcacaaggtcaggagttcaaaaccagcctggccaaaatggtgaaaccctgtctctatcccagtactttgggaggctaaggtgggtggatcacaaggtcaggagttcaagaccagcctggccaagatggtgaaaccttgtctctactaaaaatacaaaaattagctgggcatggtggcaggcccctgtagtcccagctactcgggaggctgaggcaggagaatcacttgaacatgagaggcagaggttgcagtgagccaacatcacaccattgcactccagcccgggcgacaagagcaaaactgtgtcaaaaaaaaaaaaaaaaggaatcctacagtgtgtggccctgagtgatacgtgctctctctgacagcccctgagtgtgtctgggttttgtctgtttaaatgagggtttattcagccccagacttctggtacaaaccaggggacagctagccgctcttgcactcagcacagctaacaaaccagcagtgccaggctcagccgggagttcttttgcctccaaagaaaggcttgagaagaatctacactaactttagtggaggcacttacatcagtgcctccactaaaaataaagcaaaaacaagcaaatccaggtgacagttacaaaaaaaaaatacagtgagtttataaaataaatacagcaaaggtgtgttgagaccgccagtgaatcaggtcactgtgatgaaagccgcacagcaggtctgtgtgttaaccccacgcggcaccttccttggtcactgtgagcaaacagtggaattccctgctcccaagatcctgtgctgcttcccactggcaccactctcagaccgtaagaaatcggtttgctccagaggaagatgatgaagtcatttgctttgaggtccagtgattatcattgtttctgacctaatagaaaatcatccctcactgatgcccagccctgctggtctcgaagcccctcacaggcatcatgtcatgacacccagggtgtgcccagagccccagcaggcaggactgccaggcagggctaggaccaggcctctctgttactaacctagagagcagtcagcaaagcaacccccgagtttgccaacttttcaagcgttggttttttgtctgttgaaacctcggtgtattttagcagaggcgccttcccgagtcacccgacatctgtggctcggggtcatgattgccgcgaccacccggggtgctgagctccgccccggcctggcgtctgctctgaaaaggtccagactcaggcagagcagacaccccagggccactttgccagtccttcagcaggcgccatgggctcctcctccaaacctgttccatcggcctcttagggcctgcctgtaccaccagcccctggcttattgcaccagcgtccggaacggggttcttgttctacctgcccttccctgcagcttgtcctcactgcagccagaagggtcctcagacgacatgtgctagttcatatctctcctctttttttgtttttttgggttttttttgagacagagtctcactcttattgcccaggctggagtgcaatgtcacgatctcagctctctgcaacctctgcctcccgggttcaagtgattctcctgtctcagcctcccaagttggtggaattacaggcgcatgccaccatgcccgattaattttgtacttctagtagagatggggtttcatcatattggtcaggctggtctcaaactcctgacctcagatgatccacccgcctgggcctcccaaagtgctgggattacaggtgtgagccaccgcgctcagcccacatctctcctctttttttacttttattttgtttattattacagagggtcttgctctgttgcccaagctagagtgcaatggcacgaatatggcttactgcagcctcaaactcctgggctcaagttatcctcctgcctgagattcctaagtagctgggactataggcacatgccaccatgcccagataattttttaaattttggtagagacaaggtcttgctgttgcccaggctcgtctcaaactccttggctcaagcagtcctccctccttagtcttccaaagtgctggcattacaggtatgagacaccgtgcccagccctttcctcttttcacacccttctggcagcttcccacgtcactcagaatgaaatcatacttcttccctcagcctgaagcctgccatcagccctagcagccactctggcctcaccactgggctgcagcctcccagcctccttgctgcaaccctgagctaccctcagttctacacttgctggggctgctgggtaccttccctaggtgttggcaggatcactgcccctccactccaggcagagtcagggtgtccctctggcccttctctctgttacgcagtatggcattggtttgtccgggttgtgccccaccctccccagtaggatggcagttctgggtgggcagaaacaagtgttttgtttgcagttgaggtttccccaaaacccagcatgtgtgggtgctcatttgtcgaacaaatgatcacatgcctccaattagaggtgtccaggagacagctggtgtgaggccttgggccacatgagccctgccagtggtaggggtggtatggtgtaccatggaacccagtctgggaaatactgggtaaaggcatgaggcaagatgataaacctggaaagatgtgtccagaatgacttgctcttcctcttttaaagagcatttactggtgtccccatgtgcttttcgtcagactgtgctctcccaccctctgagacctggcctccatccctaccccttcctgaagccctcctgggctgtctgcaggctggcctctcacctagagtgagggccctgccagggagtgccagtcctcctttcggagagaagccactatgccatgagcttccgtcgtgtaaagtcagacccagacagcccaggccctggtgtcaggagtgtggcagcagccagggccggggctctccttctccttcttgggccagccactggtcacacaggtgcactcaaattgggaagctctgtcatgctgtgcacttaggatttgtgtagttttcaaatgtatattttcctccagtaatacaaaatagagtttctttttattggataaaagcgggtgaggggctggggacgcagaatgtttctgagggaagcaggtggtcagggtccatcctccacgcacctcctcagcatcgggctgggctggagctgggcagacgtggcctcctcctgcagggagctcccaggcagcacaggggcccttcccagaggcctggcaggcagcgtgagtggggttgtgaagggtgggcagcagcgtgccaggtgagcaacgcgtgagggggcgtgtgtgtccggaagggacgactggcaaggccagggtgaggctgggccccgcttgctcttcccaccatgttctgttctagcggcttctagtaaaggctgttaatgggcggaggctcacattaggaggcagagcccggaagcgagagagccaagggagacagggaagttttatgttccagagacgttgcgaggtgatggagagaagaggaaagggatgcggggtagccatcctctgcccgctcacgagcacttctccgcctgccaccgtgctgcttccagcgcccatctttctctatctggagacccctcagagactccactttggtccttgctgttcttgcccttctgctgaagcacagtcatctcctcctctctccatcattcccgttgtccttgacttactattcaaaagctagctgcttcaaaccacagcgcgtctcagctctgggccaggactacgggcagtgtgtgggggagtcctggctctgctccaccacgtcggggccctggccagtgggctgaatggcgaggcctgggccgcttttctgtcttctccacgcggccttccgagtggggaaggcgggagcctggcgggagcctctcctccacatagcctggtggcctcagcctcggcctcagctggcaggcctctcccctcccttccctggagcccctgcatcccctggaatgggggcttagcctagaacagcgcttccccaaatctgcacctctgaaccccaggtccatggaatggaaatggatgtgatgtatggaaagggggttccatagccaaacaagttaagctaagttcagagggaaggtggtgaatagaaatcccaaacatctgatcccagcacagctagcggtggggacttgccttgagtgcgctccaggtggtccctggggactcggtcctggcacccctgccctcctggattgcatcccacagccctgctggccgccccgccccagcctccctgctgtgacaggggcaggggctgcggtgaccctgcagcacaggcgcggctccctcggatcccttggatctcaccggtgcatctgaggttctgcgtggaaagtggctcgggcttccaatgccgctctgctttaagctgggaccgctgtccagggtggtgcccagccttctggcatctgccatccaacccttccctctctcccctcagtggccctgtgtcctccgggcatcaaccctaatgccacctcctcacctgaccacccactgccagttgctcattttatttcctggtggtgcctcccatatctgaacctagcctggtgcttacgtccaattgcctgctctggtgctacctgagagccccatccagcccactcacgaaggcttccagagcctgtgcctgtaacttgggcaaatgtgtggagtgagcgaccaaagggctgagggagcagcgaagggagcccctcgctaggactctaggactctgttctctctgtgtctcttaaaatagctcactcgtggctgggcgcagtggctcacacctgtaatcccagcaccttgggaagccgaggcaggcagatcgctggaggtcaggagttctagatcagcctggccaacatggtgaaaccccgtctctactaaaaatacaaaaattagctgggcttggaggtgggcacccataatcccagctacttgggaggctgaggcaggagaatcccttgaaaccggaaggcagaggttgcagtgagccaagatcacgccactgcactccagacacagtgagactcaaaaaaaaactagctcggacgggtgcggtggctcacgcctgtaatcccagcacttttgggaggccgaggtgggcggatcacctgaggtcaggagttcgagagcagcctcaacatggagaaaccccgtctctactaaaaatacaaaattagcctggcatggtggtgcatgcctgtaatctcagctactcgggaggctgaggcaggagaattgcttgaacctgggaggcggaggttgcggtgagccaagatcacaccattgcactccagcctgggtaacaagagcgaaactccgtctcaaaaaaaaaaaaaaaaaactaaactagctcattcacctcactggcaggctgagacctgcagtcactccagcggcaccctgagtgagctcacacaagagagaactttggccaggcacggtggctcacgcctgtaatctcagcactttgggaggccaaggggaatggctcacttgaacccacgagttcaagaccagcctgggcaacatggtgaaacccagtgtctacaacaaaatacaaaaattagcctggtgtggtggtgtgcacctgtagtcccagattcttgggaagctgaggtgggaggatcacttgagccagggagatggaggttgcagtgagccgggattgcgccagggcactccagcctgggtgacagcgagaccctgtcttaaaaaaaatttttttaaagagaactttctgacagccagaatcaggtgggggcaggagggagggggtggccctgtgcctgtcagtgttttggctgcggagctgcgaccaagtctggatgtgtttgggatttctattcaccaccttccctctgagcttagcttaacttgtttggctatggaaccccctttctatacatcacacctatttctattccatggacctgggattcagaggcgcagatttggggaagcgctgttctaggctaagcccccattccagggggatgcagggactccagggaagggaggggagaggcctgtgatcactctgcaaagcagggctgggtggggaggccgggcggctggggaagaaacctgccatgtctgggaagaccggttggtccttagaggacctagcagcagcaaaggcaaacactggctcaggcagtggtgactggtggtgatgtgccgacaagagcggccaccgccccgtcctccttgctgctctgtctctccatcctccatgtcctgatccactgggactggccctggggctgaggtgtgagacttggtgcccacgggaggcatttcatacatgcgttcatcagcccacagttaggggcccctgcccagagcagccggcgggtgaggatgcgggcagcctggagagggcacctcgatccgggaggtgcaggtggagggaggtcccactgcctgagggccctgagagtgtctggccccggcaagtgtgtgacacgggcactatgacaggagcactgtgcggccagagtgtggcacagggcatccagtgtgattgtattcacggcagccctgagcacaaagcaaggagcaggagatgtgtggcggcagcgagggatctgccagtttccactgggtggcccactcggtcccatggaggccgaccaggagggcagggacccaagaccacagatgtagcagggaagactgtgggttccagaaaagcaggcagtgccaggcagtgggggacagccagcccctcggggctcgggtcacccaccagcactgctggtgaccagaggcccagatcctccagacagtgctgtgctcgcgggcatggaggcctggtccaactgaggggtgggaagccctggggcaaactggagttgccggtggacagcaaacaggacactggagggacttcctcctgtcctgtgaagagcagacaaaggaccggagatgctgagcatggacagaggctgcccaaggaccagggcagggcggcagtcttgtgccgcggcctggtcaacgcagatgttgcctgcccggcagcacattcgggaggacagctgtgcctagaggagaggggcctcagctgagccaggatggtgagggcagcacaggcaggtggcaggggctcctgggctggcgtttttgtttctcacagtgcccaccatggtccttcacagccaggtccgccgcatctctcctctcattcctccactctctgttcacctgggccatccctgcccttcttggcctcctgctggagtccatgctggtatctgctgggctgtccctcagtctggcccacctgacattctggagacaagtgaccatctcccccgtgagactggcactaggggcaggacgtggcctctctgcctcctgcggggcccacactggctgctgcatgctgccactaacatgtccccagttccggaagtctcctgtcctttctcttgtcacccaactcctgccttccctgaaagtcccttcccgcttccagcccgccggggtcagcttggtcagcgtccattccagccccaacgaccagatgctgtgggtgcttgacagcaggtggaacgtgcacgtgcggaccgggatcaccgaggagatgcctgtggggaccgcctgggagcatgtgccaggtaggagcctgcagacagggcctgtggtgccggccagccggggctaccatcactgggggctgctgggcgctccctccaggccgctgtctgtgaggcagcctttgtgctggggctgtgctgtcgccgctgcttcctgggccaggggacaagcctcccatcatgttccttatcaggggaacccaggccgtcctgctggtgcttttgtgggagggcagtttgcacactgcccaggcccttctgtcctttgacttctggctttcggtggctttgctggccctgccaactggtcgtcctttccctcggctcctgccccaagcccagcccatcatgggcactccgtccccgcagggaccctggtggaggtgtgcagcgtcacaagagtcggcttgggaagcagcggcccatcccgtccatggcaggggctcaggagggaccctgtctgcccacagggttgcaggcctgccagctggcgctgagcaccaggaccgtgtgggcccgctgtccaaacggagacctcgcccggcggtacggcgtcacagacaagaaccccgccggggactactggaagaaaattcccggcagcgtgtcgtgtttcacaggcaggtgcccggggccagtgggcttaaggccccttggggttcccagggctcctgtggacgatgtcggggggctctcaaagaagccgaccccactgggctccaatctctcaaagcaagaactgagggcaaagccaggagtgtgtcccagggagggaaggggctggacacctgggctctgccagagtctcctgggcaaggacaaggtgctgttgacatccacttacagctgagggtacgaagttcacatggagatggtggcttgtccagtgtcccccacctagaatgtggcaagcccagacctgcgcccaagctcccagctccatctgtgcccaccccacaggctgtgtgattgacaagtatgtgattggctcttgtccctgcagtgactgcgtcagatgagctgtgggctgtgggcccgcccggctacctcctccaacggctgacaaagacgttcagccactcgcacggcacccagaagagcagccaggccgccatgccccaccctgaggacctggaggacgagtgggaggtcatctgaaggagccctggccgagtcacgcggaggggcccggcgtctgtggcgggcacaggggcttcagagtgactccctggtggacgcgctgcctcaacacttgtccagacacctctggccaggttggacccgcacacttactttcatctatgttggtttctgtctcgttccagaacccacagcctccacccgtggctggcgtgattgctgcagcagtggcgcctcctagctcaggacagtggcgactgcccggctgcatgcactccgattacccacgtgctgccgtcctggtctcatccacagatagctccagcttttgttggtgggagtggtctccggaggcctcccagaaccaagggtagccgggcagctggtttggcccagggcctccttccacattagtagccccagggccagatggagccaaaggtcagctctctgcagcgcgggatgtgctcggtgatggctttgtcccatcataggggggtgtccccccagagacaaagctgcagagcacattccatgccagacgctctggccaggaagctgaggccgggcttgagaggagagcgctggccatgccaggagagaacccacgcacatgcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcacacttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcctgagcctgcactgtcctcgcctgcagcctcagaggggcaggcatccccgcacagacttgactggcagggcggtcacgggacctgcgggctggctccgagtggcagcccatgccttctgcggggtatgggttgacacttgacaggttgaaaccagtgcctctatggacggctgctgtggccccttcagacaatgggcagtgcccaccccgcccactggcatctgcgtgtgagggctaggccgccctgccacacatcccgccccctcccggaggcagcttcaggacaggacaccaggctggctgctttttttagcctgcccctggcccaggcccagtccttggtgtcagggagcccccaggccgcaggtggagggtgataaaatatgttctctgacaggacccagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttccaaacctggccgagtgtggtgcctgagctgtgagaagtgtcctcagccgacactcacgagggcagtgcaagggagaacctgccagcccagccccaccacagggagagtgcgtcagcagacctgtcctggcctggctggtgttgaaatacacaccggtttgcccaagtggctgttatgggggaatggccgctccagagctggctgtaccccatggtagcctctgaggaggacgctgtggggtgaggtccagggctgcctcctcatggagctgtgtgtgagcaggcgttggaggggttcgagcccctggttctgtatcttcagccagcaaacgaaaccatatcgcaaaccagagctgctggaaaccagcacacgcaaaagatgacgcccagcacagcagcaggacacaccatgtgccaggaaatgacctcagcaagaaacctcaggccgtgtgaagagcagcaaagctttccagaaggcataaaaggaaacttgaataaaggaagatatgttccacattcctggatggaggactacacacattatggaaagacctcattctttccaaaggaatttataggtgtagcttgatttcagttcaaatccccactgggattgttttgttggggcaggcagggaggaataatgttagtacccacaaatgcccatgactgtgcccaatgtgcttctcaccagagccctgcaaggggaagtctcattagccccttgagactcagagaggttaggtaacttgctcaaggtcacacagcactgggactggaagccagctctgtagaactgcagacctgtgctgtttgatgcctcctcactgtcccgtcactcctgggaagaagaaacgggtgagaactgctaagtgatgacaggtggagccccagcaggggccactctattgaatggcatggcccagaccctcggagggccaggcaacaggctagcaaggcccacagggagggagcagaatggagagggcatctcagatgcgcttaaggagcggcgggggcggggcatggggggtgtcacaactaatgtggccactgcttcattctctgggcaaaataatattaaatggattaaagaatctaaaaccagtgggaaaactgtctgatttctggatggcaaaggctttctaaactcaaaagtgataggacaagctacagaggaaaataagtacatagatttgatttctccaaaatacagaaatgctgctgggcacagtgatgtgcagttatagtcccagctacttgggaggccaaggcaggaggattacttgagcccaggagtttgaggctgcaatgaactatgatcacaccactgcactccagcctcggcgacagagcaagaccttgtttctcaaaaataaataaatagaaggaaataaatgtaaaaatgctgcaaattaaaaacctcaaagaagggaaataattgcaacaaatgggaattgatgttgaatatttaccttaaaaacctatacaacaataagaggagtgcgcccttcagcagcatgtatacaaaaattgcaacgatacagagattagcatggcccctgcacaaggatgactcgcaaattcataaagctttccataaatatatttattaaaaaccaataggaggagcacttcgagtcgagtgtaagggcccttcacaaaagcagaaggaacactggcccaaacccccagcaccccggaagcagaggtgagatgggagcagcttgggagccccccattggcgccgccctactggggaagccggtccgtacgtaggccttgcatctcgccacctccacttctgtcctcaagaacaagtcctaggtcaagggaaacagcacagcctgtttataattaggaaacacttaaaacagcctggcatttgggaacagccatgttaacgtgagcaaattcctctcatgaaatagcctgcagctattaagaagcacgtgtgtgcaggaagcggaggcgcaggacctcaccgcgccagcgtgaagttcccgggcatggtcatgaaagcgtggttctgtaagaaatcagagggagaaagggagagaagggggagggagacaacccaaacgttggagggtatttgttgtaaacttcaaacttttggcaggtttgaaatttttcataactccggggaggagcaagaggggtgaaaagaaacaagttctctacttgtgatcagcagctggtcatagtggttgcctggagtatatgcctttttgtatcctttgaatttccagccatgtaaatgtattatttattccaaaaataaagcagatttacattttaaaaattcagttgtctctaactactctttgttatcaaggctggttgagtcaaatatcacaaagtagacaccaatgacttcttaaaaatcatatttacaaagtacaatgggggaaatgcttatactacattaaggttaaaaaaatactaaattgtgtaactgatctggtttcatatatatataaatatacacagaaaaaaatgtaatatatatctgcacagaaaaaagctgaaagaaacatatgccagaatgctagcagtgcttgtatgcgtgcagatgacgcactcagtcagcgcctttacttgtacgtgagcgcttaggggccctgtctctggggaccatgtggggcggtggggcgcttgagacagtgtttccctgcatcgtggccggacctctctactcaatccccagtgttctacagtgaacatgaattttataagcagaaagaaattacttttaagagccaggcgcagtggctcacacttgtaaccccagcactttgggaggctgaggcgggcggatcacaaggtcaggagttcgagacctgcctggccaacatgctgaaacccagtctctactacaaatacaaaaattagccgggcgtggtggccagcgcctgtaatcccagctactccagaggctgaggcaggagaatcgcttgaacccaggaggcggaagttacagtgagctgagaccacaccattgcactccagtctggatgacagagcaagactacatctcaaataaataaataaatacataaataaataaattacttttaagaatcaccaatagaaatctgtctttccatcttttttttttttttttttgagatggagtcttgctctgtcgcccaggctggagtgcaatggcgcaatcttggctcactgcaacctccgcctcctgggttcaagcaattctcctgcctcagcctcctgagtagctgggagtacaggtgcctgccaccacgcctggctaatttttttatttttagtagagacggggtttcatcatgttggtcaggctggtctcgaactcctgacctcatgatccacccaccttggcctcccaaagtgctgggattacaggtgtgagccaccgcgcccagcctttccttccatcttgattgcagtggtgattacacacatgtagacattcatcagaactcatcaaagtatacacttaagtctgtgcattttattacatgtaagtaacacctcaatctgaaaagtatcagggcaacaccacacactgcagaggggcagggctcctccggcagttactcacttcccttgaaacagaagctcaaacatggagtagtcttctgtgactaaacttgttttccgccctcccaacttccaggaagaaccttcttctgaataggatttgaggtaacttaggaaactgctctcaatacggaattttaaagttggtgaggaagtcgacagaaggggaagtcacagtaggaaaatcaaggtactatcaggatgaagtcagcacgcagagcaaggccagcgaggcccaggcgccaggccttggtccctgcccacctcacccaggccagccagacagcacggactgccctacaaggtcacctcagagagatgggggtgttctctcactgctggcttttgatgagcccaggagggctcagccttcactatcctccctaacaggcatttggggtgcagagatgctgacgcctgaataaggttgggattcggggcccttgggaacactgggcacctggtgggtgggtggaggggcaggaccggctgcagccatgtttcccttagaaacagactgctggaattaacgaactaaacaaatgaaccaaggtgcttcaccccccaaaaaagtgagttttgttctgcgtggagcgattgcctttgggaagccaccaaggccacctgccaacaggcaaatgctgtgctgccgtctgcctggctgactccggccctcccagtcctgcaagctcatggccaggacgataacgatgacaggggcaacaccatggtcctcgctgcccttcctggggcaggagggcccagaagactgataagctaaacccagggcctccctcggctgcttatctgcccagcacctttcctctaggtcctctcctcccaccagtacaggggtctgggagggggttgcagggggtcctgaaccacagatccctggagactcagtgggagcagctgtactaggaatcaggcaccactccgctgctgtaagtcttcgtgagagccactggccagcttcctctgacttccctgtcccctcacccaaatcgatgacatcaggagctaatggcccaggctgccctcctgctgcagtgcccataattcttccggcaggccccgccctgcactccacgaccagcctgggttcttcatcctggtaacctgacaatggatttcgtggggcccactctcagtgcccgccagcctgtgtcctgcctggccaggcaatgagtaccggcggcaggcagctgcctcacccctgcatgacccccccagcccaggggactcaatggcgctgtcatcaaaggggcagctgtagatctaggagggacgtggagggggctagccctgggcctctggcattgtggaggctgacctatagagaacagagctggagctggggagacatgaagtctgcacatctagaccccagtgaggagcccaggctttctaggcacaagccccatgggctccccgggcccagcccctaagaaccacggcagctgcgccaggccactcctgtctccacttccataccctccaaaggagaggcacctcccccccccatggcatctccaatctgaggacctgccacctcccagaggaccggaggccctgatgccccaagaattgggcttggaaagatgttaatatccactgccccaagtgccaaggttcagaggcactggtccaggacacacagcagcggggaagtggaaccctcactccagcctgcagtctgggctctgtcactgtgctgtctctccatccttccctccccacaaccagggctgtaggcccacctaacacaccacacacttcccagaaacaggagtcacatccttttcagggctggtagggtggctgaagatggcccaaaacctcctgaatggaaaaaccttgatggggagactgagggccaaggcagaggtttgtccaaggtcacccccagagtggcggatccaggaccctgggcaagatcttcctactgtccaggcctctcccccacctctcttgtgtggcccagcaccctggactcctccatgcccaggtgtgctccccccaggcacgctgggggcagggtgggcagcaggtgccccccaccaggatagtggttcttcctcctgcagaccttcagccctctgctcctggcaggacactgtggccctcctgcccacgttggtgcgggttgaatttgacggcccagcagaattcccaggcagggcagcctggctatcctccctggtgtctcggctctgagagcggagacccagcctcccagcctggagttgtggtgaattcgcaaacaagtctccatctccagaaccttcctgaagaaaacagctctccaggctggggcaagaagcctgtccctacagtgatacaaccacccctcaataaccccgggcaccacctggcacccactgggggccaccagggagcccaccaagcccactccgggcttggacagagggcaggcctggaggaaggcacatccaaccccactgaccggcatgcacctggggccaggggcctgctgccactgcagaggtgagaagcaggagcagcaagacctggtgcccattagtcatgggggaaaagcaaaagggggagacagggacaaatccaggcctgggtgggctgcctgtcagggggagtgatatccaaggaggaactggtggtcagagtggggtgggggatacccggtacaatttgttcatgcctcaacaccagccaccgcgggcctgccagccctgtgtgccctccctggcccggagtccacagggtgcaaaaggctgaccgcacaggacctcccgtgagaaccctacgctgcagagctcgttctcttggcttccaggcctttttatacgctgtcctgctgcttggacatgccagtccccacccctgcacctaccgagctcctgcggcactcagctgtcacccatctgggacgcacacctgtccgaggctctagatcaaggtgggaggttagtcctcactcccttcaggggctggacagcgagctgaaggcccgagcccagctgcacccagaaaacctgccacttggaactcacctgaccatccaagcccagcccccagtgcatgcgacagatgaggcagagattgtgccgtacagagatcaatatatataaagtgccggtacaacgctctgaaaaatagttttgtcccaaaatccagcgcctagggtgctccgggcctagcctttgccagtgaggtccaacggctgcaggaatgggggcagcggcagctcgtccagggcctcggggaagcggcctggagagatggcggtgaccagcacctgcatggcgcgcgcgaagagcgagggcggcgccaggcccgccagccactggaacttgtcctcacccagcagccgctgccagcgcggccggtcgcccagcagctcctggcgggccgagccggcggcacccacgggggtgtacagcgccaggaggtccagcagcagcaggcggcgctggcgcggctccccgggagctgaggcgggggctccggcggcggagggagtggccccggcgtcgcggcccagctggcgcagcagcagctcgagaggcgtgaggccgccgccgtcccgcagaccgggcgaggcgccgtggcccagcagcaggaagaggcactcggggcgcgccagctcacaggccacgtgcagcgacgtgccaccgccctccacgcggctgcagccacgccggtccagcacgcgcgcccgctcctcggccgggaagtcgcgcaaggtgcgcaggatgcggcgcagaatgcccacgcggttgtagcgcactgccagcgccacgtgcggcccgggagccgcgcagcagcggaagccggcactgggcggtgcgagcgcgcgccgcgggaacgtggccagcaggtaatgcgcgtacgcttggtggtcgtgcacgagcgcgtagagcagcgcctcagagggcgagtaggcggcggcgcgcccgcgctcgtcccagtggaaggcctcgctggcgcgcatatcctccagcagccacacgggtagcaggtcgcgcaccgcctggtagaaggcgaacgacgacttgcggcactgcttctgcgctcgcgagcgcgccgcgcccgaggcctcgggcccgccgtccgcgccacccccaggccgccgcgcgtcccacggcatgctggcggcggggcgttcctgggcctcaaggcatggatcccgcgaaggcacacctgcggggaaaggaagaggccacggtgaggcgcggggaaactggggaggcccggggactcccctctgcccctcacacagcccctccggtcctggcccaccaggcctgtacctacctccagcctcggccaggcccttccagtcaccctacagctccatctctccgacgcccagaaccaccgcctccatccttgatctagctgtacctgttctccctccttgaaactgacttgctctctggcacctctgctggaaatgcccttgctgcccatgccctcaaatctcccctcccctctccaacccagggacccactggaagagcttctgttcccacctaagccaggttcatacgaccccaaataaagaaaaggccagggaggggatgagaaagcttgggcccacatctcaagctgaggcaaatccactctccagcccaagcgcaaccctgaccctgatctccgaccccagaccacttggaggcccctggagcctcttcctgggctgttcagaggcatgatccagactcagacctacctggttcctgcaccgcgatcacctagttccggggatgtgggtatatcacagtccctggccgagcctcagctttatctgtaagaaaggggaggggtggacgacggctgtgcgggcggggtgagcctggggcgtggcaccagccctctatccaaacatgtttgcttacacgttagctcctgggaggagataggagggtgaaaacaacctggagaccggtgtgcaccgcactgcacagtctgccatcctcttcaggtcccatacctctcttgatctccccgactactagatgaagcgggtactgccatcccactttccagcagggcacaagcttctccaattctccaaggtcagcaagccacggcagagccaggcctagaactcaggtcccctgcgtctcagtttgggctcattccagaattggtggggacccccaacccacaggcaatcgagcttaggccctgaccctgccctctgagtccccagccccgacctgagcctaggcgtctgacctctggctccgtcccaacctccctactgccttctttcaagggtaagcccttggtcacaaggggcctgggacagaaggcaggccgcgtccacacacactgactgggtcactatcactggcagtaactgagttaaagagagcggcgcggtgcgggtaggctgtggcccgtgggcaacaccgtgactggagccccttccccaagcctgggcctccgggccccagatatgccctgtgccggcacgcgtggggcgccgggcgggttacgtaaagttcggcctccccacgtcaccgggcagagtcacggccgcggctcgtgaataagggggttgggccatcgaaggcagcgccgcgcccggggccacccgccacctcctacccgtcccctcccggcctgcacggccagacgtcgggcggcggagggtcgcggggccgagcggggcgtccgcgcgcaggtggccggcgcagcgagggctgcacctgcgtgcgcgtgtgccggaggaggagggggcggcggccgcgggcgcggcgcgggggacggggactcaccatggggggcgcgggggccacaggccgggcgtccccgcccctgccgcggaccggagcgcgcgctgtcccccgcgggcgagcgggcaaaggtcccacgacggacgcacgggagggagccaccgccgcccgcgcccgccgcagccgcgctctgagccgccgcggccggatcgcagggcggcggtgccgtcgccggcggcgggcggcgggcggcgggcggcgggcggcgcagtgcggccccggccaggcaggacagcgggaccgtccgccgccgccattggcccgcgccgccggcccccgccaccacccattggccgccgcgctgcaccattgttacgtcactggccggcgggcggggcgcaccgctggacccgcggaaaacttcggagaaacttgagggagcgccggcggggagaacggagaggaggggcggggccgtggcgaaaggggcggggcgttgatgggcgggggcggggctcccggaacccgagctgcgggcgaagaaaggctccgagctccgagctgccctagcccgggagggcgccgctgctctgcgaactcgggcgcgcgcgtaggtggcccgccctccgccgtgcgtgactttcctcgtcgcgtccagctccccttttctttgaccttacgtgaccttgggaaaaacctccaggctgctaccccatctgcacatgggagggccgggggtaggagccgcgacccctaagggctccaccgccttctgcccggccagggtcgtgcctggcgcgcccccgctccagctgacccgcgcaagggagggaggggcggacggatggggacagctgtttaggagcgcgcactgcgcccatctcggcctcaacactcatgtttccacttcgtttcacgaccaccagccacagtggacacgatgatccccagttcacccgccagcaaatcagggctcagagaggtggcctcaaagagaggagcggccaggagggaagccgggggtttgccctgcggttcttcccacatctgggcgggatagattcgattgggcctcggccacccccaccgtctccgtcgggggttccaaggtttggggtcatgacctagggggcttaggagcctgggtccatctcaactaatttatggcctcactcgcccccagcggctgggaattctaggcccattttacagatgtggacgcagatctggagaggggcaatgactgctcaaccccccacccatcctcccagacacgaccttccacctggaatccccccacacacgttctcagaggccaggcagccggggtctcatggtgaaatccccacattccatgcaggggctctttctggttccttccctagaatgctgtccctgcccttccagtactatctcaccagggagaccctcccactcccccactccgctccaaccaagcaaggcctctgcctcgccccggtgggaggggcctcgtccagagggcacgcccctgcacacacaatcagccctgtcctggcttctctgtgtgccccagccagtcagtctgggtggaagtcttacctgggccctctcaacagacctaggcaggcctctgtccccagcccaacgagctcaatcccttaagcacacacgccacagagcagtcctgagaggccaggtggacagtaccatgaggcagacaaagctgtgaggcccagagagggtcaggccaccccagcccaggtaggcactcacatgtatcctgcccaggctgccatgcatggacccaccagggggatgaccagaccccaccagccctgccccacctcagggcgggggacgttccaggccacgccatctctcccagggagtccatggcaactgccaagcttacagcagccaggttgtcagcaggagtaggggtatagagggcactgggcctggcatccgcacccgcctttgcctcagctccacatgtctcctcctgtatctaggcctatctccctagggcttctcccatctgccggttctggatgcctctgagtacgatggtggggagagcaaagtgagtgaaggtcctggagtcaacaatcggcctttgggagcccaaaccctgggggacatcttggggagatggtgcccatgtgggctgtctgtggctcaaggctcccctgctctcttgccctcttcgaaggctggagttgagatacagccgtctccatggctactggtggaatgagggtgaaagggcaccagtggatgccaggctgtgcactgggcctcagggcgggtctctctccaccccttgatgtcttccctgcccccgtgccctgacctgccctcctcactggggatcccagagggtttttttttttcccaagacaaagtctcattctgtcacccagactggagtgcagtggtgcaatctcagctccctgcaacctccacttcccaggttcaagcaattgtcatgctgcagcctcccaagtagctgcaattacaggcatgcaccagcactcacagctagtttttgtatttttagtagagacggggttttgccatgttggccaggctggtctcgaactcttggcctcaagtgatctgcctgccccagagacctttttctaaaagccaagtctgaccctgtttctctgctgcctagaagcttcctgtggacatggacatagccacaaagtccagatgggcagaaagaggcatttctggcagagggcaaagcaggggccaaggtctggagtgtgacacaaaggctgcagaggccacctgactggccaggtcccatggggcctggaatgcccggcaaggatcctggattttcccctgaggcccaagtggaggggttgggaagtggtttcactagtgaattattttagacacacatacaaagagcatcatgatgcctgggagcccgggacccagttgaaggagcaacacacggcagatcggaagccctgcgtgcctgtcccctccctccccagccagcctcagtgtgagtccgcgtgcgtctttcccactgtaagtgcaagtggcagcagacatagtaacactccctgccatggggctccacagcactgcctcacctcagcctcttgcctttttctcctgaggtcacttttagatccagccccaggggaaccccctgctttgggttgcagccgccatctctgctgcagtgtcttctgatgaaagctgtcccctgtgggcatgagtgtggacatgctgcacctcctaaggcagcagtgccaaggctgatggtgccctccacggtggtttcatggcatcgctgctgcactagaggctgcccagggacgtgtgaacagctgtgaaggggcaggttcctcagggagggaggatgggctgcggggagggtggctggggcaggggaatgggcagagcatgacttccaaacacctaggaagccccaggtggagggcggaggggggtcttgccatcttgggataggagttgacctttgaccccatcatgctcctgctgggacctgacccaggcacactcctcttcctctgggagggcttgtcccaccagggcaggggtctgtgtgtgcccaggcagggagccacaggcagtagggggaggctggggctgcaagcacagaggccccggaaagtgtgtgaggacgctggggagtgggaagggccctcggaggggtggtatggccggcttaggttttctcgacaactctagttgagtatgcactgcagggagacggagaggccgcagccactgaagccaactgtgctggagcaggcggagggcaccaggggtccctggagagaagtgccgcctcctgccaggcccctgacctataggtgagggtgtgagcagaagaggagaatctaggaggcctcccgggtattaggggaaagctgagcacctggaagatggcagagccaagaggtgtccatggccctggagatggggtcatgagtataaagagggcgcttggagtgtgaggcaccagggatgggaggtgagaggcccgaggccccagccggggcttccaggaaaggaggtgggagagggtcttggggccaagaaggcacagggcttcccgaagccaaggtgtcccaaaaataagggagcggtcggctgggacagattcagatgtggtggctcacacctgtaatcccagaactttgggagtccgaggcggacagatcacctgaggtcaggagttcaagaccagcctgaccaacatggtgaaaccctgtcgctactaaaaacacaaaattaggcctggtggtgcatgcctgtaatcccagctactcggtaggctgaggcaggagaatcgcttgaacccaggaggcgggaggttgcggtaaactgagatcgcgccattgcattccagcccgggcaacaagagcaaaactcggtccataggtcacagtgccctttacagaatgtcatggggttaggggagaaacctgtttggagagagttcaggagcaagcggggagcgggatagagctgtgaggacaggagaggaaggggcaggcttaaagaatgaaacggtggagataacacacgtgcacatgcatgtatgtgcactcagacacgtgggtaggcccacacatgcatctgtgcatcatgggcggcacgctgtgtgtgcatgcgtgtgcgtgggcagcatgctgcagcctgcatttgtgtgtcctgtgtgtccattatgtgtgcagtgcgctgatgggcaaaaacgctgacgatgcaggccagctgataacctggaggaggccggctggagtggggcctgccacacgtgaggggtaccctgggctggcgacatgggcagttcttcttgggggggggcagcatgttgggcacagacacagaggagggcacaggtaaaggtgctcggagacatctgctctggtggcttctattttcaaggccatctgctgagaataggaaggggtggatggtggggagggggctggaggagagggcttcatttgctgactacactgagatcctctctgacctgagcccctgccacccagccaggcctgcggagcctgccatctgcgcaactgggatgggacaggtggccgcggccaggaaggcaccacaggtgcaggcaggagggcaggcagcttcctcagggaggggctggcaccagacatgctggatcccgcctaatcagccacccaccagtggtgggactgggctgagcaccagtcacttatctgtgacatgggtcaggtggattttgggtgtcagagggaaggtgtttcatgtggcaagactggcaaggccagcatgcggagtggctaggaccgggtgagagcctgggggtgtcccaacacttgccccacctcatgcaggttctgtccttccactgcctggccagaccagaccaaagctcacctggcctttaagactggcacctgcaccaggagccactactactccctcctacggtggcaggctgggctctgccccaccgcgtctgcagccccatcagctggtctctcaaggctcagctttgggatgccagtacagaccaaagacaggacaaaaccagtggagacaagggacatcctgggagccgaagggtccagcatgtatagccaaggagtggcgtctcaagtgtgcagggagcccccaacatagctggaagatcggcccgggggaagatgggcgagggcaccataggttatccacatgctggccaacagacacgtggagatagacattcagctttgccaggaatcagcacgtgtacaggctcctggcgaaaactgagtagactgggaaagcccgtgctggccgggttaggactcaggcacttgccccaccagcagggaaaactcacatgcttgggggcccggcagatccttctgtaggcatcttatcacaggtgaatacctgcctgtgtactaagttacatatacaatacaatgctcactgctgtggattttgttctcttgcttttttttttttttttttttttgagacagggtcttgctctgttgcccaggctggagtgcagtggtgcaatcatagctcactgcagcctcactctcctgggctcaagtgatcctctcacctcagcctcccaggtagctgggactataggcacatggccaccacacacaaaaaataaattttttaatttttatttttgtagacatgacaccaggtcttgctatgttgctcaggctggtcttgaactcctgagcttaagcgatcctcctgcctcaacctcccaaagtgctggaattacaggtgtgagccacctcaactgacttaattatttaatgtttcataaaataatttagcagccgggggcagtggctcacacctggaatcccagcacttcggtaggctgagacaggcaggtcacctgaggtcaggagtttgagaccagcctggccaacatggtgaaaccccgtctttactaaaaatacaaaaaaaaattagccaggcatggtggtgggcacctgtaatcccagctactcgggaggctgaagcaggagaatcacctgcacccgggaggcagaggttgcagtgagccgagatggcgccactgcactccagcctgggtgacagaacgagactccatctcaaaaaaaaaaaaaaaaaaaaaaagaatttagctgaattttgtattttctttctttctttttttttttttgagacggagtcgcccaggctggaagctctgcctccccgggtcacgccattctcctgcctcagcctcccgagtagctgggactacaggcgcccgccaccacgcccggctaattttttttgtatttttagtagagacggggtttcaccatgttaaccaggatggtctcgatctcctgacctcgtgatccgcccgcctaggcctcccaaagtgctgggattacaggcgtgagccaccgcgcccagccttatatttcatgtctatttcattattaaagctttgaagagaatacaagtgcataccaagtactagggagatagagtcactgctgcatctttaataaggaaaacctggaaactacctaggtgaccatcagaaggggtatggctgacatggtcatggcgaagcctgctgtgactttgctgcagcttgaagagcagtgagtcagaaggggcaacggagaccggagggcctggcccggcccaggtcgcacagtgcagggcagtcccaagggtgacagcggccagtgcgcgggcgcgccctctacccacatgccccgacccgccgggtccctgcgtccgcaagatcactttccgggcccgaggcggggaaggggccgggacatgggttggggactgagcgccgctgaactgcgccatggtcggagagagtttgcaggggcggaggtgttccctggtcggaccctgccgaccgccctcggggagaggcgaggccctggcccgtgacggctgggtccgggcctcagtatccccatccgctcaggggaaagcgggcggcagcccggagcccgaccccagcgcccagcgcggcccgacaccgccccctggcggccgcggacgtcactgcgacccgcagcctccgccgaagccgggcgagggacccccgacccgggcgcaccaggctgcgggtgcgggggcggggacgcccagcgccctggccccgggggcggggttcgcgggctgagtgcccactccgctctcccctcgccccgcggcctcggcgggccccccgcccaccagggtctccacctccccccgggtgaaatggccacagtcccgccatccgcgccgccgccactgcgcctgcccccggctgggccgatcggaggtcccggcggggcgggcgaggcaggtggtccggcgggccccttccgggttcccctcccccagccggagtccgcggaccgcgctgggcgcagggagggggctgtgcgcgcctccgcttcccggccttcccagcggggacgagcgccgacccccgcccagtcgggagacgccctcaaggtcccaggctctgcttctgcccgcccgcggcccgcggactgcgggtgacagggtccccggtccgagccccatctccctaggagagcggaccccagcgctcctgtaccctccacctggtggccgtccacgcagcccggcctgctcgcgcgtcccaactgccacttcccttgccttccccagccgcacgtctaccaggctcctgtgtgtctgcctggctgggacttccgcatactccaggcccactttacaggtgcagatgctgaggccagagcgcctcaggagctggatgcaggggagagcgtgcgggcagtgtggggagagactcggcctagccttccattgcagctcctatccctgctgcgccaccccctcggcctgtcatctgtccccatccaggaacccccaggacactgtcagcagagcccactgagggtccagtgctgtccaggtggcggcatcaggattcccaggagccagccctcactatgccaccctatgtccgtatgtccagcagggatctgagggcctggaggggtgcggaggccctgccaggagatgctttcctcagtgcccattgtgaagggagcagagggctgaactggaaggggcttcctggccccaggagggcagtgattaggtaaactgcccacccttcaaaagtgatggacaggaaggggaaaggtggagggtggaggagctgcaggttatgccggtgacccctgagagacaaggagatctccacagtgtatcagttctcttctgctgtgcaacaaacaaccctgccagggtggctttaaacagcaatgatgtaggattgtttgcggttctctggattgactggatggctcttttgcttcctgtggcgcccgctgggatcactctacagctgtagggatctggaggcccaactggagtgaaatgtccaagtggttcatccacatggctacagttggtgctggttgccagtgggagctcggctgcctccagcatgggctgccaccctgcttcggtgctcctttgcttggcttctccacgtggctaacttggtcttcctcacagcatggcaggacaagccccagtgtgcaagagctcattaaacctctgcttccatcatgctttctaatacctcattctccaagacaagcccagagttcacgtggaatgagactcacaaaggcatgaatctcaggaagcctggtttattattatgggcatcacagcttagcacaatgatggggaagcagtggggacagatcgtagacagcagaccttccagggccagaacaagcagggaaggctcctggaggaggatgggactggctaaggaggggctgggaactctcttccttctccctgaagctccaaatcctcagggcctggggaggttggaggagcaccaaccactaaatcaagatacaaacgctcaaggctcaaactcctgaactcaaggcggatcacctgagttcaggagtttgagaccagcctgggaaatatagtgagacctcatctctacaaaaaataaaaataaaaaagttagccgggcgtggccaggcgcggtggctcatgcctgtaatcccagcaccttggaagcccaagacaggcagattgcctgaggttaggagtttgagaccagcctggccaacgtggtgaaaccccatctctgcaaaaaatacaaaaaaaaaaaattagctgggcttgatagcaggtgcctgtaatcccagctactcgggaggctggggcaggagaattgcttgaacccgggaggcagaggttgcagtgagccgagatggtgccattgcactccagcctgagtgacagagtgaaactccatctcaaaaataaaataaaataaaataaattagccgggcatgatggtgcctgcctgtggtcccagatactcagaaggctgaggtggatggatcacctgagcctgggaggtcaaggttgcagtgagccgtgatcatgccactgcactccagcctgggtgacagagcaagaccctgtctcacaaaaaaaagaaaagaaaaaaatcccaacataccgactgttgacaagaacatggagcaactggaactctcatacaatcccccagtgggaatgcaaaatgatgcaacaacttggaaaagcttggccatttcctaaactcatcataggaaccagcagttccactcctaggtacctgcccaagaaatgaaaacaatattctttttttttcttttattttcttagagataggatctcactctgtcacccaggctagagtgcagtggcatgatcacagctcactgcagcctcaacctcccaggctcaagtgatccttccacctcagcctctcaagtagctgggactacagggagcgacacaacacctggctgatttttttatttttatttttgtggaaacagggtctcactatgttgcccaggctgagtcgaactgggttcaagcaatcctcccgcctcagcctcccaaaatgctgggattacaagcgtgagccaccatgcctggcctgaaaacatctctaacacaaagatctgtatgtgaacgttctgtgagataaagtagcacacctaggaagccaagcatgctcctttctgtttgcagcacagtttcacaaagccctacctctgtgaccacctgcagctctccagaaagttgctttgaagacaaaacgcgacagagcacacagtccccctccccacgcctctggcttgagttgctacattctctaaaagatccatgaccctagccttgcctttccctcctcattacatctggttagggccgggcgtggtggctcacgcctgtaatcccagcactttgggaggccgaggcaggcggatcacgaggccaggagatccagaccatcctggctaacatggtgaaaccccgtctctactaaaaatacaaaaaaagtagccgggcgtggtggcgggcgcctgtagtcccagctactcgagaggctgaggcaggagaatggcgtgaacctgggaggcggagcttgcagtgagccgagatcgcgccactgcactccagcctgggcgacagagcgagactctgtctcaaaaaaaaaaacaaaaaaacatctggttagtgatgatgcttctgtgatctataaccagatgtattcttacccaaaccttgatgtaactctgcctcagtgtaacttctgagcaagtctgatgtgattttgcacgtattgaactcccacaattcatgtataactgtgagctgaaactattttggagcaatctaagaaaacctcaccaaggaaatgttctgggctatcagcctctgggtaatgtcctcaggaggcttctgaatcaaactcactcttttttgttttttgagacggagtttcactcttgttgcccaggctggagtacaatggcacaatctcgactcaccacaacctctgcctcctgggttcaagcgattctcccgcctcagcctcttgagtagttgtgattacaggcatgcgaaaccacacccggctgatttttgtatttttagtagagatggggtttctccatgttggtcaggctggtcttgaactcccgacctcaggtgatccgcccacctcggccttccaaagtgctgggattacaggcgtgagccaaggtgcccagccatcaaactcatatcttttttttttttttttttttgagacggaatcttgctctgttgcccaggctggagtgcagtggcgctatcttggctcactgcaatctccacctcccgggttcatgccattctcctgcctcagcctcctgagtagctgggactacaggtacctgccaccacacccggctaatttttgtatttttagtagagacggggtttcaccatgttagccaggatggtctcgatctcctgacttcgtgatccgcctgcctcggcctcccaaagtgctgggattacaggcgtgagccaccacgcccggcccaaactcatatctttaaaagctttctttctttctttctttcttttttttttttttttttttgagatggagtctcactctgttgcctggtctggagtgcagtggtgcgatctcggctcactgcaacctctgcctgccaggtttaagctattctccagcctcagcctcctgagtagctgggattacaggcgttcaccactgcatccagctaatttttctatttttagtaaagacgggatttcaccatgttggccaggctgatctcgaacccctgacctcaggtgatccacctgcctcagcctcccaaagtgctgggatggattacaggcatgagccactgcactcagccttttttttttttttctttttttttttttgagacggagtctcgctctgtcacccaggctggagtgcagtggtgtgatcttggctcaccgcaacctccacctcccaggttcaagccattcttctgcctcagcctcccaagtagctggtactacaggtgtgcgccaccacgcctggcttttttgtttatttttgtttttattttttgagatggagtctccctctgtcacccaggttggagtgcagtggcgtgatctcggttcactgcaagctccacctcccaggttcacgccattctcctgcctcagcctcaggtgtccaccaccatgcccgggtaattttttgtatttttagtagagacagggtttcaccgtgttagccaggatggtcttgatctcctgacctcatgatctgcccatcttggcctcccaaagtgctgggattacaggcgtgagccactgcgcccagcccttttttttttttttaagtggagacggggtttcaccatattggccaggctggactcaaactcctgacctcgtgattcgcccacctcggcctcccaacgttctgggattacaggtgtgagccaccatgcccagctgcattttatttctttagtcaacatccatagcagcattattcataataccctcaaaatggaaaggcatatccattaactggtgaatagatgtataaagtgtgggatttccatacaatggaaattattcagcaataattattctcgccatctgcccaggcttgtctcaagtgacccacctgcctcagcctcccaaagtgctgggattacaggtgtgagccaccactcatggcctacatcaataaaactcttagagaaggccaggtgtgggtggctcacacctggaatcccagcactttgggaggttaagacaggaggatcacttgagcccaagagttccaggccagcctgagaaacatggcaaaacctcttctctacaaaaattttaaaaattagccaggcatagtggcacgtgcctgtggtcccagctactcggaaggctgaggtgggaggaccgcttgagcccaggagtttgaggcttcagtgagctgtgatcacaccactgcactccagcctgggtgacagagggagactctatctcaaaaacagaaaaaaagggccaggcgttgtgattcacgcctgtaatcctagcactttgggaggctgaagctggtggatcacgtgaggtcaggagtttgagaccagcctggacaacatggtgaaaccccgtctctactaaaaagtaccaaaaaattagctgggtgtggtggtgggtgcctgtaatcccaactactcgagaggctgaggcagaattgcctgagcccaggaggcagtgagccacttccctccagcataggtgaaagagtgaaactctgtcaaaaaaaaagaaaaagaaaagaaaagaaaggaaggaagggttcgcagaggttgcagtgagccacttcactccagcctgggtgaaagagtgaaactctgtcaaaaagaaaggaaagaggaggggaagggagaaggaggaaggaagagagaaagaaaaaaagagccagagcttgagctaagccttcagatgggctgtggcaggaaggaaggaaggagggagaaagaaaaaaagagccagagcttgggctaagccttcagatgggctgtggctggaaggaaggaaggaaggaaaggagaaagaaaaaaagagacgggagggagggagggaggaaggaaggaaggaaggaaggaaggaaggaaggaaggaagaaagaaagagaaaaaaagagccagagcttgcgttaagccttcagatgggctgtggctcagctgagacccggtcaatgctggaggcagccctgaaccttcccggtttcagcccccaaacccttggggcctgtgtgtggtcccagggccccggatacgcgagcctggatgtgtggcgccgagttgtttacagaaaactctccgtgagggaacgaggcctattttcaatgataaatgccccaaatcacaagtagttcaacccccaagtctgaattctcccaaactggagaaatcggcttatttccaataacaagctccaggctcaggggaggccagcccagccgcgcaggtgaagctgcaattagtgcagggcaattagggacgctccccgttcgggtggggcctggcccacggcggcgcttcgggagggaaaggcagagagggtgtgcgccagccccagccgcccacgaaccgctgggagcagacccctctctctggcctggaggggacacggtgccactgacttgagcctggaaccaaagggcggggtacccatgcacccctgtgctgagagattcgctgagagccgcgcagagggccccagagtccaaacaggacacccaggattgaggcgaggttaggaaacgcacagtacctgaggtcctcactttcagggctccctgagtgatgaaaggggggctgggagaaggcagaggctgcccgggagagaagagcagctttggggggttctgggtccccgcaccccaccccgcactaaccaactcccccagccccagatagaaggggagctgggcaggttctggggggtcagccccaggcaggaccgctccccaacacccttcccttggttaccctcaggtatggagtccagagtggagtcagccatgctcagaccttgaccccctttttttaaatttaatttttagtagagatagggggtctcactatgttgcccaggctagcctcaaactcccaatctcaagcgatcctccccccttggcttccaaagtgctgagattacggatctgagcctccacgcctgccctgagcctcgccctgcggctgcctgggctcctccccgcctccgccccggaccaccagggggcgctgtgaagcctgagactggccgggcttcaccttggacccgccaggagtccctgcaggagttgggagccccgccagccacagctacttccccgaccctcccggcttcccaccgctgattggaccaggcatgggcatctgactgaggggagcctatccataggctggccagtgatctatcagggctggcctagtgagaacacggccaatcagatgctttcctggaacccggggccaaagctgccccaggggagtgtggtagccgcaggcagaagggctagcccggagacaggagggggaggtccgaggaggggatcccggcgagggagacgcggggcgagtggcctgggctcctccttggcttgacccagcttagactttctcaaaccgaagtcattctcgctggctcctggcgactctcatcctgtccgctgtcaccctttcgtgattgacctgaaatcacttcgtcactgcagccgcaccctaagcattcatctcatatctgtgatgtttgctgtgctccttatgtttgctctaatatgggttaaaccaaattcaacaccatcaaaataatgttcttccatttgcacacccactttcacagtagcagcgttcccaacagccaaaaggtgggagcagcccacgggtccacggacgggtgaaggggtgagcaaacagtctatacggacagtggagagctctttaaccgcagaaagaaggaaattctgcatatgctgcaacatggatgaaaggtgaaccctgacattatgcggagtgcaataagctagtcacaaaaagacaaatactgtaggattccacttacattctgtgtccagagtagtcaaattcagagagacaggaagtagaatagtggttgccaggggctgggaggagccgtgaatggggaggtattgtttaatgggtatggagtttcggcttagattgaactgtacgctttttttttccttccttccttccttccttccttccttccttccttccttccttccttcctccctccctgcctcctttcttctttccttccttctttcttttccttccttccttcctctttttctctttccctctttccctcctttttctctttctctttccttcctttctttctttttctttctttcttcctttctttctctttctttttctttctctttcattcgtttgttccctccctttccttccttcctttctttctctttctttatttttcttttctttctttccattcctcccttcctccttctttcccctgaccatggcaaagacgtgaactgtacacttaagcatggtttaaacggtaagtgttatgtgatgtgcgttttaccaccatgtttgaaaaaggttcttctgtgcaccccagaacccatcctgcgtggggatccacagagcgcccagcccagcctctgcatggcatgaccaagagcatttgctcaccggggggctcaccgtggcctgagctagggcaaaagtaccaagccaggatggccctacccagccagagccggagactgaggggtcaaactggggtactttcctcgtctgcaaggagaactcatagcagtcctctttaaggttctttttttttttttttttgagaccatgactcactctgtcacccagcctggagtgtagtagcgccatctcagctcactgcaacctctgcctcccgggttcaagcgattctcctgcctctgcctcagcctcttgagtagctgggactataggcatgcaccaccatgcccagctaattttagtatttttggtagatactgggattcaccatgttggtcaggctggtcttgaactcctgacctcaggtgatctgcccgccttggcttcccaaagtgctgggattacaggcatgagccaacgcgcccggcccctctttaaggctctcaagggccctgtctgccaaggaagaaaatgccatcccaacccccagccccacccccacttccatacacacgttggccttagtggggactaaaagcagagaggaaatggaggcttagagaggtcgagtgacatgcccaaggtcacacagccacaaccggaagccagcaattccaatggcaaaatccatactctctctaaaactttgcttctgaactacaagaatgagagcctggcgagtgcaggctaggttgaggagaagccaccggacagacacagaacaccttccggcgcaccagccttccgtggccatttggagtgggaggtgcaaaattgagcaaatgcataaaacctaacttttgcatcacacaaggattcccatgttgcaggggtaccgcgtaacactcgcatggagttttttggtttgggttttttgttttgttttgtttttttgttttgttttgttttgttgagacagagttttgctcttttttttttcttttttttttttttgagacggagtttcgctcttgttgctcaggctggagtgcagtggcgtgatctcagctcactacaacctctgcctcccgagttcaagcgattctcctgcctcagcctcccaagtagctgggattacaggcctgcaccaccagacccagctaattttgtatttttagtagagacggggtttcaccatgttggccaggcttgtcttgaactcccgacctcaagtgatctccctgttttggcctcccaaagtgctaggattacaggcgtgagccaccacacccagcctcacgtggatttttgataaagcaaggttcttctgtgatagcagcaggcctccattatcctggtcaattggcctgcacaactagggaaacaatggtggaaaacttcgagaagcttgtgttccacctgccaccaatggagaaagcaccactccactgtgacatgcttcctgatgactcgctgaacagaaggatgcaccctcagccaccaagggtgtagtttgtgggtgcctcctgggaacatcaggttggcaacacaaatgccagcccctcaccctagagtgatttcagagtgtctcatctcttaactctgagtcacagagcggtggggaggaagacatggggcagggcagggcagggcagggctgggcgtggcgtggccactcatggagcagagggaagggtggagaggtgcactctgagtttgttgccttcatttgctttgttgatgaaggaggagcctgaggggcctggcagtgggactgaggctctgggccttcctgctcccctgggtttgacccagactccagctacccaggcattgccaggcagtatcctggggaaaggtgggacctgctgcttcccacgcctgccctgtgggatggggagggcttggggaaggtgctgctatgccctgagtccccggagccaaagactcccgagggtgacaagcagccctgcccgacctcaggcccaggggtgatggctgttggtggctcccaggctgagtcactgtagccttcccgtcactctctctgacacccagagactgggtcctgccatcctggggtaaggcagggggcaggaaggtgctttcgagaatgtagccctggccgggcacagtggctcacgcctgtaatcccagcactttgggaggcagaggtgggcagatcacctgaggtcaggagtttgagaccaacctggccaacatggtgaaaccactaaaaatacaacatatactaaattactaaataaaaaaaatactaaatacaaaaagtactaaaaatacaaaaaagtagctgagcgtggtggtgcacacctgtaatcccagctgcttcagaggctcaggcaggagaatcgcttgaacctgggaggtagaggatgcagtgagctgaaatcgtgccactgtactccagtctgggagacagagcgagactctgtctcataaataaataaataataaataaataaataaatacgtagctgtgccagaggcttagggaactgggagtgtcttagggaactggggacctaggaggggaggccacgtgggtagggctcccaccccactcacttcaactggacattctcagttcaggaagtgattttgttattgttgttgttgagcttctgagtaaaatttcctgtgaaaaggggtttagcaggcgggcgcagtggctcaagcctgtaatcctaccactttgagaggtcaaggcaggaggatcgcttgaacccaggagttcaagaccagtcagggcagcatggtgaaaccttctctacaaaaaaaaaaaaaaaaaaaaaaaaaaaaaaaaaattagctgggggttgtggcgtgcacctgtagtctcagctactcgggaggctgaggtgggaggatcacttgagcccacgaggttgaggctgcagtgaatggcaatcacaccattggactacaacctgggtgagagagtgagacactgtctcaaaaaaacaaaaattaaaaaaagaaagaaaaaggagttaactactaaaaatcatttctgggccaggtgcaatggcagagtcccagctactctggaggctgaggtgggaggatcatttgagttctgtaggtgaagtctgcagtgagctgtgagcacgccactgcactccagcctggacaacggagcaacaccctgtctgaaaaaaatataataaattaaaaataaagcctgggtgcagtggatcatgcctgtaatcccagcactttgggaggcctaggtggtcggatcacctgaagtcaggagttcgagaccagcctgaccaacatggagaaacccggtctctactaaaaatacaaaattagccaggcgtggtggcatatgcctgtaattccagctactcaggaagctgaagcaggagaatcacttgaagctgggaggcagaggctgtggtgagccaagatcgtgccactgcactctagcctgggcaagaaaagcgaaactccatctcaaaaataaaataaaattaaaaaatagccgggcgctgtggctcacacctgtaatcccagcaccttgggaggccaaggcaggcagatcacaaggtcaagagttcgagaccagcctgaccaacatggtgaaacctcatctctactaaaaatacgaaaattagtcgggcgtgattgcacgcccctatagtcccagctactcaggaggctgaggcaggagaatcgcttgaacccgggaggcggagattgcagtgagtcaagatggcgccactacactccagtctgggtgacagagcgaaactgatcccaaaaaataaataaatagaataatgaagatagaaatcatttggggtccctgcaccctacataaaatgtcaaatcataaaccccagggcctactctgaaccaagacctctctgttcctcactgtacctcctcagagaagaaactctggaagagcaagaaaagtgttagactcagagtcaagcggacccagtagaaaaccccagaaaaggacagctcagactcaatggaagcttatttttctctcattgtgaagatgtcggccgggcgcggtggctcacacctgtaatctcagtactttgggaggccaaggggagtgaatcgcttgaggtcaggagttcgagaccagcctggccaacatggtgaaaccccgtctctactaaaaatacaaaaaaattagctgggcgtggtggcaggcgcctgtaatcccagctacttgggaggctgaggcaggagaatcacttgaacccgggaggtggaggttgcagtgagctgaattgtgccactgcactccagcctgggcaacagagcaaaatgctgtctcaaaaacaaaaacaaaaacaaaatctgtttagaggggcccagggcttatatggcaaggagtgtcacagtgtcaggaacctgggctgcctttattcctttcatcctgtggctctgccgtacctggttttattttttttctttttgtttgctgttgttttttgagatggagttttgccctgtagcccaggctggagtgcaatggcgcaatcttggctcactgcaacctccgcctcctgggttcaagtgattttcctgcctcagcctccagagtagctgggactataggctcacgccaccacgcctggctgattttttgtacttttagtagagacggggtttcaccatgttggccaggctggtctccaactcctgacctcaggtgatccacctgcctcagcctcccaaagtactgggattacaggtgtgagccactgtgcctggcctctttttttcttttttttagacacagagtctggctctggggcccaggcttgagtgcagtggtgagacgggagaataagtcctagaggaagggaacctgaggacttcccagaactaaatcagatggagaggagagaggaggcatttcagctacgacaggaaatatcctcttcatttgcatagggcgttcaccaagtaagtgactttgtaacttcatcctcttcatttacatagggtgtacacccagtaaatagctttgtaacttcacttcagtaactcactttaagcctcttcatttacatagggtgcacaccaaataaccaatggaaacctctagagagtatttaaactccagaaaattctgtgacgggctcttgagccaacgtgctccggccgctcccactctgtgcagtcgactgtacttttgttttcaataaaactctgcttttgtttcttcattctttccttgatttgtttatacgttttgtccaattctttgttcaagacaccaagatcctggaaaccctccaacgctaacagtggcacgatcacaactcactgcagcctctcctgggctcaggtgatcctcccacctcagcctctcaagtagctgggactacaggcccacaccgccatgcccggctaattttcgtgctttttgtagagatggaggtctccctcggtttcccaggctggtctcgaacgcctgaccttgtgatccgcccgcctcagcctcccaaagtgttgggattacaggtgtgaaccaccgcgcccggcctggaccctccatttcttttttttttttgagacagagtctcgctctgttgccaaggctggagggcagtggctctatgttggcccactgcaagctccgcctccccggttcacgccattgtcctgcctcagcctcccgagtagctgggactacaggcgcctgccactacgcctggctaatttttttgtatttttagtagagactggatttcaccatgttagccaggatggtctccatctcctgacctcatgatccacccgcctcggcctcccaaagtgctgggattacaggcgtgagccaccgcgcccggcctagttttcttttttaagacggagtctcactctgtcgccgaggcttcactgcaacctccgtctcccaggttcaaaggtttctcctgcctcagcctcccaagtagctgggattataggcgcccaccaccatgcctggctaatttttgtatttttagtagagacggggttttgccatgttggccaggctggtcttgaactcctgacctcaggtgatccacccgcctcagcctcccaaagtgctgggattacaggcatgagccactgcactgggccacatgaatagttttcatttctgagatcacttcgtgttcaaaatggttgctgaaactcctgccattttatctgcattcccagaagtgagaagggagtagagtgtgcctttccctttaagaactctttatgaagtcaaacacactccttacattgaggccaaaaattagtcacatggccacacctatgtgtaagggaggctgggaaatgtcttaattccaggcagcaaatgccctgataaaatatcagcttctaatcccttggatctctgtgggaggtggaggtggggagtggaagtggaggaccgtgagcaatagctgatgtaatcactgagaagctgtgtgtccttgggcaaatcccttcacctctctgagctcctgcctgtctttgaaatgaggatgtagaaagatcatctccaaggacactccctgccttgacattttgagactctggcgcagggagcccagggtggtcaaagacaagaacagaagctgcttgggtttaaaagttgcctggccaggcacggtggctaacgcctgtaatcccagcactttaggaggccgaggcgagtgaatctccaggtcaggagttcgagagcagcctggccaacacggtgaaaccccgtctctactaaaaatacaaaaaaattacctgggcataatgacaggcacatgtaatcccagcaacttgggaggctgaggcaggagaatcgcttgaacccaggaggcggaggttgcagtgagccaagatcgcgccactgcactccagccctggcgacagagtgagactccgtctcaaaaaaaaaaaaaaaaaaatgttgcctgttctgggctgggcgcggtggctcatgcctataatcccaacaatttgggaggctgaggcaggcagatcacaaggtcaggagttcaagacgagcctggccaacatggagaaatcatgcctctgctaaaaatacaaaaaattagccgggcatggtggcaggcacctgtaatcccagctactcgggaggctgaggcaggagaatctcttgaacccaagagacagaggttgcagtgagcccagactgtgccactgcactccagactgggcaacagagcaagactccatctcaaaaaaaaaaagaatggctaaggcagagcaggtccgaaggcagctagttgcccttttgtttgtttgtttctaagatggagtctccctctgtttcccaggctggagtgcagtggcatgatcttggctccctgcaacctctgcctgctgtattcaagcgattctcctgcctcagcctccagagcagttgggattacaggcatgagccaccacgcctggctaactttttgtatttttagtagagacggggtttccccatgttggcctgtctggtctagaactcctgacctcagatgatctccctgccttggcctcccaaagtgctgggattacaggcctaagccaccatgcctggccaagcttgcccatttttatggttatttcttgattacatgctaaatagagggtgtattattcatgcctccccattttagaccatatagggtaacttcctgacgttgccatggcatttgtaaactttcatggtgctggtgggagtgtagcagtgaggacgccctgaggtcactcttaatcgccatcttggttttggtgggtgttggccagcttctttactgcagcctgtttcatcagcaaagtctttgtgacctgtatcttgtgccgacctcctatctcatcctgtgacttagaatgtcttaacctcctgggattgcagcccagtaggtctcagcttcattttactcagcccctgctcaagatggagttgctctggttcacacaactcaacactttgggagactgagatgggaggatcccttcagcacaggagttcaagaccagcctgggcaacatggcgatactccctctctgcaaaaaatatatgtaaattgccgggcacggtggcctgtaatcccagcactttgggaggccacggcgggaggatcacgaggtcaggagatcgagaccaccttggctaacacggtgaaaccccgtctctactaaaaatacaaaaactcagcccggcgtggtggcgggcacctgtagtcccagctactcgggaggctgaggcaggagaatagcgtgaacccaggaggcagagcttgtggtgagctgagatcgcgccactgcactccagcctgggtgacagagcgagactctgtctcaaaaaaaaaaaaaaaaaagatgtatatttacttatttacaaaaaccgggccaggctgggcgcggtggctcacacctgtaatcccagcactttgggaggccaagacgggtagatcacaaggtcagcagatcgagaccatcctggctaacacagtgaaaccccgtctctactaataatacaaaaaaaaaattcgccagatgtggtggcggacacctgtagtcccagctactcgggagactgaggcaagagaatggcatgaacccaggaggcagatctcgcagtgagccaagatcgcgccactgcgctccagcctgggcgacagagtgagactcagtctcaaaaacaaaagcaaacaaacaaaaaaactgggccagacgcggtggcttagcctgtaatcccagcactttgtgaggctgaggtgggcccacctgaggtcgggagttcgagaccagcctgcccaacatggtgaaaccccatatctactaaaaatacaaaaattagctgggcatggtggcaggtgcctgtaatcccagctattattgaggctgaggcaggagaatcacttgaaccgggaggtggaggttgcagtgagccgagatggcaccactgcactccatcctgggcaacagagactgtatctcagagaaaaaaaaaagggggggggcaggtgttttgtctcacgcctgtaatcccagcacttcgggaagccgaggcgggcagatcacaaggtcaggagttcgagaccagcctgggcgacatggtgaaacccccgtgtctactaaaaatacaaaaattagccaggcgtggtggcgcatgcctgtaatcccagctactcgggaggctgaggcaggagaatcatttgaacccaggaggcagaggttgcggtgagctgagattgcgccactgcactccagcctgggtgacagaacaagactctgtctcaaacaaacaaacaaaaaacgatctgtcctctggtgacacgggagcctggatgccttgctggagtggatagtctgtggctcgggggagactctctaggagcccccaggccaccctgttccttcctgcaaggctacttgctgccctgacccctctgaggggcaggcagggaggggagaggcactggggaaactgcagggggatgtggttgtgatccaggcctgtggagggagtgctggggaaggggagacttcagcaagggcagatgaagccttgttttttccttttttctttctttctttttttttttttttttttttgcgatggagtctcgccctgttgcccaggctggagtgcagtggcgtgatctcagttcactgcaagctctgcctcccgggttcatgcccttctcctgcctcagcttcccaagtagctgggactacaggcgcccaccatcacgcccggctaattttttgtatttttagtagagacggggtttcaccctgttagccaggatggtctcgatctcctgacctcgtgatccacctgcctcggcctcccaaagtgctgggattacaggcgtgagccactgctcccagccagatgaagcattgtgactctagggcatgtaaattccctggcagccaggccctgggagcacccctcccctcctgtgcccttgacacctacctcagtgaggcagccccagcagccgggcagtgggcggcagagaagggtgtcctgggacagaggttttcctagtctttcttcagaatggaggaagcccctggggtgcctggacttcctgtaggacccagggaagaaagatggccattctccctgtcgcgtgatgggggctccagctgttttacacaagaagacatataactttcatggttaagagcaggggttctgggcctgatggcttgggttcgaatcccggctcctatgcatgccagctgtgttacatacttctagacaaattacataacttctctgtgcctcactttcctccactgcaaaacgaggagtcctgagcaggtgagatcccctgacagctctcgggacagctggagtgctcagtgaaagctcttcgtgcaatcactgcggagggtgaccagggacatcgataggacgctggagggattaccctatgtcccccgacccgcccgactacaacagccttgcagataagccacgagcctgcctgctcctcctcgtgagttggagacaggagagggagcagagttcaggggcttgtttctttctttcttttttttttgagatggagtttcgattctgttgcccaggctggagtgcagtggcgcaatctcggctcactgcaacctctgcctcccaggttcaagtgattctcctgcctcagcctcctgagtagctgggattacaggcctgcgccaccatgcctggctaatttttgtatttttagtagagacaggggtttcaccatgtcgcccaggctggtctcgaactcctgaccttgtgatctgcccgccttggcctcccaaagtgctgggattacaggcgtgagccacggtgcctggccaggaccctccatttcttttttttttttttttttttttttttgagatggagtctcgctctgtcacccaggctggagtgcagtggtgcgatctcagctcactgcaagctccgcctcccgggttcatgccattctcctgcctcagcctctcgagtagctaggactacagtcgcctgccaccacacctggctaattttctgtatttttagtagagactgggtttcaccgtattagccaggatgttcttgatttcctgatcgcgtgatcctcccgcctcggcctcccaaagtgctgggattacaggtgtgagccactgcgcccggctggaccctccatttctaataagctcctgggagagtcctccctggtgctctgagggtgactgaccggcaaggcacttctggggcccctaagccctccaacctcagctgctgtggagagctgacccccaggggagtacgtcagggtgctgggtggggcaccagtttcaaggatgcccaacacagccctccccttggggctgcaaggccctgggaccagcggcccagccctgtccccaggcaggtcctcagacctaggaccacaggggggtctggggcccaggccaagggcaaacctgctgggatctgagcccctcttggtggcttcctggtgtgtgcacatccttccccaggcaggagaggaagcagggccagctccttctcctcccagggcaagacctgaagtctctgtttgtgtgtctgtcagacttgctgtgagggccacagtgtctccactgaggccttatccagcctccaggaggtcccatttttcagggaaagggcctgctgctgaaggctgtcactcatctgacttcaaatcccagctctgccacttccaggctgtgtgactccaggcaagttgcttaacctctctgtgcccactacttctgtaaatggggatatcatgggattctcgtgagctgtgaatagcatctgttgatgtgtttgtttctgtgcattcagactttccctctttcctcaggcacttgccgggcagccttctgtgccacatccctgaccctgccccagggcacaccagcttcagtgacagggatggctggtgaacaggaggcccaggcctgctgctctggccgatgtaaatccaaggagctgtgatgacgcgggagaggggcggtttgggaaaaaatgtgtgaaggatgcccccgtgggagcaggagccccactggcaggggcaggccgggggtaactcagccacagggaaggggcccagccggggctggagggagggccacctgcagaaatgagctgtgggggggcgagaagggcaggcagctggggctgaggaagaccagcccccaagacacccatggagaaactgaggcagaatctgtacttggagccagccaccgctctccactggcccacactgctgtgatccttcccacgctgcgcggctggctggaacccaaaccccccacagcgggcctggccttcagagctggttccagatgtttaaatacccagccttcacctcccgtcacagacacttccactggaaggtgttggtgccacatccccagtgctgccaggctaatatggggtgggggccttgcagccccaaggggagggctgtgttgagcgttctggacactggtgccccacccagcacccagcaggggcactctgcgctgtgctgcccctccccagctgcctgggccaccagttcaggagagctcacccctttgcaacctttcccaactcaatgccacgccaggaagtcaggagggggatgaccctgccacactctgccccccagctcccttcccaccatgccccgggaccaagacaggagggccagctgggcccagggcacttcgccagtatcatcgggtcctcaccacagccctcaagggggtgttcctgttccacacacagaagactgaggcccagggatgggactgggtcgtgtgaaacgccaggccatgcccggccccgcagagtcctgcgtagctgcccggccggcccagggctcagatcccctcctccaggcctggccccagctgctattggggcccactgaggcctactggatcctaactggatgcaattaggacatcacctgatgcccctgtcagggtggctcctcccaaccgctagaggactcaggccaaaggcatttggggtgcagcccccaccctggccctggtgggccggagtcatgctctatgtgccccccagctgtccaagcaggggtgtacagagactctggggtggggtgagggtgagagcctgagaaggctgttgcggaggacacaccggaaactgtcaccaggccctgccctcagccgacccgggccagggccaggagggcctcctgggggccgccatctttctgttctgggaaggccaggctgggggtgagctccatggggctcctgtgtcctcatccattggtgggatgcggctccctcccggggacctctcagggcactgataagagccaccaggactaggttcagcccacagcaggtgggatgcacccgccccttggcgggccgggggtggagaccgggagtttctggagaaggcctttcagattctgaaggcaggcactccatgccccatccctggagcgcgagtgacaagtgtctttgtcacagaaggacagaaaggccctacgtggcccctgagcagctctggggaacattcttggtccgggttcctgtctgggggttctggagtctaggattccaggatctgggttttgaggtcttgggttgtagggtctgcggtttgaagcccctcttgtaacccaggacagaggtgaaagcagtggggtggactgggcagcccccaaagttcaatggacctaaagtgctggtgctcagccctgcccaggcagctggcaggtggtccagaaacccctcgttctatggagactgaggcccaagtctttggaggtggtcaggggtctgtcccagagcacctttgggcgaaaggtagggggaagaccacccaagacgaccctccccaacaccagcaagggagcccagcatctcctctgaggccactgccctgtgggtccagcctctctgggctgggtgtgtggaggccgctcctatggcggtgtgggcggtgcagctcattcccccggggctcccagcctcccacccccatccggcctcctcctccagagcctggggactggtggatgcctgccaagaacgcccacagcctgccaggatgcgcaggaagcacacacacgcctaatcccacccccattgtcatagatccctcttgattctgggcctgtctttctgggggaaactgaggcccagagggattgagggcccccaaggtccccgagtctccaggtgtaccttggaggctgtgctttagtggggcctcccccggccttctttgcagtcctgagtgtgtgaaggggaggaatcgggggctgccaggccaggagccaaggccgggggtggggagcagctggcaggtgtcccggcaggaggcccggctaggggagaccagaactcctctgctcctccctcccaacggcttcccaccccactctacagcaggccgctggcaggcccggaagggcttgggagccggagggtgcttgccggggctcctgaaggcctgaggagctcctgagggactggaggcttcgggcctggaaggctggaaggcactggccctgcagcttggttcccggggctccacgtgtctgaatgcaaaacaaaggcggctcacaatgagaaggcgggtgctggggatctgcccccgtcgtgcatgtgtcaccacacggtgtcgaagcggacacctgcctccgggatgagcgcattgggcaacactgcatgctttgcattgggaacatgtttgtgtgtgtgcgttgggggtgtgtgtgcggtggggggctatgggctgggatgtcccttgaggtgatcagctctctacgttccgcacacacaaacacacagtgtgactgagacacacatgtgagtattgagatctccagggctgacttcctgccggaagcatgccctggcccccgtcaccttgtgtgaaattcctccacctgagcaccttcccggtagagccacgcgttgcctgtgatggaggggccatgactaacccaggcactaggcctggaggctgggctggctgcgctgtacagttgcaaggacctgccagacagctctgtggacagagcctccgtcggggtttcaccacgttggccaggctggtcttgaactcctgacctcaggtggtctgcctgcctcggcctcccaaggtgctgggattatacgcatgagccacagtctcgctctgtcacccaggctggagtgtagtggcacaatcacagctcactgtagcctcgacctcctcagctcaagcgatcctcccacctcagcctcccaagtagctgagactactacaggtgtgcaccaccacacccggctaattttttaagtttttgtagagatggggtttcgccatgttatccaggctggtctttttttttttgttttgttttgagacggagtctagcactgtcacccaggctggagtgcagtggcgtgatctcaagttgctgcaacctccacctcctgggttccagcgattctcctgcctcagcctcccgagtagctgggagtccaggcacctgccaccacgaccagctaatttttttatttttagtagagacggggtttcactgtgttagccaggatggtctcgaactcctgaccttgtgatccgcccacctcggcctcccatttacagtagactgttttctactgtaaaaggctttttcaatcaactttggtattaggtgtctatttactactgcatagtcaattacctcaaagcttagcaactgaaaaccaaacgccatctcgcagcataggtgggttagaaattcagaagtggcccagcccatggctctggcccagggtctccagcaggctgcagaggggacagcagtgacttggagggatttcttccaagctcacccacagggggaagccttcagctcctggccaccttcgcctctccggcctgggacagctgactctccccagggcaagagagcaagaagggggggccaccactacccaaaacaaaagttggtctttttttggccaggtgcggtgactcacgcctataatcccagcgattctcctgcctcagccccccgagtagctgggagtccaggcgcctgccaccacgcccaggctgatttttgtatttttagtagagacatggtttcaccatgttggccaggctggtctcaatctcctgaccttgtgatctgcccatctgagcctcccaaagttctgggattacaggcgtgagccactgtgctgggccatgtgggtcgtattctattcctaagtcacccagtcctacccacactcagggagtacacaagggaacagacagcaggaggcagggattgctgggggccttcctggaggctgagtatgatgagcgcccggtgaggagtcctacaaagttggtaaggggtccgctcttggaatggatcgtagtcatactcgaacacttactctgtccaggcactgctccaagaactttatgttgagccctcactaccaccttgggctcggcatgtgagcctcactttacggaataataaagagaagagaagtggccaggcacagtggttcacgcctgtaatcccagcactttgggaggccgaggtgggtggatcgtgaggtcggagttcgagactagcctggccaacaaggtgaatccccgtctctactaaaaatgcaaaaattagtggggcgtggtggcgggcgcctataatcccagctactcaggaggcagaggcagaaaactgcctgaatccaagagatggagggtgcagtgagccaagatcgtgccactgcactccagcctgggtgacagagcgagactctatctcaaaaataaataaataaataaaataaaaaaaagagagagagaggaaaagtgtcttgttctcaaatccctcagcccataagagctctggagctggctgggattccagtctacatgggtttgtacccaaggaggaagctgggctgggcaggctgtgcctcagagcctgcaagatatggcactatgtcccccatgggagctgatattggatcagttcaggaaaaggtgacatcagaagaggctctgtgggtgccctaagccaggggtggagggcagagggttggggagaggagctcacccccaggagagggtttggaggttagacagaagagggctaaggtcagggaccaagggctctgtgtctaaagatggcccagggaagagggagtcagctagaatgtgggggaggccaggaagggaggctgcagtggtgtggactcctctgcaggagcagcctggccatgtgatggcacaggagcagggcagcgtggggtcaaggcccacagggggcaagctttccgttccggtggctgggtgggagcatggccacattctttaccctctcattgggccagtgctgccccagaccctgtctgggctgatgccccagatgtggcctgccagctcaccagccctgaggccacgtgtcccaggtgccccacccggggcggtgcccccccatccattgccccagctagtccagcctatgtgcccagcaccctgccctctagcctctgccctcagcccctgggagccatcactcttcatgaagcaacctgacccttaggccaggctgtcacactgctgggcacctccctctccagggagcccaacagacgtcctaacctttcccagacctttttattttatttttttaaatatatatatgcacgtattagagatggggtcttgctatgttggccaggttggtcttgaactcctgtcctctcacatcggcctcccaaagtgctgggattacaggcatgagccacggcatttggcctctcatacctttgagagtgcagatgaggaatttttgcagagggccacaagaatcctgcctactccgccctcccccgcccccaccaccacccaacaaatgcagatatttggtgtctccccagaatcaatgtccagcactcaccaggggccacaagccctggccaaggcctgtctgcctgtcccagtgtctgtctctgtccctcccgaccagcctcggaatctctccagcaaacactggaccactctgcccggctcctcccagctgcatgtatccacccagcccccagatgccagcaaaggctccactgaccaccccccagaggggcgggtgtgccgtccccaccacctagtccagcctagctggccacaggcctccacccgcatttccagcctttgtccgagtcattctcctgcctaacctgtccctctcccttctccaaacgtccagatctttcccatcctttagggctctgctcaaagccggatagctgagtctgagaaagtgacccaacctctttgagccttagtttcccccctcccttgccagggaactgggaggagggaagagggtgcggccgtggggagcctggctccccgcatccgcccagcccgcggggctccccatcccggccagtggctccctaagccttgccaggtggtgacggctccttgggcggcccattcccgccccgcaaaaccagctaagggcccctgaaacgctgcccggaacgccccgcgggagaacatctgcgccaggggccgggggccgggggccgcggcgggcgaaatccgagaggcccgggctcctcctgctgcgcggccggggaggggggcgcctgccgggtcggggctggaggacctgcgcgcggccccgggaggccccgcctcgccttccagtctgtgaaatggggcgacggcctgggcgtggcggcgagttcttgtccgctgccggcgggcgcggtcgtcgaggacacagctaggggaggcgcagaaacacccggaggcggcaccgccgtctcctccccgggatcccacaccccgcaggttcaggaggaaggcgcggcccgaggcctccggggcggggtgtccccgagacgggaacccgaacccgacggcctccgttccgcctgcgccccttcaaggctcccggacgggcctcagtggcttccccgcccctccccaccgcgtcccggctccccgggcggggggtggggggggtcgcgtgcggacggttccccaccccgcgcgtgcgcacctctcctcccccaggagattaagtggggactctgaaccctgtctccagccctgatggggaggagtaatccgattgctttccaaacccggcctcgccttgcaaacttgtccacccccaacccacccggacggccgggccgccgcctcctctgggcctcgtctccccttcaagcccccggccttgtggggaagggggaatccttgacgcattttacagacggcacatagggtcggggcagtgctttaaccggagaccaggagcctgactcttccagggctctgtgagacagcctggtgcctggcgggggtgacacagccccactgtctgccccgcgtttacagccaggaaccacacctgagccatttccaagggtgacatgtgtcacagaactgtggggaaggggctatccagagattcccagtaggagacacggggagacctgcagggtgagtttggacgggactagagagggggcagggctgggggaagaaagtgcccccagcggttggccctgagagaggattccagggctcccttgaaagaacagcggggtgggggtggggagcagaaaggaggcctgcgggccacatgcagcctctggatctcagcccagcagcccgaggagccacagctgggtgcagagtggctcattcgtattttactagatccctcgggcctctgtgccttcccagggctctgcaagccggggaagaaaagaatcgttgcttcatcctgcaactcccagacggtgcttcccgaccctggtgcgggtggtgaggagggggagggaggtggttgtgaggcctgctttgcagttgtttgtggaatacagtaagattcttggctgggatgagccgaacaggacgaagaaccgaattctgccggggccgcttaaggaagactgcctaggcgaggtggcccaggctggggatgagccagtggaggaggaagtctcgagagaggggacagcagtgagcccagcaccctctccatgggagtctgagtgtaaggcatcccgacctgtctgccagcgtctctctctgctgggggctgctaaggtgcagataggaagcggtcgggggcctctgtgtatgggtggaggaggcggatggtggggggcaggcaggcgacggggcagggaagaccctatgaaaactaggacctgtcctatggacaggcttcaccggcggacagtgggggaatctggttaaactctgagtctaaacctcacgctggccgggcacggtggctcatgcctgtaaatcccagcactttgggaggccgaggcaggcagatcacaaggtcaggagtttgagaccagcctggccaatatggtgaaaccccgtctctactaaaaacacaaaaattagccgggcgtggtggcaggcgcctgtagtcccagctacttgggaggctgaggcagcagaattgcttgaacctgagaggcagaggttgcagtgagctgagatcgtgcactccagcctgggtgacagagtgagactctgtctcaaaaaaaaaaaaaaaaagaaagaaattaccagggtagggcatggtggctcacgcctgtaatcccagcactttgggagacggaggcaggtggatcgcttgagtccaggagttcaagagcagcctgggcaatgtggtgaaacctcatctttattaaaaatacaaaaattagccaggtgtggtggtgggcgcctgtaatcccaggtacttgggaggctgaggcaggagaatcgctggaacctggggtgcggaggtttgcagtgagctgaaattccactactgcactccagcctgggcgacagagcaggactccatcttgaaaaaaaaaatctctacaaaaaaatacaaaaactagccgggcatggtggtgtgcacctgtagtcccagctggctcgggaggttgaggtgggaggattgcttgagcctgggaggcggaggtgccagtgagccgagatcacaccactgcactccagcctgggcaagagagcaagactggaaagaaaaaaagagagaaagaaagaaagagagagacagagagagagagaaaggaaggaagaaagggagggacggagggacggagggagggagggagagaatgaaggaaggaaggaaggaaaaaggaaggaaagaaagaggaaggaagggagggaggaaggaaggagaaaaataaataactgaacacatatttatcttacagtttctccacatcaggagtctgtgcatgattaagctggtcatttgcttagggtctcacaaagctgcaatcaagggtcccactgggatttcagttgaatttggctggggaaggatacgcttctgagccaccgaagttgctggtggagttcagttatttgctgctgtaggactgagggcttcagttttgttttgtttgtttgttttttgccaactattggatttagaggctgtccttagatcctagaggcaagctgttatctccacatggcagttccttgccatgggggcctttcagtgtaacagcatggcagcttccttctttttctttttttgagacagagtctcactctgtcacccaggctggagtgcagtggagagatctcggctcaccgaaacctctgccttctgggttcaagtgattctcctgcctcagcctcccaagtagctgggattacaggcatgtgccaccatgcctggctagttttgtatctttagtagagacggggtttctccatgatggtcaggctggtctcgaactcccgacctccggcgacccacccaccttggcctcccaaagtgctgggattacaggtgtgagccaccatgcccagcagcagcttccttcttctaagccagtgagaggggaagagactcaagcgagataggcacaacagtcttatgtgatgtaatcccatatattccatcacctttgtcctgttggttccagcgagtcacaggtcattcccacactcaacaggagggactacaaaacggtgcaaacaccgagggcagggatctttgggagctacttttttttttttttttttttttgagacagagtctcgctctgtcgcccaggctggagtgcagtggtgtgatcttggctcactgcaacctctgcctcccgggttcaagcgattctcctgcctcagtctctcgcatagctgagactacaggcacatgccaccacgcccagctaaattttttttgtattttaatagagacagatttcaccgtgttgcccaggctgacctcgaactcctgagctcaggcaatccacccttctcagcctccgaaagtgctaagatgataggcgtaagccactgcctccagcctgggagttattttggaaggaccctaactacactaagcaactaaaaagaaaggcaattattaacttcatgaaaaactgaaagttaaaccagaaaggaaacttaaccacagtgcattagttggctcagtagcaaacaatgtttatataatcattataatgaaactgaatattgatttgatccgaaattgctctatattgataatgagaggtgacacagggagagtatggggaggggggtgttgcacggaagagtgtaaaaaatgtgaaactcatcttctgtaagggaaagccagtagataatggctgggttgttaaatcaagtaacaacagcacaagaatgttatttataaacatggagataaaatccagaaaaagaagccaaaaaagttgaatgtggctgtctctggggaggattaagagtgggataggtggggaggggctgctgcttttcactatgtctatttgccttttaaaattctatgcatatcatgtgcctatactttattgcattacttggataaaaatatacagtaattaatagagaaaggggtaggggaggagaagcatccttgaagagtgaacagtgaagttccctgggggacaggctcccatttagaggcagagatgggggaggaacaatatcccctgggaaccctcaggggctcatacaccagaaattacagtaaccagagcttgcaccaggagaatatagtaactgcctggggcctgggggaggtgggcgttcctggggctggggggatttgagaggatagtggtgggggtgagcttggatcctccttggggtggagaaggagcctcgggccccgagtgggtttcccccaccctaggagtctcccatctccatagacatttcttggggagactctgaaggctctgaccaggttttcttttgttgttagaaagggggtctcgctatgttgcccaggctggagtacaatggctattcacaggcatgatcatagctcactgcagccacgaaatcctgggctcatgatcctcccacttcagtctctcaagtagctggaactacaggcatgcaccactgcagcacctggcttttttttttttttttttttttttggcagacggagtctcactctgtcgcccaggctggagtgcaatggcacgatctcagctcactgcaacctccacctcccgggttcaagcgattcttctgcctcaacctcccgagtagctgggactgtaggtgcccgccaccatgcccggctattttgttttatttattttttttaacagtctcactctgtcacccaggctggagtgcagtggcaggatctcggctcactgcaacctccacctcctgggttcaagtgattctcctgcctcagcctcctgagtagctgggattacaggtgcctgccaccatgcccagctaattttttttgtatttttagtagaagcggggtttcaccatgttggccaggctggtctcaaactcctgacctcaggtgatccacccgcctcagcctcccagagtgctgggattacaggtgtgagccaccgtgcctggcctttttttttttttttttttgagacaggatctcactcgttcactcagattggagtgcagtggtgtgatctcagctcactgcaacctctgcctcccaggctcaggtgattctcccgcctcagcctcccaagtagctgggaccacaggcatgcaccaccatgcctggctaactttttgtattcttagcagagatggcgttttgccctgttggccaggctggtttcaaactcttgagctcagacaatccaccctctttggcttcccaaagggctggtattacaggcatcagccactgcgccccagcctatctctgtcactttctccctgccttcctctctcctccacagaatgatctctcgcagcacccaagtctgcaccctgcttcactcactcagcaatctgtccaggagctccttcaatgtcaagacatccagaaagatctgtcttcctccttttccaggcccctgtgcaggaaccccctgcacctggtcccccgtgatgggtgctcaggttggtgcagaactttgcttttattaattatgcgacagatggaacccctcagcacatcctacgaggctttcttttgccctgggatgccctacgaacctgccctgggatgccaggtccatctaggtacactcgtcataggccaggtgtcccaggccccagcagctgtgtggacagctgtgaggaaaggagagtaaggaggaagaatgctggtgactttgggtcaggaagggatttctgggctgggtgcagtgacccacacctgtaatcccagcactttggaaggctgaggcggggaatcacttgagcctaggagttcaagaccagcctggggaacatagcgagaccctgtctcaaaaaaagaagaagaagaaagggacttctgggggttccttggttgctggcactccccaagggcacagggctatctctggggctgccactgtgggcctgggcactggtgatggggggtggggagatggctgagagtccctgtctggagcacagtccctggctggaaggtgattctggctgtcagaggcatttgaaccagagcaactccattttgaataggggctgtgtaaagtgaggctgagacctagatgggctgcactcccagagggttaaggcattctaagacaggatgagataggaggtcggcacaagatacaggtcataaagaccttgctgataaaacaacttggagtaaacaagccggccaacacccaccaaaaccaagatggtgacaagagtgacctctggtcatcctcactgctacactcccaccagcaccataacaatttacaaatgccatggcaacgttaggaagttaccctatatggtctgaaaaggggaggcatgaataatccaccccttgttttgcatataatcaagaaataacctttgggtgtggtggctcatgcctataatcccagcattttgggaggctgaggtgggtggatcacttgaggccaggagttagagaccagcctggccaacatggtgaaaccccgtctctactaaaaatataaaaattagccgggtttgatcccagctacttgggaggctgagtcaggagaatcgcttgaacccaggaggtggaggttgtggtgagccgagaccgtgccattgcactccagcctgggcaacaagagtgaaactctgtctcaaagaaaaaaaaaaagggcaaccagcagccctcagggctgctctgtatgtgaactagcaattcttttttcctaatcaacttgctttcagtttactctatggactcgcctggaattctttcttgtgtgagatccaagaatcctccctctcttggggtctggatgaggacccctttctggtaatatggcctcttacccccttggtataccttaaggtggccttgggcaacttacattacatctctgggcctcagtttcctcctctaaaaaatggggataacaaaagcccctctcctaggagaagaggcagggaacagctggacagggcagagagcctatcttgggatcccggggaggggctatgaaggaaaggcttcaggaattgagtgggacagggtatgggtcagaattctggtctgagctgcctgccccatgactccaggccctcccgtggcagggcccaggcacctggcctccaagcctcagtttcctcgactcagcaatgggcatggcagccccaaccttggagtgacatattgtctaataaccctgactcactccccacctcccacgcccaggggcccctgcagtcctgagatgggccaagtcaagccacacctctcttccggctggagcagcctgaccaagtcccacttgctgttctgccagggagcctgattttggcactggtgtatttccagaaccaaggtgggtgcccggtctgaggccctagcgggtgtctgggtcccttcctggaggccccttgcctccctcagccctggcttttgggacttagcaggggaggaagttttttgttttgttttgttttgagacgaagtctcactgtcaccaaggctggagtgcagtggcacaatctcggctcactgcaacctccctctcctgggttcaagcgattctcccgcctcagcgttgcgagttgctgggactacaggtacgtgtcactacacaggctaatttttgtattttttagtagagatgaggtttcactgtgttagccaggctgaactcctgacctcatgatccgcccgcctcggcctcccaaagtgctgggattaccggcatgagccaccgcgcccggcctatgggaggaagttctgacatggatggcaggggtggggagggcagctgaggactctggagcagaggctggggccccactctggctttccctggccctaaaggaagggtggggtctgagagtgtggaggcctgagagcaggggcagcacagacacccactctgagaccacttggttgtcccagccaccgggttccaggtgtctggggccaggtggggttttctctccaagcccagagtgacctccccactcccagccttgcccagagcaagtcttgctgagttctaaggtgaactcccacttgttccagaccagggacacagggtcctgcaggcctcccggagcaagcactcttgagagggcttctccacgtggccacaggacagactgtgcttcatccagcactgtacgctcaaacacacacacctgaaacaaaggctccacgaacaggcctgcccttacagcacaccatgctcttgtttagtcttccttatgttttttgttttcgttttgagacggagtcttgccctattgcccaggctggagtgcagtggtgcaatcttggctcactgcaacctctgccttccaggttcaagcgattctcctgcctcagcctcctgagtagctgggattacaggcacacagcaccatgcccggctagtttttctatttttagtagagaaagggtttcaccatgttggtcaggctagtctcgaactcctgacctcgtgatctgcccgcttcggcctcccaaagtgttgggattacaggcatgagccaccacacccggctgtcttccttatttttttaaatgccagctgttttatgcacaattgtcccaaactagaaacaacccaattatccatcaactggtaaaggaataaactaatgtgttatctttgtttgtttatttaattttgatacagggtcccactctgtcgcccaggctggagtacagtggagagatcacaggtaactacagcctaaacctcttgggctcaagtgatcttcccacctcgggcacacctggctaatttttttttttaattgaatgtggtatattatttaaaaggaatgctggccaggtgtggtggctcatgcctgtctgtaatcccaacactttgggaggccaaggtgggtggatcacctgaggtcaggagttcaatatcagcctggccaacatggtgaaaccctgtctctactaaaaatacaaaagttagccatgcgtggtggcgcacgcctgtaatctcagctacttgggaggctgaaacacgagaattgcttgaaactgggaggcagaggttgcaaagtaaaccaagtttatgccactgtgttccagcctgggcgacagagcgagactgtctcaaaaaaaaaaagaaaaaaaaaactataatggtaaattttgctatgtatatttttatcagtgtttaaaaaaaaacataacaaactctcccttggctctgccatgctccttatagggcaggctactgtaaaatgaaactacgggccaggcacggtggctcatgcctgtaatcccagcactttgggaggccaagatgggtggatcacctgaggtcgggagttcgagaccagcctgaccaatatggagaaacccccgtctctactaaaaatacaaatttagtcgggtgtggtggcacatgcctgtaatcccagctacttgggaggctgaggcaggagaatcacttgaacccaggagtcggaggttgcagttgagccgagatcatagcatgccattgcactccagcctgggggacaagagcgaaactctgtctcacaaaaaaaaaaaaaaaaaaaaaaaaaggaagaaaggaaggaaggaaagagagagaaagaaactacagggactcttgttaaaaaattattaagaatttcaagatggcaacagcagcatattaaaaccaagtgtggtctcttctaggctcaggaccctatgggattgcacaggtcgcagcccaagcgcagtacttgcgcacaggtcccagccccttccctctctgggacttgtcttctggcccctcactcctgcgatgagcttttctttcagctggtgaaaggccgcagacttcgaacctctgggcctttgtccaggacgttccctcagcgctcagtgcccttcctggtggcctcctacatcttcagatcccggctgagctctgcttaaatccgggaccgggtagtcactggggcagccacttggctggggcgaggccacctcgctttgggtcttgtcgcgcccaggccagcgccagcccaggcttgccatggactggctcctgggcgttagatgaatgaatcgactcaacccgggccgccacgttgtgttcagaacaccgacagtcgctcccaggcaaccagcacctgctgcgccccgtttccagcgacctccccaaccgcgtggactcgcatccacgtgcccggcggggccgcagcagaaaggctcggaccccccaggacgatcggccggtgggggccggtggggccgcagactcggggggcggggggcgccaggcttccgggtcctgcccccgccccgtggggaacagcaggacggcgccgaggccgtttcgctttcctccgcgcccatttgccgggaggggaccccgtgctccgacctgaaggtgacggcagagcctgcgggaggcctaggccggtcccgccctacgggtcccgggggcgaccctcgcgctgacattggcgtccaggccgcggcccctgcctccgcgcccacccacgccgggcctggccctcgctcccccgggaaaagccccgccggcggccgcgagagcgcggaagcgcagccgtagtgaccgcgagacaaagacccggcggcgggggaggcggcggagagaccccgccagcgcggagaccccagggaagcttctctggaagacctggtgctggtccgctctcccgggacctcattttccttatgtggacaacgggggcggggtcacagcagcccctcgggcttatagccgggttgttctttccttaaatctcctccctctgccaaaataaaaaaccccacagggcaaggcgcggtggctcacgcctgtaatcccagcactttgggaggccgaggcaggtggatcacctgaggtcaggagttcgagaccagccttaccaatttggtgaaaccccgtctctactaaaaatacaaaaattagctggacgtggtggccggcgcctgtaatcccagctactcggtaggctgagataggagaattgcttggacccgggaggctaaggtcagtgagccgagatcgtgccactgcactccagcctgggcgacagagggagactccgtctcaaaaaaaagaaaaaaaaaaaaaaacccacagcgtcccggaggggcctgaggagttgtgaggggccgcctccgcctccagcatctggcatctggaggaggaggctgaggctgaggtgagggtgagggtgggtgacccgcacctgtccaggcccaggttgcctgctcccagcttgggctgggcagtggggcagggccatgatcccgccagtgctgtggttagccctacacctggcctggctgaggacagcgaacctggcaggtccaacctgggccctcccagcctaggatctccaaggcctcgtctcagtcaccatcagctgctctagggtgcagtggggcccaaggaggattgggcctgatctctgccccccagagcccatggacccaggactgggcccaccaggcgtgtcgcaggcatagggtcagtggcttctcaacagctgctggccccggcgcccctcaccaccccacctccactggtcagaaccaccacactgccagagactgggtttccctgcagttctgaccagtggggatggggtgaggtggaagggacattgcttggccgggcacggtggctcacacctgtaatcccagcactttgggaggccaaggcaggtggatcacttgaggtcaggggctcaagatcagcctggccaacatggtaaaaccccatctctactaaaaatgcaaaaattagccaggcatggtggtttgcacctgtaatcccagctactcgggaggctgaggcaggagaattgctcaaacccaggaggcggaggttgcaatgagccaagattatgccattgcactctagcctgggtgacagagcgagactgtctccaaaacaacaacaaaaaaggcagaggagtggggagtctggatggctccgctggtccagcccacccctcaggggacagactggttgacttgacgggttcactgagagtgctaggaccggccccaggtgtagtgccctccctgcggtgtcctgaggtaaagcctgccactctgagcctgctttctcttgccaggagacaggaccttgtccgctgcagctgggacatggtgtggataaaacctgtcagacagtgggcgtcctcctgccctgaagcctcccctctccctggtagccttcaggccccccagattctggtctctcggcctgctgtctcctttttccttggtaccttggcacctgaactcgcttggagtgtctaaggagctgcctgtgacaccatggggacctctattggtcccagcatcccctgcccagccgtggggggcatcggtgtcagccctgccaaggatcagtcagccaatcaacaaaccgcagggatcacccagctcatggatgtgggtgccgggaggcagggagggccacacaatgaagagatgtgtgtggtcctccatgctcagagatcctcatgcccctctcccagggatgggagttcccctccccatcaggggtagccctagggcccccagccccactctcactagggccagcctctctgtgaacccctggactcacatcacgtgtgcggggcccagctttgaggtggaagaccaaaccttggcattgcttctgtggaagctcaggaaatgcccacgatatggcctgaccaccccattcacacgaggatggagggagcaccctggtcacctgggggttgtggttagagtgccctccagccgagcctgcagcccagaccgagctagactggaaggggtagaagggcattcaggtagggacacagcctgggcaaaggggccctgacctttggcagctgcgggaagatgagcccacctgaaagggaggctgcattgagtgcagtcaggacctgggctgtagggctcagcctctagacagcaggagcacagaagggcgtggcggggtctcctgcccggccataataaacaggcccaagacttgttcacacaggtcccaggaatatgctgggtttgccttacgtataatttgtgattcatacctctcagtcttccagaaagatgcagtctacagaaattcagaaacaatcaatttgtaagaatagacatagataattttgaacaaccaagattagtgggagataggcatttacccaattctaggacattaatgattagtaatcaggcatcagacatagctgtggtcagccatggtggctcacacctgaaataccagcactttgggaggccaagacagaaggctcccttgagttcaggagttctagaccagcctgggcaacagagtgaaaccctgtgtctacaaaaaataaaaataaaataaaataaacaaattagcctgtggtcccagctacctaccagggagcctgaggtggaaggatcgcttacgcccgaggtcgaggctgcagtgagcagtgattgcaccactgcactccagcctgagtgacagagtgaggccccgtattaaaaaaaaaccccaaaaacttagctatgagtttcctggcagtcgaggcatgaagggaatgagaatggactatggaacttcactgtgtgatcacagcggagtatatcaggcagccaggaggccctcacttatatacccaagcctcaggcagcaggcatgttctgtggcggcctctggaaacaggccatcagggccgggaggacagagatggctgtgagctgggcctgcaccctcagggccctgcctgttgagtggctccagggtgtcttgccctctctgggcctctgggccaaggctaacccaactctctgggtcacaggggctcaagacctcagtggcaggtcatgaggaaggctgccctgccagcctcaccctggctccccacccactgcctgcttctttttttttttttttttttttgagatggagtctcgctctgtcacccagtctggagtgcagtggcgcgatctcggctcactgcaagctccgcctcctgggttcacgccattctcctgcctcagcctcctgagtagctgggactacaggcgcccgccaccacgctgggctagtttttttttttttgtatttttagtagagacggggtttcagcatgttagccaggatagtctcgatctcctgacctcgtgatccgcccgcctcggcctcccaaagtgctgggattacaggcgtgagccaccgtacccagccctgcctgcttcttaagtggcccaggaggacagggagtgagcttgtctctccccactgcagggtcctgagggctggggactgtgctgacactggtctctcccctgcctaggcatatcctgttcctagtgcttggaacacccttcccaccctcacatgcctggcaaattgttcttcacctctaggttcacatgtcgcctccttcagctttaaattcctacacgaggccaggcgcagtggctcacgcctgtaatcccagcactttgggaggctgagacgagcagatcacgaggtcaagagatcgagaccatcctggccaacatggtgaaaccccctctctactaaaaacacaaaaagttagctgagcatggtgtcatgtgcctgtaatccagctactcaggaggctgaggcaggagaatcgcttgaacccgggaggtggaggttgcagtgagccaagattgagccactgcacttcagcctgagagacagagtgagactccgtctcaaaaataaaataaaataaattcctacacgaaggctggggctggctccgagtgagcgggcctggggtatttgtgggataatgtaacttgggagtgtctaagtaggaaaaaactttaggttcttcagtcccattgtgcatggggaaacagaggccctgtgctggtaagtaatggggcagaagccagggtggctgcctcagttggagggaaagcggcaccaagattcacaggacagctctggggtcctggtcgcagtccctgccgtgccgccttctcactcagtgaccctgagcaagctgcttgccacgagatgtcggctccgtggcagtggatagcttcagccgtgggaagtccttggcaatcccctggctcgcggctggtgctcagctgggttcgctctgactagcactgcaccttggtcaccacctcgactgccacacaccctcccccagtggagacagagccaggggtctctcagcttccccaaccctggctccccattgtccagcctcagggatttggagactgggacaaactagccatgcgggggaaaggtgttccagaggagggaacacagtgagccaacaagaggatgggatggggcagggcctgttccaggaacaggctggggtcactctcccttctccagagtccaaggcacatgggtggtgggagaagagataggagaggctggcgaaaaccagcccgcaaggccctaaatgcctgactaagaagcttcagtctttcactgaagttttggagctaggttgggtgcagtcagatagcttgggggctgggccggagcatctggtggagagtgagacaccggtgtgagctgcagccctcgctgtgggtcccagcacccaggactgcacccagcccaggactgcagcaagcaggcacaggatgcgtggctgactgaggcctgtactccgactggagtcacctaggagattggctgagatgacctccagaagggccttgccccaggccggaccccaaggggaagctggctctatgtctttggacgagttaggaactcattgggggtggctgcggttttatttggggattcagctgtgccctgcacaccagctgctgagcaatgtctccaggaagccacagctgccctctgggaggcagggggccaggtgcagtagaggagatgccccagcggctcatgcaggagctcactcagacgccagaaccccagccaaggaggcaccccagacccaggcccaccagggccagtgtccccactccacgacaggggcactgcagccggggtggacacccagccttgctgctcactagtcacgtggtctgggcaagtctcttcctcttccctgagtgaggtgaggcaggatgggctaggatatgtggtggtaacaaacaactccagtctctttttttataatttcctacagacttttttttgttcttgttgaggcagagtatcgctcaattgctaaggctggagcacagtggtgctatctcagctcactgcaacccccactccccaggttcaagttattctcttgcctcagcctcccaagtagctgggattacaggcgtgcaccaccaaacctggctaatttttgtacttttagtagagatggggtttcatcatattggccaggctggtctcgaactcctgacctcaagtgatccacccgcctcggcctcccaaagtgttgggattacaggcatgagccaccgcacccggccaacctgtagattttttgagataaaacagctttattgagatctaattcacatatcacacaattcattttaaagcgtgcagctctctgtggtggatggtatattcgcagagttgtgcaaccatcaccacaatcaattttagaacattttcgaggccgggcgcggtggctcacgcctgtaatcctagcactttgggaggccaaggcgggcagatcacctgaagtcaggagtttgagaccagcctgggcaacatggtgaaacccccctctactaaaaatacaaaaattagctgggcatggtggagggcgcctgtaatcccagctactctggaggctgaggcaggagaatcgcttgaacccaggaggcagaggttgcagtgagccgagattgcaccacggcactccagcctgggcgacagagtgagactctgtctcagaaaaaaaaaaaaaaaaaaaagaacattttaatcaccctccaaacacaccatgtacccattagtaaccactctccatttacctgctctgcccagcccctggcaaccactcacacactttccatctctatgggtttgcgtgttctggacatttcatataaatgaaaccatatgacgtcgccttttgtgactgacttctttcacttagcaaaactttttaaaaatagcttttattggctgggtgcagttgtttgtgcctgtaatcccagcactttgggaggccgaggcgggccgatcacgaggtcaggagatccagaacatcctggccaacatgatgaaaccccgtctctactaaaagtacaaaaattatccgggcgtggtggtgcatgcctgtaatcccagctactcaggaggctgaggaaggagaattgcttgaaccagggagttggaggttgcagtgagccaagagcccaccactgcactccagcctagagacagagcgagactccgtctcaaagaaaaagaaagctggctgggcgcggtggttcacgcctgtaatcccagcactttggtaggccgaggcgggtggatcacaaggtcaggagatcaagaccatcctggctaacatggtgaaaccccgtctctaccaaaatacaaaaaattatccaggcgtggtggcgggtgcctgtagtcccagctatttgggaggctgaggcgggagaatagtgtgaacccgggaggcggagtttgtagtgagcccagattgcaccagcctggggacagagtgagactccgtctcaaaaaaaaaagaaagctttttttttcagagctgcctgaggttcacggccaaattaagcagaaggtacagagagttcccatgtacctctgcccccacacatgcacagcctccctcacaatcaacatcccccgctggagccgcacatttgttacaactgaggaacctacagggccacatcatcaccggaagtccagggtttccatgagggttccctcttcctgccggatgcttcacgcgttcgggcgaatgtataatgacttgtctccaccattagggttttatgcagaatagtttttgttttgttttgttttgtttttgagacggagtctcgctctgtcgcccaggctggagtgcagtggcacaatcatggctcactgcaacctccgcctcctgggttcaagcgatcctcctgcctcagcctcctgagtagctgggactacaggggtgcgcccccacatctggctaatttttgtatttttagcagagatggggtttcgccatgttggccaggctggtctcaaactcctgagctcaagtgatccacccgcctcggcctcccaaagtgctgggattacaggcataagccaccgcacctggcctagagttatttctctatttgactactaaaggacatcttggttgcttccaggttttggcagttatgaatagacgtgctttggttgtgtgaacataaatatttcactcctttgggtgaataccaaggagcaccgttgctagactacatggtaagagtatgtttagttttttgtttgtttgtttgtttgtttattttgagacggagtcttgctctgtcaccctggctggagggcggtggtgtgatcttggctccctgcaacctccgcctcccaggttcaagcaattctcctgcctcagcctcatgagtagctgggattacaggtgccggccactagacctggctaatttttgtatttttagtagagacacggtttcaccatgttggtcaggctggtctcaaactcctgagctcgtgatctgcctgccttggcctcccaaagtgctgggattacaggcgtgagccaccgtgcccagtgagagtatgtttagttctgtaagaaactgccaaactgtcttcaagagtggctggaccattttgcattcccaccagcagggaatgagagttcctgttgctccacttccttgtcagcatttggtgttgtcaatgttctgaattttggccactctaataggtgtgtggtgttacagttgttttaatttgcatttccctgatgacatataatgtggaacgtctttttgtttgcttgtatgcccacctgtgtatcttttcttgagaaatctgttaaggtttttggtccatttctcaatcaagttatttgttttctttttttcttttttcaagatggagtctcactttatctcacccaggctggagtgcactggtatcatcttggctcactgcagcctctgcctcccaggttcaagcgattttcctctcagcctcccaaatagctgagactacaggcatgtgctaccacgcacagctaattttgtatttttagtagagagagtttcaccatgttgaccaggatggtctggatctcctgaccttgtaatccgcttgccttggcctcccaaagtgctgggattacacacatgagccaccgcaccccgcctatgttgttgtttattattttactttatttcttatagagatagggtcttgcctcattgcccaggccagtctcaaactcctggcctcaagtgatcctcccctctcagcctcccaaagtgttgagattacaggcatgagccaccatgtctgggtgtgtttttattttcatttgtctctaaacattttctaatgtcccttgttatttcttctttgatgtatgttgtttaatttccagagttttgtaagttttccagttttccttctgataatgatttccttccttccttccttccttccatcctttttttaacagtcttgctctttcgcccaggctggaatgcagtggtgtgatctcagctcactgcaacttctgcctcccaggctcaagcaattctcctgcttcagcctcccaagtagctgggaccacaggtgcgtgccaccatgcctggctaatttttttttttttttttgagatggagtctcgctctgttgcccaggctggagtggagtggcacaatctcagctcactgcaacttctgcctcccgggttcaagtgattctcctgcctcagactcccaagtagctgggattacaggtgcccaccaccacacccagctaatgttttgtgcttttagtagagatggggttttaccatgttggccaggctcgtctccaactcctgacctcgtgatctgcccacctcggcctcccaaagggctgggattacaggcgtgagcctaatttttgtatttttattagagatggggtttgccatgttggccgggctcaaactcctagccccagatgattgggcacagtggctcacacctgtaatcccagcactttgggaggccgaggtgggtggatctcctgaggtcaggagtttgagatcagtctagccaacatggcaaaaccccatctctactaaaaataggaaagttagccaagcttggtggtgggtgcctgtaatcccagctacttggtaggctgaggcaggagaatagcttgaacacgggggagggcggaggttgcagtgagccgagattgcaccacttcactccagcctgggcaaaagagcaagcctccgtctcaaaaaaaaaaaaaaagatagtgagtgagttctaatgagaggtgacggtttcacaaggggctcttccccctttgctcctcactcctctctctcttgccgccatgtgagaaggtccaagcttccttcccctttgccttccactatgactgtaagtttcctgtggcttcccagccaggcggaactgtgaatcaattacacttctttcctttataaattacccagtctcaggtatttctttatagcagtgagaatggactaatacacccgtcatccatctctggtcccatctggccttcagacaattggatggtgccctctcccgaccctgtatcgaaggtagatagatcttccccactcagtccactgactcactaccaacctcctctagtttctggggaaatactatcacagacagacccagaaatgatactttatcagctatttagaaatcccttaatccagtcaaattgacacctaaaaatagtcatcacagtccataaatgtatagaattgttatattttcttgcggtgttaaaccttttgttactatataatgtcctatgtctcttgtgactttttaaaaattttttgttttgttttgtttttgagatacagtttcccgctctgttgcctacgctggagtgcagaggtgtgaccacagctcactgtagccttgacctcccaggctcaaatgatcatccacctaggcccctcaagtaggtggggcctgtgccaccaagcctggctaattttttttttgagatggagtctcaccctgttgcccaggctggagtgcagtgttgagatctcagctcactgcaaactccgcctcccaggttcaagcgattctcctgccgcagcctcttgagtagctgggattataggcgcccatcaccacgcccagctaatttttatatttgtaatagagacggggtttcaccatgttaaccaggctggtctcaaattcctggcctcaagtgatccacccgccttggcctcccaaagttctgggattacaggcatgagccactatgcccagccccactgtcctttcttcaagttcactgattcttctgcctcctcgaatctaccttcgaatccttttagcgaaattttctttttttgttgttttttttcttttcttttttgagacagagtctcgctctgttgcccaggctggagtgcagtgggtgatctcggctcactgcaagctccacctccagggttcatgccattctcctgtctcagcctcccaagtagctgggactacaggcgcctgccaccacgccaggctaattttctttttttttgtatttttaatagagacagggtttcactgtgttagccaagatggtctcaatttcctgacctcgtgatccgcctgcctcggcctcccaaagtgctgggattacaggcgtgagccactgtgcccagcctgtttgttttttttttttcttatgagacagggttccctctgtcacccaggctagggtgcagtgacgtgatcatagctcactgctgcctcaaattcctggactccagtgattttcctacctcagccttctgagaagctgggattacagctgtgtaccaccatgtacagctaatttgtaaatttatttatttttttcttttttgggacagggtttggtgggtttggctctattgcccaggctggagtgcagtggcgcaatctcagctcactgcaacccctgttttctgggctcaagccaccatctcacctcagtctctcaagtagctcgaactcctgacctcgtgatctgcctgcctcggcctcccaaagtgctgggattacaggcatgagccacttcgcccggccgattcttgtctttctccatggttttttgtttttgtttttgtttttttgttttttgtttttttgagatggagtttcactcttgttgcccaggctggagtgcagtggcatgatctcagctcaccacagcctccgcctcccgggttcaagccattctcctgcctcagcctcccaagtagctgggattacaggcatgcgccaccacatctggctaattttgtatttttagtagagatggggtttctccacgttggccaggctggtctcaaactcccgacctcaggtgatcctgcagatccgcccacctcagcctcccacagtgctgagattacaggcgtgagccacccgacgggctccatggagttttttgttattgtttttgtttgtttgcatttgtgtttattgtttttgtaagctgtctctgtgccaaagatcagcctgaaataccatcttaatgaaccctctagcttttctgagtctgtgcctttctctggccatgcactgcgcagtcactttctaattttccttgtatgtgcagtttttttttgagtttctaatcttttttttttgttgttttggagacaaggtctcgctttgtgtcccaggctggagtgcagtggcgcaatctcggttcactgcaacctccacctcccaggttgcagcaattctcctgcctcaccctctctagtaactgggattacaggcgcctaccaccactcctggctaatttttgtatttttagtagagacgggggtttcaccatgttagccaggaggctgttgaactcctggtctcaggtgatccatctcccttggcctcccaaagtgctggtattataggtgtgagtcatagtgcctggccgaatgttctgatctttaatgtctggctcccaaaaaggaaaaaaaagtagtgggggcagggcactggccctttaaatcacctggtggtggcttgagttggaaggggaggagcctaccccagttggggaggagcacaacctccgtggcttcttgcctcttcctctgcacctccaggatctgaagcagtgtttccggaaagtctctcaaaccctgtttgtcctctcctctcataccaccaccacaatcatcaacacagaagaaagcttctgtggccaaatttgtggagttttccccatacaccaagcagaagagccagttgagcgtcccctagtccagttctgaggctaactggagatagcatcagatcccatggagtgagggcgcactccccaagcctcccccgtcacagccccacacaccagtcccacgttggggcccctggaacttgtgacctacaagcttcaagttggggttcccacatccccctctttgggttctgttaatttactggggcagctcacagaacacgaagacacacttccttacatttactggttcattgtaatggatacagatggagacatctgtggtgttatatatatattttgggtttcatccttggttcctggctcttagttcccatagcccttgttacagtctttggatagaatgttgggtgtggccaggcgcagtggctcatgcctgtaattccagcactttgggaagcctaggctggtggattgcttgacctcaggagttcgagacagcctgggcaacttggaaaaacacggtctctacaaaaaatacaaaaactggcacggcgtggtggtgcactcctctaatcccagctactcgggaggccgaggctggaggatcacttgagtctgggaggtggaggcttcagtgagctgagatcgagccactacactccagcccgggcgatacagccagaccctgtctcaaaaataaaagaatgggccaggcgtggtggctcatgcctgtaatcccagcactttgggaggccgaggcaggcggatcattatctaaggtcaggagttcaagagcagcctggccaacacggtgaaaccccatctctactaaaaacacaaaattagtcaggcatggtggcgtgtgcctgtactcccagctactggggaggctgaggcagaagaatcacttgaacccaggaggcagaggttgcagtgagccgagatcgggccatgccattggactccagcctgggcagcagagtgagactctgtctcaaaaaaaaaaaaaaaagactgttgagtgtgttaggtctcagagtcaagcctcatacatattacaaaggaggatacagataaagagagctatagctatagaactataaatacagctatagggaacacgtatggcacttccatgccctaccccaggggttgaagttctgtgaatcttgtccttagggtttttttaattttaatttttatttttttttgagacggagtctcactctgtcgcccaggctggagtgcaatggtgcgatcttggctcactgcaacctctgcctccctgtttcaagcgattctcctgcctcagcctcctgagtagctggcactataggcgcacaccactatgcccagctaattttttttgtatttttagtagagacggggtttcaccatgttggccaggctggtctcgaactcctgacctggtgatccgcccacctctgcctcccaaagtgctgggattacaggcatgagccaccgcgcctggccgtttgtttttgagacacggtctggctctgtcacccatagtggataacagtggcccgatctcggcttactgcaacctcagcctcccaggctcaagcgattctcctgcctcagccacctgagtagctgggattataggtgcacaccaccacgcccctcttatttttttttttttttttgagacggagtctcgctctgtcacccaggctggagcgcaatggcgcgatctcggctcactgcaacctccacctcctgggttcaagagattctccggcctcagcctcccgagtagctgggactacaggtgtgcaccaccatgcccagctaatttttgtatttttagtagagacggggtttcaccattttggccaggatggtttcgatctcttgacctcgtgacgtgcccaccttggcctcccaaagtgctgggattacaagcgtgagccatcatgccccgccttatttttgtatttttagtagagacaaggttttggtatgttagccaggctcctggcctcaagtgatctgccccacctggcctcccaaagtgttagcatatggaagcttcagagttcagcattccttcccccagggtatagggcctctctggggagggtccaaagcctcacaatgagaaaggtggggaggattaaagtcctgccttggggcagatgaaaggagggaaggagaaggtcagaggtctgtccttgaggctgaacactcccagcgttgtatgaaaagactggactttgcagtgtctcatgcttgtaaccctagcactgagggagaatccctcagcccagcagttcgagaccagcctaggcaagatagggagatctcatctcaaatttaaaataaataaataaataaataaataaataaataaataaataaaaggccagtctcagtagctcacggcctgtaatcccaacgctttgagacaacgagtcaggtggatcacttgaatcccggaatcccggaattcaagaccagcctgggcaataaagtgagaccctgtagctacaaaaaatacaaacagtagccaggtgtggtggcatgtacctgtagtttcagctactcaggaggctgaggtgggaggatcaatcgcttgagcctgggaggcagagattgcagtgacccattctgcgactgcactccagcctgttggacagagccagactctgtctcaaaaaaatttgaaaagagactataacaaggtctttaggagttatcaaccaggatctgtgcacaaatatatatcctaaccccacaggcagcagtcagttatcacagcacagatgcctgttatctggaggacaggctgcatttgcccactctggctcctgcaagctgtgtgcaagccggtccaggaccacctgcatctactgcctgctttgcaggctgggctgggaaatgggtagctgccaaactgctaagagctgaaattgagcaaaattaactgcactttaccatccaagccttcccctggaagttacaagccttcagtagactccagagtttcaaaatagtcacatcaggcagattctgccagtgtaattgtttaggcaggaagaccatttcctgatgtttccttctctgccatcttgatattatcttttgcagagcagtttttattgattgattgattgatttgcgggggttatttttaatggaggccagcttagcaattatattttttagcataatgttttcaagatttatccatattgcccttcattacttttcatagctgaatagtgttccaattgtatccatataccacattttgtttaatcattcatcagctgatggatcataagttgtttctactttttggctgttatgaatgcagctatgaacatttgtgtatatatttttgtgtgaattgtgggcatgtgttttcttgttttatttatttatttatttatttatttatttatttatttttgagacggggtctcactctgccgcccaggctggagtacagtggcgtcatctcagctcactgcaacctccacctcccgggttcaagtgattccccctcctcagcctcccgagtagctgggcgggcgcgtgccaccatgcccggctaatgttttttgtatttttttttttgagagagtttcgcttttgctcctaggttacagtgcagtggcgtgatctcagctcgctgcaacctctaccttctggtttcaagtgattctcctgcctcagcctcctgagtagctgggattataggcacccaccaccatgcccagataatttttgtattttttagtagagacggggtttcaccgcattggccaggctggtctcgaactcctgacctcgtgatctgcccgcctcagcctcccaaagtgctgggattacaggcgtgagccactgtgctcggccttgttttttgtatttttagtagagacggggcttcaccatgttagccaggatggtctcgatctcctgaccttgtgatccacccctcggtctcccaaagtgctgggattacaggcgtgagccactgtgcctggccagtttgtttttgtctgtttgttttgagacaaggtctcactgttaccgaggctggagtgcagtggtgtgatcatggcaagctacagcctcagcttccttgattcagacaatcctcccacctcagcctcctgctggtctggaactcctgggctcaagtgatctcacctcaacctcccaaagtgctaggattacaggagaggagtgaaccactgtgcccagactttttttttttttttttttttgagacacagtctcactctgtcacccaggctgtagtgcggggacacggtcacagctcactgcagccctgcctcccaggctcaagcattcctcccacctcagccatctgagtagctggactacaggcacagcaaccatgcccagggaatttttgtgttttttgtagagatgggggtcttgccatgtcacccaggctggtcttgaactcctgagctcaagataacctcccatcttggcctcccaaagtgctaggattacaggtgtcagccaccacagctggctgggcatatgttttattatttatttatttatttatttatttatgagacggagtctcgctctgttagcccaggctggagtgcagtggcccgatcttggctcactgcaagctccgcctcccgggttcacgccattctcctgcctcagcctccccagtagctgggactacaggcgcccgccatcacgtccggctaatttttttgtatttttagtagagacagggtttcaccgtgttagccaggatggtttcgatctcctgacctcatgatccgcctgcctcggactcccaaagtgctgggattacaggcatgagccactgcgcccggctgacccaatatttcttatcgtctgtctttttgctaatagccatcctagtgggtgtgaagtggtatctcattgtggttttatttgcatttctgtgatgactaataatggtgaatatcttttgatgtgtttattagccatttgtatatcttctttggagaatgtcaatttggatcctctgctcttttttttttttcaattgactttatttttagagcagttttaggttcacagcaaaattaagtggagggtacagagagctcccgtccaccctcctgtgctcattttgtaatggtgcaacagcacaaaagtctggtcatggatgctagcttcatgcccatcacaggtggcagtgagtgctcctgctccaaacgtcctcactccgggacacacgctgatgaagtttctcttctatggcatggggaagagaaagaggaagtggcaggttccccactgactatttaagccttcagccagagataacaggtcacctctactcacattttagtcgcaaagcaagtcattcagcaattcctaactttaagggggtgtgaaattctcccgtgatcctggaggagagggtctgaatatatgtggccacccctaaagactcacgggagttaaataaggttcttttgtgcaggacttgtcactgcatttcctgggccacctggcaggtggcaggtggagtagcgccgacatacttgactggggaacccttctcttttttttctttctttttttttttgagatggagtatcgctctgtcacctaggctggagtgcagtggcgcgatctcggctcactgcacctctgccttctgggttcaagcgattctcctgcctcggcctcctgagtagctgggattacaggcgcgcgccaccatgcccggctaattttttgtatttttagtagagatggggtttcaccgtgttagcccagatggtcttcattgcctgacctcatgatccgcttgcctcggtttcccaaagtgctgggattaccggcgtgagccaccgcgcccagcctgggggacccttttctcctagagcatctcatgggacatgtgttctctggaatcccatttgggaaccactgtcttggctggtggctacttcctaaaggaggggttgacaaactttctggaacggcccagtaagtaaatattctaggtttttcagaccatatggaccaattactcgattctgctgttgtagtgcaagagccgccgtatgtaatatgtaaatgaatgggtgtgcctgtgttccaataacgttttatttatagacactaaaatgtgaatttcatacaatttttctgtgtcacaaaatattatttttcttttgatttttttccaaccatttataaatgtgaaaaaccattcttagctcatggactgtacagaaacaagtggtgggcgagatttgacccacaagctgtgggttgctcaccttgtcctagaggacagagtcccagcacctttgcctggcattcaagccccgtcaccttccccagttccatcatctaccacgtctccgcacagagctcaagcatggccatggcagatgtttttctaggatcaaatcacactctttcactctcggggccttttcccagtctgttctcccttctggaatgtccttccagctcttctgtccccagctttgcttgggaacagtggggcctcccttgatctgggaggaatctggagcttctgacgctggtggctccctcacttcctggcgctgcagagtcagccgccccccgccccgcccccgtgctgtgttctggagctctgtaggtgtgtttgcttccccagccacaccatgagcttctggagggtggggactttggcctcctgagttctgatcccccaggcctgctatcgttggaatgtttccccaaaaaagcacaagttggaaactgaatttccagtggaacagtgttgggtcgtggggcctgatgagaggtggttaggccgtgagggctctgccctcatgaaaaaaaattagctgggcctggtggcgggtgcctgtaatcccagttactctggaggctgaggcaggagaatggcttgaaaccgggaggcggaggttgcagtgagccaagatcgcgccactgcactccaacctgggtaacaagagcgaaactccatctcgaaaaaaatgaaaaaattaaataaaataaatttatttctgttctttattaattgcccatctcaggtattctgttacagcaacacaccattgactcagacagaaaattggtatggagaactggggctgctgctgtcacaaacacctgaatatgtggaaaggctttggaactgggtgatgggttaagcctggaagaattcggaggagcaggctagaaaccgccgacattgccataaagggagcattcggaggattctggtgagggctcagaagagaacagctacagggagagtggaaaacttcttagagattgcttaagtgataatgaccagaatgctggcgggaatgtggacagtggagtcttctgacaggtctcagatgaaaatgagaaacaaggtattagatattagaggaggggtcatccttgttattacataaagtggcaacaaacttggccatattttgtctatgcctgatgattttatgaaaggcagaattatttttcctttttttttttttttttgagatagggtctcgctccattgcccaggctggagtgcagtggtgcgatcatggctcactgcattcttgacctccctggttcaggtgatcctcccacctcagcctcccgagtagctgggactacaggtacacaccaccatgcccagctaatttttgtatcgctttagagactgggttctccctatgttgcccaggctggtctcaaacgcctgggctcaaacaatcctcccacctaagcctcccaaagtgctgggattataagcatgagtcaccaggcccacccagaaggcagaattgaagagccttgaactgaaatctctaagcagcaaagcactgaaagagacacttggcttcttttaactgtggacagcaaaattagagaaaagagaaaggatttttttttttttttttttttgagacagagtttcgcttttgttgcccaggctggagtgcgatggcgagatctcagctcacggcaacctctgcctcccgggttcaagcaattcccagcctcagcctcccgagtagctgggattacaggcgcgtgccaccacgcccggctaattttgtatttttagtagagatggggtttctccacgttggtcaggctggtcttgaactcccgacctcaggtgatccacctgcctcggcctcccaaagtgctgggattacaggcgtgagccactgcgcccagcccgattttttttttttttgacagggttttgttcttgtcgcccacattggagtgcagtggcatgatcttggcacactgcaacatctgcctcttgggttcaagcgattctcctgcctcagcctcctgagtagctgggattacaggcatgtgccaccacgtcaggctaattttttgtatttttagtatagatggtgtttctccatgttggtcaggctggtctcgaactcccgacctcaggtgatccacctgcatcggcctcccaaagtgttgggattacaggcgtgagccaccctgcccagctgaaaaatgatttaaagatgaaattataatgaacagggaagccaaatggggagatttggaaaatttgcagcctggccatataaagcatgaaaggcatgtttaggagagcaaatcaaggctgtggccaagccgccactttcgggttttttttttgagatggagtctcactctgtcgcccaggctggagtacagtggcatattctcgggccctgcaacctccacctcttgggttcaagcaattctcctgcctcagcctcccgagtagctgggactataggaccatgccaccatgcctggctaactttttgtatttttagtagagatggggtttcactatgttagccaggatggtctccatctcttgacctcgtgatctggttgtctcggcctcccaggctggcccgggtgccgctcgactcactgctctggaaagtacaacctgtaaaccttagtggcaaccatgtgctgctaattctgcaggtgcagattgcaagagctgcggggccatggtctcctccaccgagatttcaaaggatgttacctacagcctgggggcccaggcagagactttttgttgaggtggagccactgcagagaacccctaccagggcagtgccttgtggagatggaggacagtgaggctgtccccaagacaagaactgtaggctgggcccggtggctcatgcctgtaatcccaacactttgggcagaagaggcgggccgatggtgtgagctcacgagtttgagaccagcctgggcagcatggcaaaagctagtctctacaaaaaaaatacaaaaaattagctgggcatggtggcaggcacctgtaatcccaactactgaggaggctgaggtgggagaggattccttgagcctgggaggcagaggctgcagtgagccgtgatcatgccattgcactctagcctaggcaacaggagtgaaaccctgcctaaaaaaaaaaaaaaaaaaaaaagatttaatgctgtctgcctactcggctttggatttacttaggaccagttacttcttctttctttcctgtttctcccttttggaatgggaatgtttagcctatgcctgtattttgaaagtagataacttctttgatttcacatgcttgtggctggagagaattgacctcaggatgaacggtgcctgcgtctcacccatctctgatttaggtgagactctgaagtctcaacttttgaattggtgctggaccaagctatgactttggggctattgggatggaatgtattttgaatgtgagaaagacatgaatttggagcatgaattccagggatgaaatgctagggtttgaatacattccccaaaacacatgtgtagaaacttgatccccagtgcagcagtgttaggacatggggcctaatgggaagcgttcagatcaacaggcattgctcttgggaatagtttaatgccatttttgagtgagtgggttttttattgtgggagagggttcatgatataagggcgcattcagtccccttctttctctctctttttctcttctttgtacctttcatgaagtgcaaagtcttaccagatgcaggcccctctattttggactttcagcctccagagcagtgagaaataaatttctgttctttgtaagttacccatatcaggtattcagttacatcagcatataacacactagttcccgtggggtgttgcaaaagtcacttctggctgggtgtggtggctcgtgcctgtgatagcattttgggaggccaaggctgggaggatcacttgagtccaagagtttgagaccatcctgggtaacatagtgagacaagatctttactaaaaatcaaaaaattagctgggagtgatgatgtgcacctgtagtctcagctactcgggaagctgaggagggaggattgcttgagcctgggaggtcgaggttgccaggagccatgatcacgccactgcactccagcctggatgacaaaatgagaccccttctcaaaaataaaaataaaaaataaaatgaaaaagttacttcctctctcgggacctcagtctccacgtctgtcagatgggagcaatgtctcctgccctggatgcctcctgaggttgttctgagggtcgaataaggctggccccaaaggaaccatgaccagcagagagctgaccttggaggataatggctgacaccactggaatttcgttttggggcactgatcctgtgctaggcaccttcagaagtgaccaagagcagaaagcccaggccctgctgagagggggatgcagcgtggtgacataaaatcctgttgctgtgtccccagcacctgggacaaaatgagacttgggggtattggagatgactcgaggaacctagatgaacctcaggtgtctgggagctcccagactgtcaggaagaatgacatcaacaccaaaccctgccctgagttaccgcattgtcctctagggactgggcactgaagcttcctgcagcagacaaaatttgggtctggatctgagccaaaagccccctcatttataaatggggaaacatgacttcacattgatccaaaaataaaaaataaaaataaaaaataaaaacaggccgggcgcagtggctcgtgcctgtaatcccagcactttgggaggctgaggcgggtggatcacctgaggttgggagtttgagaccagcctaaccaacacggagaaaccctgtctctactaaaaatacaaaatcagccaggcatggtggcgcatgcctgtaatcccagctactcagaggctgaggcaggaaaatcgcttgaacctgggaggcggaggttgtggtgagccgggattgcgtcattgcactccagcctgggcaacaagagtgaaactcttgtctccaaaaaaaaaaaaaaaaaaaaaggaaactgaggccctgagaggtccaggggctctcaggcagccagaggcagcacctgacctggcccaggcccccttccccgggagcacagatgccaggatgtgtggattggcgcccttcttgggctgctgggccccgtggtctgctaattagtcacatcatttttggcatcgcacacagcctcgggaactggagaatgtcattgtcaaagtatttttgaatatttgccttctcagcaagaagatgagaaagctgtgaggacactcagtcttccacggggtggatactaaccaaaatcacaagcagcttgagctggaaggacctgggagccgggagagatgccggaggagtcccgcgcgctgcctgtcacagctgtgtgacttcgagacagggctctggccccctgggcctcagtgtcctcccctggaaaatggctcattcatttctcaggtgggcatgaagttgctatgtgccacgcactgctgtaggctctggggagcaaaacaggcaaaaatctctgctctcacaggctgccatccccaggggggccataccatagaaatcaaatcagatacaccaggggtgacacatagaagggagagcccaggggtggggctgtcagggatggccttgctgagaaggtgacatgcgagtgagaatttgaagggggcaggagggagcccaaggggtgtcaggggaagagccctccagcacagggagcggcaggcacaaaggccctgcactcgggcaggactgggttgttccaggagcatcagggaggccaggcgggctagagcaggtggtgactcagggaggcaacatgacaagactgggtcacaaaaggccactggaggcctgcttgctgcttgtggagggccttgtaaactgctggaaagcctttcttttctttctatttttgttgttgttgttgttgacagggtctccctctgtctcccaggctggagtgcagtggctagagctcgctgttacttcaaactcctgggctcaagtgtgtgccaccatgctctgcacccaggctggagtgcaatggcgccatctctgctcactgcaacctccgcctcctgggttcaagcgattctcctgcctcagcctcctgagtagctgggattaaagctgcctgccacctgcacaggtaattttttttgtatttttagtaaagacaggattgcgctatgttggccaggctcgtcttgagcccctgacctcaggtgatctgcccgcctcccaaagtgctgagattacaggcgtgagctgcacctggccttaatttttaaatttaatttaaaatttttgtttttgttgttgttgcagaaatggagtctccctatgttgtgcagacaggtcttgaactcatagcctcaagtgatttgtccgcctcagcctcccaaagtactggacttacaggtgtgagccatgacacccagccaaacctatggtttttttttttggtgttgttgttttgttttttttttttttgagatggagtcttgctctgtcgcctggactggaattcagtggcgcaatatctcggctcactgcaacctccgcctttcaggatcaagcgattctcctgtctctgcctcccgagtagctgggattacaggtgcatgctgccatgcctggctaattttttgtatcttagtagagacggggttttaccgttgttgcccaggctggtcttcaactcctgagctcaggcaatccacccgcctcagcctcccaaagtgagccactgtgcccgaccaagcctatgtttttgttctgggtgacggtctagagcaggaccagacgtgatatggtttctgtattagccgtattcttctgtgccccatgcttcaaagatagaagcaaggaggccaggtgagatgtgaggaggcctgccccatggtggggacagtgggggaacgagagaggactggactccagatgtgtctggaggcagagttgacattgggtgtggaattgtaaaaaataatttgttggccgggtgtggtggctcacgcctgtaatcccaccactttgggaggctgaggcggatggatcatggggtcaggagatcgagaccatcctggctaacatggtgaaaccctgtctctactaaaaatacaaaaaacaagattagccgggtgtggtggcaggcgcctgtagtcccagctactagggaggctgaggcaggagaaatgcgtgaacctgggaggcagaacttgcagtgagccgagattgcaccactgcactccagcctgggcgacagagcgagacttcatctcaacaacaacaacaaaaataataataataataaatttttctttttttttgtcctccctgcctcatccctgtaatttattttattttactttattattttttttgagacagagtttcactcttgttgcccaggctggagtgcaatggcgtgatctcggctcactgcaacctctgcctcccgggttctagcaattctcctgcctcagcctcctgagtagctgggattacaggcatgcgccaccacgcccggctaattttgtatttttagtagagacagggtttctccatgttgaggctggtctcgaactcctgacctcaggtgatccgcccgcctcggcctcccaaagtgctgggattacgggcttgagccactgcgcccggcctataattttttttttttttttttttttaagagacagggttgtcaggcacggtggctcacgcctgtaatcccagcactttgggaggccgaggcaggtggatcacaaggtcaggagttcaagaccagcctggtcaagatggtgaaaccccaactctactaaaaatacaataattagtattgtatttttacatacattttaggggtgaggtggcagacccctgtaatcccaactactcgggaggctgaggcaggagaattgcttgaacccagggggcggaggttgcagtgagccgagattgcaccactgcattccagcctgggtgacagtgagactccgtctcaaaaaaaaaaaaaaagaaaagaaaaaagagagacagggtcttgctgtattgcccaggctggagtgcagtggctattcacaggcacaattccgctactgatcagcctgggagttttgacctgctccatttccgacctggggtggtggttcacccctccttaagcaacatggtggtcccctgctcctcggaagtcaccatattaatgccaaagttagtgcggacaccctctcggcatagcgcactacagcccagaactcctgggctcaagcgatcctcttgcctcagcctcccaaagctgtgtgagccaccacgcctggccatttaaatcattttcaaatgtacaattcagggacatacagtacattcacgatgttgcacaaccatctccacagtgaagttccagcaggaaacccatgtccatgaagcaggcactcccttctcccctccgtgtgctaggccagtgcagggagagacatgatatggggctgccagcaaggcagatgctaggggaaattgagggagatggctggaggagaagagggtcttcggctatcccctgcgtcactcccaggagccccaagatgtgtgcgcagcagaggagactctgagacacattctcctctagaccaggcactgctgaacactggagcagtgcaagcaggacggcaacaccaagaggtcctgggcggggtggggtctggggagggagagagatacaagaaccaagagtcccagggctgcagctgagacagggctggtaatgaggcacagccccggagtgggcaggggtggggacctcccatggatgggatggtcagaaggctcctggaggaggtgacatgtaggtggggtaaggcagaggaagcctgggaagattgggggaaaggtgttcccggcctagaaacagccgaatgccagcaggcctctccgtgtcacacccctgcctcctagggccatccatctctctgtctgtctgttccagggagggttccccggtttgtcttttactgaaagatcctggaggaggggagggctagttgttgctcttatgcaaaggccctgaggcaggtgcagggtgtgaaggggaggggagacatgaggccaggagtcgaagtggagctggaggcagggccatgcctcatgtgcctggggccagctgtggagtgtttggaatttcatccttggcccacaggaaatccccgtagggaccgggggtgggggtggggggtggtgggggttgtaagccaggaaggaagtgatccagcccttgtttcaaagatgatctctggctgtcatgtcattaggggatggcagttggaagggtgtcgtggtatctaagctggtagaggaaagagtacggcccaggtatcccacctcccagggcaccctcgtgtcactcttgacaggcccagtacttgcagtgtcctggggaaaagccccatgtgtctctcatctgtgaacgagaggtgaatggaggcccatctagctgggccaggcctgaccatccgcaggactgaatgccagcaagcctttccacgtcccacccctgcccactagggccatccgtatctgtctgtctgtcccagggagagttccctggtttgtcttttactgaaagatcctgggggacgggagggctagttgtcactcttgtggacaaggggtaggtcctcagccaggaaacctttctttttttttttttgagatggagtcttgctctgtccgccaggctggagtacagtggcacgatctaggctcattgcaacctccccctctcgggttcaagcgattctcctgcctcagcctcctgagtagctgggaagacaggcgcccaccatcacgcctggctaatttttgtatttttagtagagacggggctttaccatgttggccaggctgaccccgaactcctgacctcaactgatccgcccgactcggcctcccaaaatgctaggattacaggtgtaagccactgtgcccagcccaggaaaccactcttggaaggcagtttctagacagagaaaagaacacccttttctctgagggtctaaatgttggtgtagccggtatctgtctgctgcgaggctgctgggaagccagtgctctgctcattatctatatccctgccaatatatctacactcttactggggtctggtttaaatgtcccagcctgaccccaagacaaagtcagcagtggtgactgaagcagcccttgctgcgtggcaggctctgtgctgggcacgggattccagacacacaagagtgagaccctatcttgcagagcttacaattcggggtgggggcaggggggagggaaacacaagtagccctaagcatggctcatgacaactgtcatcagtgccaggagtggggacaccagggcctgggacagggggctgaggcggtcaggaggttcagaagggctcctggagaagggggcctgcgagctgagctgtgaaggccaaggggcatgatctgggtcgcgtggcctggtgggagcctcacccctgggcaatcctgggaagagaggtcccaaaagtggggaatcttgaggccagcttaggcaggaggccctctcctctcctgggcagagacctgcttcagcctaggtctgagctctgcccgagctggtcttcccacatgcctgcggccccttgagggaggcctcacactggtcccaggcctgctgctgccgtccgcccatgcctcacgggaagcttcttagacagagtgaaaagcattcctaagggaatgtaaagaaagggcggggcggctgggcaggaaagggcctggctcacacttcccctcgataatcttatcgcgatgacaagctcccagcctggcctccatttgttcatctggaccgggagggtgccctggctgcaaggctggagttaggattgacataaccgtaaagtgtggacgtgacccaccaggagcatggggatgaggactcctcggggtggccttgtgggaacggggtggggcacccacactggccttggcaccctagcaaaggtgtgggtgtggaaagccaggcctgaagtctcaagtcctggcagggaggccatctcctccaacaccctggcaaatgaaggatgcaaaggaaacgaaatctacagaaacgcggagaccctgaatgatgtgttcttctgtgtcttcttcctcctcattctttctgttatttaattatctctattttccaaacagcttccttgagatataattcatagtacatgccatacaattcacccatgagaagtgtccgatacagcagttttagtatatccagagtcatgcaaccatcaccacaatcaatgttagaacatctcgccgggtgaagtggctcacggttgtaatcccatcactttgggaagctgagggaggtgaatcacgaggtcaagagatcgagaccatcctggccaacatggtgaaaccctgtctctacaaaaaattagctgggcatggtggtgcgcacctgtattcccagctacttgagagactgaggcaggaggatcgcttgaacccaggaagtggaggttgcagtgagtcgagattgcaccctgagatcgcgccactataccccagcctggcgacagggactccgtctcatacaaacaaaaaaacaaaaaacaacaacaaaaagaacatctcattacctcagaaagaaaccctgtacccatttgcagtcactccacattcctctctccctcagcaaccaataatctgctttctgcctgttgtggacatttcatagaaatggaatcatacactatgtggtcttttgtgactagcttcttcatttaacctgttcaggattcatccatgttgtagcatcctttttatggctgacccatattccagtgtggatagaccacactttgtttaaacattcatcagatgagggacattaagtatgaataatactgctatgaacatttgcccacaagtttttgtgtggacatatgttttcagttgttttgggtatatatctctgagtgggatttctgggtcaaatggcaactctatgtttaacttcttgagaaactgccagactattttccaaagcagctgcaccattttacattcccaccagcagtggcttccagcacttgttactgcatctttttgatgagtgctatcctggtgggcaagaagtggcatctctttgtggttttttcatttccctgacggctaacattgagcatctttgcatgagtttcttggccttttttttttttgagacaggagtctcgctctgttacccaggctgcaatggggggcgatattggctcactgcaacctctgcctcccaggttcaagtgatgctcctgcctcagcctccaggtagctgagattacaggcacccaccaccgcgcctggctaatctttttttttttttttttttttgagacggagtctcactctgttgccaggctagagtgctgtggcgtgatctccgctcactgcaacttccgactacctggttcaagagattatcctgcctcagccaccccatagctgggattacaggaatgcaccaccatacccagctaatttttgtattgttagtagagatggggttcaccatgttggccaggatggccttgatcttctgacctcgtgatctgcccgctttggcctcccaaagtgctgggattacaggcgtaagccaccgcatccagccacagctaatcttttttttgtttgtttttttgagacggagtttttgctcgttgcccaggctggagtgcaatggcgcaatctctgctcactgcaacctccgcctcctgtattcatgtgattctcctgcctcagcctcccgagtagctgggattacaggagcctgccaccatctgcagcaaaatttttatctgtaggagagacgcggtttctccatgttggttaggctggtctcgaactcccgacctcaggtgatccatccgcttcagcctcccaaagtgctgggattacaggcgtaagccaccatgctcacccacacaagttttaatttttatgaattccaatttttctcttttgttccttatccttttggcatcgtaatcaagaagactttgcctacctcatggtcacagagatttaggttttcatctgacagttttatagttttacaattaggtcttacaattaggtctacgatttacttgcttagttattaacatattaagtaacaagttctagcagtgggtctaataacttctgtgattttggagacgagtatacgtgctattttgaggctgggcgcggtggctcatgcctgtaatcccagcactttgggaggccaaggtgggcggatcacgacgtcaggagttcgacaccagtctggccaacatggtgaaaccccatctctactaaaaacacaaaaattagctgggcgtggtggtgggtgcctgtgatcccagctactcagagcctgagggaggaaaatagttggaacccgggaggttgcactgagctgagatcatgccactgcactccagcctgggcgacagaacaagactctgtctcaaaaaataaaataaaaataaaataaataaataaatgctattttgagatatttccagtgactgcaatgtgttgagatggaatatcacctacattcataagtgaagaaaatgctggattttggttaaaggttgattttttttttgagacaggggtcttgctggaggcctcaaagtacctgggattataagtgagtgccaccgcacttggtgttaaaggttaatttaaataaagatgtatttaccagctctggttcatggtctccagaattctatccatggattccaggttcagaactcttaggatggctaaaattccagcctgaagtctcagttttccaatagtcctttgggggcttgaaacctcccaggaatggctttagggtgttttcctgacacttcccagccctggcccataccctgccctctgcctggctccattcttgggaaaggaattccttgccaaacagaattttctaacaagcccaaatatagtaataataataattagcagcaggaagaactataaacactggggtaggaaagcctgtacccgtctctccttttcctgatcccttcccttcattcctgaactgaaggagacggagcccctttgggctttgatgactccatcactggggtatgttcatttgatggttgattttgctgtaccaggtacttcctttcccattttctaatcattttataacacatgctgactcttttcccttccctttttctgggaaaatacaatgaatacaaaattataaacactgtatgtttagcatcagaccaagcatgttgcagacacccttgcccctggccgtcccagaatccctggggcaactctggccttggttaagaggctccatagctcctggcttagctgtgccccggctcctcccctcatatcatgcctgatcctaggaagatatttcacttctgggtgcctcagctttctcatctataagggtggggtatgagatggtcatggtcatagtttttgtttttttttagggtggggggacgagatggtcatagggtcacagtttttttttttgtttttgttttatacagacgggatctcgctatgtcaccgggcgccatggctcaagcctgtaatcccagcactttggaagtccgaggcgggcggatcacgaggccaggagttcaagaccagcctggccaatatggtgaaaccccgtctctactaaaaatacaaaaattagccgggtgtagtggcgggtgcctgtaatcttagctactcgggaggctgaggcagaggttgcagtgagcccagatcgtgccactggactccagcctgggcgacagagtgagactctggataaaaaaaaaattaatgaaaggaaaaaggcaaggaggaatcccaacgatgacaggttgaaagctgcagaggagactgatggggagtgacctgtgaggtagcaggaccaggtgaactggaatccccaggtccagataagtgagggtttccaggaggaggagtggtcgactcagctgctgctgagaagctcagcgagaccaagaagtgacccccggattgggcagcggagaggttgtaggttaccttagcagcagttaaggggtggggacacagccctgctggatggggtgatgagaggctgggacgggaaggggtggaggaggtgagtgtagggaagtctacagaaatgtctgaagggagggagaaatggccagaggcaggagagggtttgggggcaggagtcggtccagagtgaggctgatggcacagaaaagcctcgaggggagggcagcgggatggggtcctaggcctgaggaggacgtgagtacccgacagggaagtttgtctgtttgggtactgggagaggagaaagatcctgaaggctttcgtttttctctgaagaatgaggtaaggccacgggctaggagcccaggcagaaggggctgtgggaggtgtaaggagaggggagcaggcatgaggtctcactttcagagtgggagtctcaccgaaaaacatgatagggctgccggctttgtggatgcgttagaagtgtgggatcacaaattcccaatcccagggctgtgtgtggagccctctccccaagcgatgggaaggcgagtgtccttaacgttggggttccctatgctggaaggatggactctattacagtccatcaggccaggaggtaggtactgtttcctgtattttacggttggtaaatctgagagcttcaggccaatacagtatcggtgtagcattagggtcagacaaaatagaacagggcccggcacatattaagtgttaatattcgttggaaaaaaaaaaaaaagaatgcttgtcaagtccactgctgcgcccctactggtagcccagcctggcctcagccttgggggctggtgggtggagagggcggccttgtgtgctctgctatccctattgccttaatgacccagtatcacctttgtgcccttgtaggttgatccttctagtctcgtggcagaactttgtagacaccaagcgagcggggcagcgtgttctggacctcattcctcacacagggctcacctccggatgagtcagaggccttagccggtggcccagccccgggaatgccaccccggttctgtaccctgcccaggccagctgacagggtgtattggggcacacacctgcagcatccagggcactccaaggagagggacgtacttttgaggagagtctaaaagtctaagtcccccacctgaacttggtgggggaagggcttctataccaggagggctcccagccctgtttcttaaaggccatttaggcagaagtgaacgtggtctcttcaataaagttaataatggttcatgctgcagaaaatgttcaagacaaaaccctgcttatttactcaggctttaaaaccataaaactcccaaattctccctgtagctatttatatccagagctagtccccaaattaagctcaggtttgaagtaacttaaaagaaaaatagccttccctgctttaaaaagattttccgtatagacctccactggtctaattacgaagggcgcgtagtttcagggttggctgggggtagggcaccgggacctccaaggcagttacactcctcagcctcctaacagctgtacggctgcccggtggtccctctccaaggcagcggctctcaggctagcctcagcctaccccacccgcccgcaccccgtgttctccctcgtgggggtgccggggggagtagggaggcggggcgggcggcaggtccggaaaagtggctgccctcgccccgaaagaagttgaccctcctcccgtgccgagagcttgggatgaaaatagcttcttcctctttacccttcctggacccccgccccaggacgactgggccccttcattcatctttcagcggccacccaggcggcttgggcgtccccacgccgggactctgtgccccggggacccacggggaccctcccttgggcctctgaagccgcggcgcaccccgcacccaagccaccccgggggccccggcctcccccacccaattagcgggcagcaccgcagacccgagtccccacgcagctcgcgccaggggaggcggccgcctgggaagcccgtcccccgcgccgcggcccccgcccccgccagccccgcgtcccctgggaaaggcgggggcgcagcgagtttcccccaattagtttcctctttgtatggagtcttagcgcgcccgtactcctccgcgcagcggaaagtagtcccggccgggcgctccgcggcttcccagcgccagacacattttactttgagaagtcgacgggactctcagcggggtccttcagatggggggccagaggctgcgggaggcgtgcgcgggcagcaagggcaggggccgcggccaagggtagggggcggggagggccgcgaactcctcgccgctgcctggagagatggatcatggggcgtagggagatggcaaacctcaaaccacgtacggcgggcgatacgcgtcaaccgaacctcgccaacggaagcccggagccgcccctccccgctcccccgccccgccgccccggacggacgggcgcgcggagccaaccccgctgccgctggctgtccaaatcccaccagagccaatgggagcgcgagggggggcggagccatctcgcgtcagttgggctgcgcgcccccctcccccggcgcccctgcaggccccgcccctgcctcctcccctctccgctcgctgctcccggagtagttggtgccagtgaagtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccgccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtaggtggcagccgcccccgcggccccgggccccgcgccccgcgccgcgctgaccgccgtattctgcttcccccgcaggtggcggtggcatgagggtcggaccccagtaccaggcggtggtgcccgacttcgaccccggtgagtagcggccccggccggccggcggcggggatgagcgggagccccgggtccccggcgagcccgagggggcgggagcccgccgacaactttctttttgtgcgttcgccctgccgtccgtggggagaacagcagggcgaggacgaggaggcgcacacgcacacgagtgttctgcaaacgtgcctctgcacccgggggaggccaggtcgcccccagcagggccggcgccgctgcccccttgcgcctccgaggactgcgggtggcgtcggaggtggccacacctggcctgggggcgctgggggtccctgcgtccaggtgagctgcgcctcggccaggggtaagggtggcagtgccggagagttagtgtcctgcgagcgccccggacttaggaggtccccagagacccctttctcggaacccttcccaaaggctgctccccacgcctttgctcctcctctcagcctctgggctcttgctggctcctgactgccctcccatccagaaggcgagtagaagaacgaccccccaaaaccagtcaataaaagaagtgtgttttccagagggcgcctgcctggggaagagagtctcgcgtgtggcagttggattttaggacctatttgtaaatgtgtgtatttccttttttttggaggaagagattgtgaaattgagaagcatcagaagctttagcctaacaaatgcttttcacctacaagaaagccctacaccctagaatggaacacttagttccctggctgctattctgtgtagaagcaaatttaaagtggtacaagaaaaaaaatccgatcagacaaaggaattcgtcagattttaatgcatgagattctagccagtgtctgtatgagactgtctttaaaggttgttggtatggaaaatgtttgaaagaacgtaggatttatttcagaaataaaattcaaaagagcatcttgtaaagctggagttaacaatcctccatggttggagggctttagagctggggttctgtatgtgggttataccactagtttatttgaaaagataaacgcatacatgttttttccttggaaacaagactgcagaaaattgcaatgatctagtccttgaaaaaggcgattgctctcaagctgttattaaggtactaaactgcactttgaagtgaaaatacatagaggtcctaggtgagctcttggacactctggaaataaatgacttcctaaattggccttctaaattttgatttgttgacgtaaatctgttaaatttatttgtctaatactcgcgtttgtgtttcttttaagtccatgttagtgtttttgatagtttcctcttctccccaattcttttttttttttttggtagtcacttctcgtttatgagtgacaggatagaactaggtggccaggctatatctcttgtatgcttggctcctccgttccttggttggccaccaggggaagcatactgttttttggttacagttgaccctgtcttcattttgtaggtcaagtctatctttgctttaaaacacagaacataaagcttgttaccaaattttcctaatgtattatttttaaaaatcgacttccacaaatctttgagtaagttggtaggctttttgatacatttttgttaacataaattttgaaaactttatgtagatgtgttggatgtgactaaggaaaagggcatatttgtcaacaacaggaattagatttctgacattcatcgaaatattgacatcagctctgcattgttagtaatgagtttgacttctttggagttatacttttctttgaaacagcaaatataatattttgaactgtctttgggctttttgttggaatagatatgagcataaacttgctagtgaccagctattctaaaatggaaaacatttatcagattgcagtagctcacacctgtagtcccaacacttggggaggccaaggctggaggatctctggagctcaggagttggagaccagcctgggcaatgtagtcagactctgtctcaacaaaaaataaaaaaattagctgggcatggtggcatgtgcctgtagtttcagctacgggggggtctgaggctggaggatctctgggaagtcaaggctgcagtgagcagtgatctggccattgcactccagcctgggtgacagagtgagaccctgtctcagaaataaaaaggaaaacatctaactgttttgctgcatagtcttgctgccaattggttgagtattgatattaaaatttccaaatttcttttttttttttttgagacggagtcttgctctgtccctcaggctggagtgcgcagtggtgtgatctcagctcactgcaagctccgcctcccaggttcacgccattctcctgcctcagcctccagagtagcagggactacaggcgcccaccaacactcctggctaattttttgtatttttagtggagacggggtttcaccgtgtcagccaggatggtcttgatctcctgacctcgtgatccgcccgtctcggcctctcatagtgctgggattacaggcatgtgccaccgcgcccggccccaaatttctttattttgtgtttgttttaatctggaaaggaatctaactggtgtaaagtaatttcaaaccttgttttgccaacctaagcagggggacacagttttctagatatggcagaaaattgagactttactatttcctagtggttttttatgtgtcttttcatttaacttaaaagcttaaggggaaggaaggcttccattttggaatagaaatgatacaacattttttttttttttaatacggagtttcactcttgttgcccacgctggagtgcaatggcgtgatctgggctcaccgcaacctctgcctcctgggttcaagcaattttcctgcctcatcctcctaagtagctgggattacaggcatgcgccaccatgcctggctaattttttgtatttatagtagagacagggtttctccatgttgatcaggctggtctggaactcctgaacgcaggtgatccacccacctcagccttccaaattactgggattacaggggtgagccaccgtgcccagccaactgatgtttgttttatagcaaaattctttcttagctgtttaagacttaagacaggttctttccatgactgcaatttaagagtagtgaattgagtaataaattaagaattgagagtttgatccttactagtttttatttcctcctcctacttgtttttttcttttttcttttattttttgagaccaagtctcactctgttgcccaggctggagtgcagtggcacgatcttggctcactgcaacctccacctccgaggttcaagtgattctcctgcctcagcctccagagtagctgggattacaggtgcccaccaccacgcccaactaatttttgtgtttttattagagatgcggtttcaccatgttggccaggctggtctcgaactctttgcttcaggtgatctccccgccttgtccttccaaagtgctgggattacaggcgtgaaccactgtgactgcccctccccccgcctttttttttttttttgagacggagtcttgatctgttgcccaggctggagtgcaatggcacaatcttgactcactgcaacctccatctcccaggttcaagtgattctcctgcctcagcctcccaagtagttggaactacaggtgcgtgccaccatgcctggctaatttttgtgtttttagtagagacggggtttcaccatattggccaggctggtcttgaactcctgacctcaggtgatctgcccccctcggcctcccaaagtgctgggattacaggcgtgagccaccatgccctgtccctacctcagttttgagtgtgtctttgttcttctcttttactagaatttgaacagagaggtggacgtgaaacttaacaggcagctttttttcttttctttttttattatagtaaaataagtaactatggtagagatgcatgaatggaggaatttgactttgattttttttttttgagacagagtctcgctctttcacccaggctggagtgcagtggcatgatctcagctcactgcaacctccatctcctgggttcaagcgatcctcctgctgcagcctcctgagtagctgggattacagacgcacaccaccacacccggctagtttttgtagttttagtagagatgaggtttcaccttgttggccaggctggtctcgaactcctgacctcaggtgatccacccaccttggcttcccaaagtgctgggatttcaggcgtgagccactgcgcccgaccttttttttttttttttttttttttttgaaatggagtctttctatgttgcccaggctggagtgcagtggcacaatcagctcacacagcctctgcctcccgggttcaagcagttctcctgcctcagcctcctcagtagccgggattacaggcgtgtgccactatgtctggctaattttggtatttttgcaattttttttttttttgagatggagtttttttctcttgttgctcaggctggggtgcaatggcatgatctcgatctcggctcacctcaacctccacctctcaggttcaagcaattctcctgcctcagcctcccgagtagccgggattacaggcatgggccaccacacccagctaattttgtatttttagtagggatagggtttctccatgttggtcaggctggtcgtgaactcccaacctcaggtgatttgcctgccttggcctcccagagtgctgggattataggcgtgagccactgcgcagccctaattttggtatttttggtagagatgggtttcaccatgttggccaggctggtctcgaactcctgacctcaggtgatccactcacctcggcctcccaaagtgttgggattacaggtgtgagccactgtgcccggcctgatttttttgtcagattttacttatttgcggtatgccagcttgaccctatttaggtttgaaagcaaatggttggagctaagactatctgatatttcctatgcagttcaaaggaagatttaattctgtcatgccttacaaagagtgaatgaggtggatagagcacgttagtcttaaaatcctgattcagttcttttttttttttttttttgagacggtgtctcgctctgttgtccaggctggagtgcagtggtgtaatccgggctcactgcaagctccgcatcctgggttcatgccgttctcctgcctcagcctcccgagtagctgggactacaggcgcctgccaccacgcccggctaatttttttgtattttaagtagagacggggttccaccatgttagccaggatggtctcaatctcctgacctcgtgatccgcccgcctcggcctcccagagtgctgggattacaggcgtgagccgccacgcctggccctgattcagttcttataaaataattaatacctagattagatcggtgtagtgtggcattgcttggtagttagaataccatttgtgtttacactgaaataaaaagttttaccaacttttaaagagttaaaaaaaaaaagagttaaaaacctaagtgcagccctacacttttaacttaggctttgttcttacatgtgttgtccagactgcctttccatgctgtctgccgcagattatgctgagttgtcattggtttcttttaatattcagtagttacagaataatagggtaagaggggggatgcttatctatcctacctctggttggttctttcctacataagcaaagcatcacttattttgaaatgaataatgtttttctttccttttttttccttttttttttgagatagggtcacactctgtcaccagtatagtggtgtgatcatggcggcagtgaacttgaacctcctgggcgcacactatcctcccatccatactttacctcgaaagtagctgggactacagatgtccacgaccatgcctgactagtttttttgtattttttgtagagacaagagttttgccacgtagtccaggctggtctcgaactccttggctcaagccatctgcctgccttggcctcccaaagtgctgggcttacaggtgtgagccaccgtgttcagccattattattactattttttaattttttttattctctttatacacgtccttggtgcttcagaggcgtacattgttaatgatgaatatttttgagatagtggccctttaaaaaagcaacctttattttgaatgtttaatccaatgtatttaatcagatctgaaaatttgtggttgtcattggcttaactgtcacttcagagttgacttctgtcagaaaactgtgttatgttttcatgtggaataggtaattttactgaacagggtgtcttgatatgcctttcatttgttttcactggtgattctatgttctgctttttttatgctttagatcattgtaaaaaaaatatggtgaatgctttgtggttttgttttgttttgttttttttttttgaaacaaggtcttgctctgtcacacaggctagagtgcagtggccctgatgttggctcacttcaacctctgcctcccagactcaagtgatcctcccccctcagcctcatcagttgctgggaatacatgtgcacatcaccacgcttgagcccaggctggtctctaactcttgtgctcaagcagtcttcctgccttggcctcccaaagtgctgggatcacaggcatgtgcctggcaatgctttgtgatttatttatttaattattattattatttttttgagacggagtctcgctctgtcacccaggctggggtgctggagtgcagtggcgcgatctcagctcactacaagctccgcctcccgggttcacgcccttctcctgcctcagcctctctgagtagctgggattacaggcgcccaccaccacgcccggctaattttttatatttttagtagagatggggtttcaccgtggtcttgatctcctgacctcgtgatccgcccacctcggcctcccaaagtgctgggattacaagcgtgagccaccgcgcccagccagtgattgattgattgattttagttttattttttattgtattttgagacagagttttgctcttgtcacccaggctggagagcaatggtgtgaccttggctcactgcaacctctgtctcccaggttcaagtgcttctcctgcctcagcctcccgagtagctaggactacaggtgtgtgccaccatgcccagctaatttttttttttttttttttgaagacggagtctcactctgttccccaggctggagtgcagtggcgtgatctcagctcactgcaagttccgcctcctgggttcacgccattctcctgcctcagcctcccgagtagctgggactacaggtgcccgccaacacgcctggctaattttttgtatttttagtagagatggggtttcaccatgttagccaggatggtctcgatctcctgacctcgtgatctgcccgtcttggcctcccaaagtgctgggattacaggcgtgagccaccgcgcccggctgctaatttttgtattcttagtagagatggtatttcgctggctgggcatggtggctcacacctgtaatcccagcactttgggaggccgaggcaggcggatcacttgaggtcgggagttcaagaccaacctggccaacatgatgaaacccctctctactaaaaacacaaaaattagctgggcgtggtggtgcatgcctgtaatcccagctactcagaaggctgaggcaggagaattgcttgaacccaggctgcaaaggttgcagtgagcgtagatggcaccactgcactccagcctaggtgacaaagtgagactctgtctcaaaaaaaaaagacggggtttcactatggtggccaggctggtttcgaactcttgacctcaggtgattgacccgccttggcctcccaaagtgctgggattacaggcttgagccaccgcacccgaccaaacactgatttaatactaggcaatatttgcttcaggtacagctaaagcctcattcccgccttctttcttcattaattcacagttggtttatattatttctgtgatagtttgcatcttctgagaagcagatgacaagacagaattagatgtgcaagaggttcattagggtatgcttgtgaaggataaagagaggaaggaggtgtaggtggcaagagcctttacactggaagcatgtgtgacacctgtgaaagaagagagggaaggaatgatgattaatgattgatagaggaacctcaaactgcagtgcagcttgcagttcagagaaaatctcagccagagtagattgttagaagagtctgttgggcaggaatggtccttctttgtgaacatctgctgtgttcagtcattggctgggagcagcctagagtagcctagccttggtatgggtgctgtagtagatttctggtagctggggctgtcagttaactacactccttgcaacattttctctcttgaagggaaatctgagtggcacactcaaggctgtcagaattcccatacgtgtttttgtacttaaatacatgtgtgtaattccagcactttgggagggtgaggcgggaggatcacctgagatcaggagttcgagaccagcctggccaacatggcgaaaccccgtctctactaaaaatataaaaattagctgggtgtggtcgcgggtacctgtaatcccagctacttgggaggctgaggcgggagaattgcttgagcccgggaggcggagattgcagtgagccgaggttgtgccactgcactccagactggacgacagagctagactccgtctcaaaaaaaaaaaaaaagtgataatatgttttcttgttattgttagtgtttttgtaaatggaataatctatgctattcatgtacttttatgctttccaaacaagtacatttccactagcaaggtaaacaactttgttttcaccttgtcttcgtcatggtgttagttaggttattaattttttttaaatgctatcctttaatggcttatattagcatttttttcttttcttttcttttctttttttttttttttttttggagatggagtttcgctcttgttttgttccccaggctagaaatgcagtgacgcagtctcctctcactgtaacctccgcctccccggttcaagtgattgtcctgcctcagcctcccgtgtagctaggattacaggcatgtgctaccacgcctggctaattttaaaaaatatttttagtagagaaggggtttcaccatgctggccaggccggttttgaactcctgacctcaagtgatctcccgcatcggcctcccaaagtcctaggattacagacgtgatccactgtgcctggcctcttctttctttttttgtagacttgatatcgttctgcctcttaggctggagtgcagtggcatgatcacagcacactacagcctcagcctccagggctcaagtgatcctcctgtctcagtttcctgagaagctgggactacaggcatgagccagtatgcctgactgatttttgaactttttgtagagacggggttttgccaagttgcccagactggtctccaactcctgggctcaaccagtccttctgctgtgtcctcccaaagtgttgagattacaggcatgagtcactgtgcctgtaattaagttttccaattaatgatgaggttaagtgtcttatgtttttaatttttaatttttaatttttttaagaccttttttttccccttttttgagatgagttcttactcttgtcgcccaggctggagtgcagtggcgtgatcatagcgtactgtagccttgaacttctagggctcaagtgatcttcatacctcagtttctggagtagtttggactacagttgttcaccaccacacccagcaaagaatgtgacaaaaagtactaagtgtgttttagctaagtatcgataagaaaagagtgtctttttatttattttttatttgtttatatgtactttttgagacagggtctggctctgtcatccaggctggagtgcagttgtgtaattttggctccctgcatcctcagcctctcaggctcaagtaatcttcccaccttggcctccggagtagctgggtttataggctcttgccactatgcccagctaatatttgtattttttgtagagatggggtttcaggttttgttggtcttaaccctggcccaggggtgtctgtaaatttttttttcttttttttgccactcagtttcctcctgtgaatgtatctttcttttgctatttttcttttttttcccccttagggtcttgctctgttgcccaggctggagtgcggtggcttaatctcagctcactgcaaccttcatctcctgggctcacatgatcctcccacctcagcttccgaggtagctgggactacaggagtgtgccaccacgcctggctaatttttgtgtttttttgtagagacagggtttcaccatgtttcctaggctgttttgctgtttttctatagggtgttggtttttataggttttggttttttgtatggatttgtgtgagttctttttatttatatatttggatattctttgttagaattgcacatatgttttttgttttttctttaatattatgtgtgttgcggggaggaggattgagtttatttgactaggaagggataaaaatacattcctgactggagactgtactcagagattggtcttggtgtatacccctgatttctaagatgaatgttactgagaattgacaattttttttgttgattgttgtgtttccactaagttattcatctcattttggcctgctattagctagttgacccaaatcacagtgctggatgacttgaaaagctctgatttaatttttgcctagtatatagttatagtagcatataggttaaaggttaaagttacagctttgatcctataatggtcagttagtttcccacgaaaggttaaaatgctatagactaaaactaacagctgtcttagggatttgccactccttataaggcaatgggtagtgtgtggatagggaggtacaacttgtcatcactaacaaaaccctcgaaagaatgatctatccaggttgcttactctgtgccaggctagttttaacacacatcaaatcatttgaccctcacaacagtcatatgatgtaaagttactatctccattttccagatgaggaaacagaggcattgagaggcttagtcttatggttgaacctaataacttgccgtggtaatccagtccgagaggccctcagctgtaagaggcacctttattttatgtttcagtaagaaaggaaaaggatcaacaagatagactgttaattttaagtattataagaattctgatttataagtataatcagaattcaatttagtgtattttagagagggtcagccagaatcctctttaagagaaaacacttaggctgggtgcagttgctcactcctgtaatcccagcactttgggaggctgaggcaggtggatctcccaaggtcaggaattcaagatcagcctggccaaaatggtgaaaccctgtctctactaaaaatacaaaaaattagccaggctataatcccagcattttgggaggctgaggcgcgagaattgcctgaacctgggaggtggagctacagtgagccgagatcgtgccactgcactccagcctgggtgacagagcaatattccatctcaaaaaaaaaaaaaaaaaaaaaaggaaaagaaaaaacacttaggagcaagactttattggatccattgattagttgtttccatgtggccccaggtgttggggaattttatgtttcgggttgccagagccaacttgtagtccagttacattcctcttcttcctggcagtgagaacaccggtgaaatgggaggtggttagcttggttgcctggggacaaattggactgagttgctttattcctgcatgtatgttgaaatagtcatcttcacaacttagaatatagttggagttttttttagaagagccatttattttgatggtgtgactgaaggctatacatacagtcatgtattgcaaaacaaatgtcattttggtcaaggacagtggtcccataagattataatggaactaaaaaatttctgtcgcctagtaacttcaccttgtctatagtgcaacagcgtgtagcattacttaggtgtttgtgtggtgttggtgtaaacaaacctactgcactgccagtcttacaaaatctagcacatggagttatgtatagtacatagtacttggtaatgacaataactgtattactggtttgtggatttactatgctatactttgtatggttattttagagtgtattcctacttataaaaattatcagtttgctgtaaaacagcctcaggcaggtccttcaggaggtattccagaaggaaggcattgttactctagaatatgacacctccatgggtcttattgcctctgaagaccttccagtgggacaaggaaggtatggagttggaagatggtgatattgatgatcctgactgtaggctaggccaatgtgtgtgtctttgtggttttttttgtttttgtttttgaaatggagtctcgctctgttgcacaggctggagtccagtggcatgatctcggctcactgcaacctctgcttccctgcttccagtgattctcctgcctcagcctcgtgaatagctgggattacaggtgcgcgccaccatgcctggctaatttttgtatttttagtagaaatagggtttcatcatattgggcaggctggccttgaactcccgacctcaagtgatctgcctgcttcggcctccgaaagtgctgggattacaggcatgagccaccgtgcccggcctaatttttgtatttttagtagagacggggttttgccatgttggccaggctggtcttgaactcctgacctcaggtgatttgcctgtcttggcctcccacagtgctgggattacaggtgtgagccactgcacctgactgtatttacacccatactctccctgaaggttgtagttcctgccctgctttacttttactggcatagaagctgctgggcttggtgttctgctttcaaacttagcgtggatatagggagttcagcggggaggaagagaagagtaggtgcttaactagttttgatcttactcagtaccagagagtgttctgggagctagtggtgtcatgtatgtctgatttctttgagggtggtagcgtagttttttgaaccaccaaatcaggttttaagttttttttttttttttggaggggagatagggtctcaccctgtcccccaggctggagtgcagtggcgggaacatggcccactgcatgcagccttgacttcttgggcaccagtgatcctcctgcctcagcctcccaggtagctgggattacaggtgtgaggcactgcacctggctgttaagtattatctagtataaactcgtcagagctaaataggggctgaattttctaagaatatgtgcttggtttgggtcttttcttgaataggcttttgtttttgtttttttgatttttttgggttttgtgttagtttttttttttttttttgagacgaagtctcactctgtcgcccaggctggagtgcagtggtgtgatcttagctcactgcagcctctgcctcccggattcaagtggttctcctgcctcagcctcccaagtagctgggattataggcatgctccaccacgtctggctgattttgtatttttagtagagacggggtttttccatgttggtcaggctggtctcgaacttctaaccttaggtgatccgtctgccttggcctcccaaagtgctgggattataggcgtgagccaccgcgcccggctgagtaggcattttttaatggacatttgataaggaccaagtgcaactgtatatcaaatggaaatctagggaaaaattgtcttttaaattgcagttaaaagctgattatccctattgtctcttgctttccttataatgaatttgtataaattggagatgcacatcttgcatagatgtgttttcttttttttatataaagtggtgcaagtcacatcacaaaattgactattttttggccaggtgtggtgactcatgcgtgtaatcccagtgctttgggaagctgaggcaagtgggtcacctgaggtcaggagtttgagaccagccaggccaatatggtgaaaacctgtctctactaaaaatagaaaaaagctagccaggcgtggttgctcatgcctgtaatcccagcactttgagaggctgaggtgggcagatcacgaggtcaggagtttgagaccagcctggccaacatggtaaaaccccatatctactaaaagtataaaaattagccgggtgtggtggcacctgcctttaatcccagctactcaggaggctgaggcaggagaatcgcttgaacccgggaggtggaggctgcagtgagctgagatcgtgccactgcacactagcctgggcaacagagcgagactctgtctcaagaaaaaccacaaagtacaaaaaattagccaggtgtggcggtgcacgcctctaatcccagctacttgggaggctgaggcaggagaattggttgaaccggggaggcagaggttgccatcagccgagatcacgctactgcactcaagcccgggcgaaacagagagactccatctcaaaaaaaaaaacaacaaaattaaccgttttacaatgaacaattcagtggcattcagtgcactcgcattgttgtggagccactgcccttgtctagttccgaaacattttcatcaccctaaaaagaaaatctcacatgtgttagaatgaagaatgagttacttcttattctccattctcagtaccaggcaaccactaacctgctttttgtttctggattacttattctggaactttcacgtaaatgggtatgtgaccttcatgtctggcttctatcacttagtgtaatgttttcaaggttcattcatgttgaagcttgagtcagtattggtactttctgtgcttcattgcttttgttttgtgttgttgttttttttgttttgccttgtttttgttttttgagatggagtcttgctctgtcgtccaggctgaagggcagtggcgtgatctcaactcattgcaacctctgcctccctcgttcaagcgattctcctgcctcagcctcccaagtagctgggattataggtgcgcaccaccatgcctggctgatttttgtatttttagtagaaatggggtttcaccattttggccaggctggtcttgagctcccgacctcaggtgatacacctgtctcggcctcccaaagtgctggggttacaggtgcctggcctaattttaaaattttttttttgtggagagacggggtttgtttatgttggccaggctggtctctaactcctgacctcaagcactcctcctgcctcagcctcccaaaatgctgagcttataggcatgagccactacacctggctcattcatttgttgatggacatttagcttgttgttaccttttgattattgtgaaccgtgctgttatgtacattcatgtacaggtatttatctgttttcatccttttaggggtatatatctattagtggaattgctgggttatggagtaattctgtgcttcacttttttttttttttttttttttttaaatttttattttgagacaggctcttgctctgttgcccaggctggggtgacagtggtatgatctcagctcactgcaacctctgcctcccgggttcaagcaattctcctgcctcagcctcctgagtagctggggttacatgtgcatgccactacacctggctaatttttgtatttttagtagagatggagaaacatgttggccaggctcgtcttgaactcccgacctcaggtgatccgcctgcctcggcctctcaaagtgctgggattacagatgtgagccactgtgcctggtctgtgcttaactttttgaggaaccattaaattgtttttcacagtagcttaaccattttatactccatgattaacgtatgagggtttcaatattctactttttattttctgttttttgagatggagtctcactctgttgtccaggctggagtgcattggtgcgatctcggctcactgcagtttccgccttccaggttcaagtgattctcctgcctcagcttcctgagaagatgggattgtaagcatgtaccaccaagtgtggctaattttttttttgtattttttagtagagacagggtttcaccgtgttggccaggctgatcaggctggtcctgacctcaggtgatctgcctgtctcggcctcccaaagtgctgggattacaggcgtgaaaatgctactgatgacagtgcagagagtcctgagatgcttagagtagtggagttactcgatccttccctgtggtggagggttgggagttgaagaaaccaggaagtcctatatgaaatggtcctttaaggccgggtgcagtggctcacccctgtaatcccagcactttgggaggccgaggcaggcagatcacgaggtcaagagattgagcccaccctggacaacatgacaacatggtgaaaccctgtctctactaaacatacaaaaattagctgggagtagttccagctactcgggaggctgaggcaggagaatcgcttgaaccctggaggtggaggttgcagtgagccgagattgcgccattgcgctccagcctgggcaacaagagcgaaactccatctcaaaaaaaaaaaaaagagaaatcgtcctttaagtcaagccttaaaacgtaggaattacctagttaatttgaatattaatattatatgatatataagctgtacatgttataaaaattattttgaaaagtttaatctttaaaattttagtttagattttccttgtagttatctagagctgtgctgtccaatagtgtagccactagctacatataactattgaaatttaaattaattaaaattaaataaaattaaaaattcagtccttctgttacactaggcacattttagatattcagccatcatatatagctagtaggtgccatattggacagctcagaatagagtatttttatcctcccagcaagttcagttgggtggcaatgatctagacattttgatgaaatgaaagcttcattattattgctattattattattatttttgtgtgtgtgtgacagagtgtcgctctgttccccaggctggagtgcagtggcgccatctcagcttactgcaagctcgcccacccgcgttcacaccattctcctgccttagcctcctgagtagctgggactgtaggcgcccaccaccacgcccggctaattttttagtagagacgaggtttcaccgtattagccaggatggtctcaatctcctgacctcatgatccacccgcctcagcctcccaaagtgcagggattacaggcgtgagccaccgtgcccagcccaaaagcttcgttattattaatttttataattcagacgttttgcctcttttgtcaagtgcatgaaatttgagatgggtacagctgagaaatgtatgatggctgtgtgctgaattcctctaggggtgtatttgtttaaatattgccaataaggtgttcaaaataaggttatttgaaagagcaagttgaaatggaaagcttaggagagcttagttttttgtttgtttgtttttttgagatggagtttcgctcttgttgcccagactggagtggaatggtgtgatcttggctcactgcagcctccgcccccacaccattcaggcgattctcctgtctcagcctcctgagtagctgtgattacaggtgctcaccaccacgcctggctaattttttgtattgttagtagagatagggtttcaccatgttggccaggctggtctctcctgacctctggtgatcctcccactttggcctcccaaagtgtagggattacaggcatgagccaccatgcccggcctcagcctatagttcttttaatgcccttgtctactaattctatcatctgtgtcatttctgggtcagtttcagttgcttgattcttttttttcttcctctttttgggttgtcttttccacctactttgcttatctgttgatttttggatgccagacatcatgaattttactttgttggaggctggatatttttgtatttctataaatattcttgagttttgttctgagatgtggttaaaatacttaaaaatagtttgatgaagtcttgcttttaagctctgttaggtgagatcaaaaccattttagtgtagggctaagtatttcccactattgagtcaaaatccttttggggattctgtgtgatagcccatggactatgtggttttccactctggctgtgaggaactggcactcttcctgttcccatgtgagccttgtggattgttccatttgattcttttgggtattttatttatatttttagagaaggtgtcttgctctgtcactcaggctggagtgcagttttgtgatcatagctccttgcagcctcaaactcctgggctcaagccatgcaccccatatagctggggctataccatgcctggttatttttattgttttagagatagggtctcactgtgttgcccaggctggccttgaagactccagggttcaagcgatcatccctcctcagcctccccagtagctgggattacaggattttgccatcacatctggctaagggggtgtggaaccagggacaaagaccaaatacatatttcataatatactacacaaggtaaatctggttcatgtcactctaccttgactggaagcataagtatagattttgccatgttgcccaggctggtcttgagctcctagcctcaagcggtcccctcttcccaaaccttggcctcccaaaggtgctaggattgcaggcatgagccactgcacttcctgagtagctgggattacaggtgcgcgccaccacgcccgctaatttgttttggatttttagtagagacggggttttgggccaggctggtcttgaactcctgctcttaagcgatctgcccgcctcagcctcccaaagtgctgggattacaggtgtgagccaccacgcccggtctgatttttgtattttttgtagggatgggggtttccccatgttacccaggctgctcttgaactcctggcttcaagcaatccacctgcttcggcctcccaaagtggtgggatttcaggagtaagccactgcacccagccttgttcatttcaatattcctgatgaagtactccatctgatctcatttgctcttagaaatctgcttgctggttaccctgtgcagtggctcacacttgtaatcccagcactttgggagactgaggtaggaggattgcttgatgccaggagctagagatcagcttgggcaacatagcaagaccttgtctctacgtgcacctgtagtcctggctacttgggaggttgagatgggaggattgcttgaacccatgggtttgaggctgctatgaggtatgatcacaccactgcattttagcctgagagacaggagacagtatctcttagcaaaaaaaaaaaaaaagaaaaaacaaatctgactaccgtattgatgattctagtccagaattttccaaaggagtataggtggtttttttggttgttgttgttgtttgttttgttttttgagatggtgcgagtctcgctttttttgttttgttttgtttttttgagatggagtcttgctctgtcgcccacgctggaatgcagtggcacaatctcggctcattgcaaccttcgcctcccgggttcaagcagttcttgtgcctcagcctcccgagtagctgggactacaggcgtgcgccaccacgcctggctaagttttgtatttttggtagagttggggtttcaccgtgttggcctggctggtatcaaactcatgacctcaggtggtccgccattctcagcctcccaaagttttggaattacaggtgtgagccatcgcacctggcctttttttttcttttttaaacatatttatttatcatttttttttttttttgagacggagtctcgttctgtcgcccaggcgggagtgctgtggcgcgatctctgctcactgcaagctccgccttccgggttcacgccattctcctgcctcagcctcccgagtagctgggactacaggcgcccgccactgcgcccggctaattttttgtatttttagtagagacggggtttcaccatggtctcgatctcctgacctcgtgatccgcccgcctcggcctcccaaagtgctgggattacaggcatgagccaccgcgccccgccatccttttttttttttttaaagaggtggagtataactatgttgcccaggctgatcttgaactcctggcctcaagcagtcctctaccttggcctcacaaagtgctgggattacaggagtgaaccaccgcgcctggctgagataggttgttttttgaattaactattcttttttttttttttttttttttttgagacagagtttcgctgttgttgcccaggctggagtgcagtggtgcaatgatctaggctcactgcaacctctgcctcccaggtttaagggattcgcctgcctcagcttcccaagcagctgggattacaggcatgtgccactacacccggctgattttgtatttttggtagagacggggtttctccatgttggtcaggctggtcttgagttcccaacctcaggtgatctaccctccttggcctcccaacgtgctgggattataggcgtgagccactgcacccagccatgtttttaagatttttaaacatctggctcttttttttttttttttttgagacggagtctcgctttgtcacctaggctggagtccagtggcgccatctcggctcactgcaagctccgcttcctggattcactccattctcctgcctcagccccccgagtagctgggactacaggcacccgccaccatgcccggctaattttttgcatttttagtagagacggggtttcaccacgttagccagcatggtctcgatctcttgacctcgtgatccgcccgcctcggcctcccaaagtgctgggattacaagcatgagccactgcacccagcccttctggctctttttaaatgtcagatattgataactcccagactgaattaagattttatatgtcagatgattaactatcattttgagttgttgcttagttctctgcttgcttggcaacaggtcagtttccatggtattgccatttttgtaccgcattcttagtggagctgagaggttgggggtgaggctacagggccgaactctataaactagaatagctaaacttttatccagtttggtgtataaaattttttgatatacagctcaggaaaagcatataaaaaacaaaaataaaaataatttctgaataatttttttttttttttgagacggagtctcgctctgtcgcccaggctggagtgcagtggcgtgatctcggctcactgcaagctccacctcccgggttcataccattctcctgcctcagcctcccgagtagctgggagtacaggcacgtgccaccatgcccagctaattttttgtatttttagtagagacggggtttcaccatgttggccaggatggtctcgatctcttgacctcgtgatgtgcccgccttggcctcccaaagtgctgggattacaggcgtgagccatagtgcccggcccccccgcccccacctttttttgagacagagtcttattctcacccagcctggagtgcagtgttaacgatcttggctcactgcaacctcttcctcctgggctcaagtgattcttctgcttcagcctcccaagtagctggaactacaggtgtatgtcgtcatgcctggctaaatttttttttttaatattttttagtagagacggggtttcaccatgttgtcccagctggtctcgaacccctgggctcaagcaatccacccatcgtggcctcctgcagtgctggggttataggcatgagccaccttggcctgcataattcttttttttttttttttttgagatggagtttcgctcttgtcgctcaggctggagtgcaatggtgcgatctcggctcaccgcaacctccacctcctggattcaagcaattctcctgcctcagcctcccaagtagctgggattacaggtgtgcaccaccatgcctagctaattttgtatttttagtagagacagggtttctccatgttggtcaggctggtctccaactcccgacctcagattatctgcccaaccttggcctcccaaagtgctggtattacaggtgtgagccaccacgcctggccattaattcttttttaagaaagagtttcattgctattaaacaagtttgaaaatcacagtttctgcttgagtagaaaatacaaacttgggtttctaccactacactttcacaacatgcttttgactccagatttgaggggggatttctccccaacaggaggtaggccatcagttctgcagtgggcagcagctgggcatcctctaattgaattcagttctgacactgtctacactacccgcttagagatggatggtgacacatcacacaggttgaggactcagtcctatctttgatagtgaacgtaaaccttcatttattttgtctgtggttctgaccagccagctgcaaatttcaagagttcctgcagatacctccttgacttcaattactttgctagagtaacttacagaactcagggaaatgtgtttatccatttattacaaaagatacatgtgtatatgtgtgtgtgtgtgtgtgtgtgtgtgtgtgtgtgtgtgtgtgtatgtgtgtgtgtgtatatatatatttaaattttatttgagttagggtctttccccagttgccaaggctggagtgcagtggtgcgatcacagctcactgcagcttcaacttcttggactcaggctatcctcccatctcagcctcctgagtaggtgaaactatatacacacagcaccatgcccagctaattaaatttttttttggtagagatggggtcttgctgtattgcccaggctggtcttgaactcctgggctcaagcagtcctccggccttggattcccaaagtgctgcaattacaggtgtgagtcatcatgtttggcctacaaaggatatttggaaggatgcaaataaacagtcaggtgaagagatacatatagggccaggattgaaatggtccctagcactggcacttctgtcttcttggagttgggatgggccaccctcccctcacatggctgtgcttctctttactcctgcaatcccccatgtgtttggctccctacaagccatgttcagctccctgcaagctctctgaacccaatcctttcaggtttttatgaaggcctcattacgtagggatgactgattaaatcttttggccattggtgatgaattaaaagttcagtccctctcccctccttggaggttgaggtgggagttgaaaccatttgtcatcctaagctaacaaacggttgccagctattggtcaactcattggcatacaaaaagacacattactttgaagataccgaggattttaggagttgaagggccaggaaacaggaaggccaaatatatatttcacaatatcacaatatgttattaagagcaaatagtgatagaaaagtgaaagtgatgatagcagaaatgtaaagtgtaggttctataaacagtgcagatgagaacaaagctaacagttatcaggcagtctaaatgcatgcagttttttaccttagacacattcgttcgttgactgtttaattgtaaagaaaaatcaatttaagaacatgtatgaaattgcatttatactctggaaaaatgagatgtaagtaggtattttgtattttttagcgtttcaagagcataattccccttatggtatgtctgttgccttgctttcacacattccacttgtgtacatgtttttgggaactcattatgtaagaaagtaatggacttcttacacttctgttaggtaaaaccatagtaattggctgggcatgatggcatggggtgggaggatcacttgaggacaagagtttgagcttgcagtacactgatctttgctgtgaatagtcactgcactccagccggggcaacgaagacactgtctctttcttttttttttttttttttttttgatggagtcttgctctgtcgcccaggctggagtgcagtggcacagacttggctcactgcaacctccacttcccaggttcaagggattctcctgcctcaggctcccaagtagctgggactacaggtgcctgccaccatacctggctaatttttgtatttttagtagagacggggtttcaccatattggccagactggtctcgaactcctgaccttgtgatctgcctgcctcggcttcccacagtcctgggattacaggcgtgagccaccgtgcctggcccaagactctatctcaaataaaaaagaacacagtaatttttctcttttatgggatactacacttacataagtttcttttttttttcttttttttttttttttgtgagacagagtcttgcttttcccctgccaggctggagtggagtggcatgatctcagtcactgcaacctccgcttcctgggttcaagtgattcccgtgcctcagcctcctgagtagctgggattacaggcgtgccccaccacgtctggctaatttttgtatttttagtagagatggggtctcaccatgttttcccaggctgttctcaaactcctgagctcaggtggatcccccctgcctcggcctcccaaagtgttgggattacagtcgtgagccactgtgcctgtctgggatgtttgccatatttgtttcatcagtatatatttctttgcttgggttgagtacagggactgatgcctgtaatcccagcacttagggaggccgaggtgggaggattactggaacccaggaagttgaggctgcagaccaacctaggcaacagagtgagaccatgtcttcagggggaaaaaaaaagcgctgggcatgggcatatacctatagtctcagctactctggaggatgaggtgagaggatcgcttgagcccaggaatttgaggctgccatgagccgtcatcatgcccatgccaatgtactccagcctgggcaagaaagtcgaccctgtctcaaaactaaactaaacaaatttctctggctgaagtttagtaatttgcttttaagtgacgtttgtacattttagaaaataactttgtatattagacatcatttatggtacttaccgttttccatggtcataaaatacctagtctagtgtgataaatgccaggtgatagaggtatgcctggggcataaacctaggggcttggtgggatggggtgagatggttgaaatagtatgtagaaggaaaggctttccagagtttactcttagggtggctcttgaagggcaagtgaaggaaagacatttcaggctgagggaagacacgtttagatggagtcctgtggatggagagtgctggacttgtttgcgaagtcaggagtagtttgatatgatcagatgcttagggaggtgattggtaaagtggtggaaggtgagattgtggaacaggtaggcatggaccctatcacaagcgtcctggcttgtgtatctagctaaaggatctgtctgtctgtctgtctgtctttatattttttgagacggagtttcgctcttgttgcccaggctggagtgcaatgatgcaatcttggttcattgcaacctccgcctcccaggttcaagtgattctcctgccttagccttctaagtagctgggattgcaggcgtgcactacacgcccagctaactttttatttttagtagagttggggtttcaccatgttggttaggctggtcttgaactcctaacctcaggtgattcacctccctcagcctcccaaaatgctgagattacagatgtgagccaccccacctggcccatgcctctatctatctatctgtctgtctgtctatctatctattctatctaatcttttttttttttttttttttttttggagtcaggttcttgctctgttgcccaggctggactgtagtggcgtgatcttgcctcactgcagcctctgcctcccgggttcaagcgatcttcctgcctcagcctccctggtagctgggactacagatgtgtgccaccatgcctggcaagtttttatatttttggtagagatggggtttcactatgttggccaggctgatctcaaactcctgacctcaggtgatctgcccacctcagcctcccaaagtgctgggattacatgcgtgagccactgtgcctggcctgttaagtattaccataaactcttctcctatctgtcttgtaagttatgtacacctcatctatgttcttgatgtagcttgttacttagtctgttatagtaataatctctttaattattagcttttatgtcttctccattgtccactgacagccataactgcgtatatctttttgtatacctgtctacagaccagccatcctaggttgaagaatagaattacttctcattgcttccacagttcctgtcttcctttaaatcatcatgtataacacaaattatacagtagctttcttgtaaatctcctgcttctgtattttatatctgttaggctgggtgcagtgactcacttctgtaatcccagcactttgggaggccaaggtgggaggattgcttaaggccaggagtttgagaccagcctgggcaaaatagggagacaccccgtcaccacacacttatacacacacacacacacccccccacacccaccatgaaaaaaattagtcgcggcggggtgcggtggctcacgcctgtaatcccagcactttgggaggccaaggcaggcagatcacatgaggtcgggagttcaataccagcctgaccaacatggagaaaccccatctctactaaaaatacaaaactatctgggcgtggttgcacatgcctgtaatcccagctaccctggagtctgaggcaggagaatcacttgaacccgggaggcagaggttgtggtgagccgagatcgtgccgttgtacttcagcatcaacaagagcgaaaccgtctcacaaaaaaaattagtcgggcacaatggtatgcatctgtggtcacagctatttgggagactgagctaggaagattgcttgagctcaggaattcaaggctcagtgagctctgattgtggcactgcactccatcccgggccacagagactctgtttctaataaataaataaaatgtaaattagctgttcctctgtggcttacaaccttccagtggctcccatttcacttagagtaaaagtgaaagccctcaccgtggtcccctccttttttgctgctccattactctttctttatctccttcacttcattcagatcattgctcaataaggcctctcctaacctacctatctgcaagtatctctagaatatgacttaaaaacaatctaaacacagatgtcacaactaaaaaaaattaatacttagtccttagtgtcattaaatttctggtcacctattgttaaatagttgctttgtttgaaggtcactgcaacctgcatttcctgagcccaagctatcctcctgtttcagcctcccgagtagcagagactacaggtgtgcaccaccatgcccagctagttttttagaattttttgtagagacaggatctaactgcgttgcctaggctggtcttgaactcctggcctcaagtgatcctctcaccttggcctcccagtatgctgggattacaggcacaagccactacatctagacacgaatttctgatttaaataattctttgtaagaacacttcttaggaggcatttgaatggataactgtcttaactgtcttgcacaccagtctttgtcttttttttttttttttttttttttttgagaaaaggtcttgccctgtcacccaagctggagtgcactggtgcaatcacagcttactgcagccttgaactcctgggctcaaatgatcctcccaccttggcctccaaagtgtttggattacaggcatgagccactgagcccagcctcaggttgtctttctcctgctttactatttcatttttttcttttcgtcttctagcgtactgtaaatttacatatattttaatgtctgtactagaatataagctcaacaagggtagggctctttgtgtgtagacattgctcagtacatagttggcacgaaataaaatcacttaaatgaatgaatgagtgaaatacaaaggcggaatttgactgtaaaacagtcttgttggagaaggtatatggggaataggggaaagagagggcctcttttcgccctcctacattgatacagatagatctcagttggtctctgatcttgtttgtagggattttgttggatgaatgcaaggtgggatggtcttcagattgtaccaatttagctggcattgctaaccaactgttggaatctctgaaaataaaagatcttgaaattcctccccctctccccgcaaagagaaatacgaaggcagacaactgggtaaattgtcctacccctaactgccatccacagaaaagtaacattttgttttatttgattaactgtgcttgacaacattagaaacagtggaaaatcatctgggacttgggcaggtagaaactccagaggtaggactggaggaggggctgtgtaacctctctttcttactcttaagaataacctttttatctacccgagatttattggctccttaaaatcataactaaaacctgtagcctctttcagcagaaagcaatgcttagagtaagacttctactacactgccagcccgaaggcttgaacagaaggcaagtggaagccctaaaactttggctgttcctggcacgattccagtcccactctccctaccctcacccacagcttccccatcactgtctgcttgggaaccgtgagcattgttctcatcttgtgcttctttctgagttatcaggcagccggaaggccagattcccttgtcttccctcttttcatggactctgcattttcttttctgatcctgtttttcaccttgatcttcttggaacttttccctgagcccttttaaactcacggtatatcagcaaaattcccctaatcttcagtttcttctgtgatttccgccccccgccccacacattcttattctgactgaaaataggccatctcctgatgacactgcctccctgcagccctccgaaagagtacttgcctgcccctccatcccttttgtgttactaggcttcacagtagcatgtcctctttttctttgttgccatttctttacttttcttctcgcctccctaaaaacacctctgaatgtgatgtcatgagtttgtactatgcgctcctgatttttgctgcttaatccagtgtgctgtggaggattgaacctcttatgatggagttcccctctttaactctagtaatgcttcttgccttaaagtctgctttgtctaatatcagtatagctatgccagttttctttttgttcgtgtttgaatggcatctttttctgtcttttttattttcaacctttctttattcttgatgtcttggttatgtctgaacaggttttcatccacatcttaaaagcacatctttgcttttaacttgcatttagtttcattcacagtttcatttaatgtatttattgatatatctgtatttagatctaactcagagatttctatttgacccacctgttctgtgtgggtttgttttgttagtccttttgatcttcctttgcattgatttagtatttattgttattcttccctcttccttagcttggtaattgtgtgctatttggaaaaaatactattctctgagtagttatcctagagataacaatttacttcctttatttatttattatttatttatttatttatttatttatttatttattttgagacggagtctcgctctgtcgcccaggctggagtgcaatggcgcgatcttggctcactgcaagctccgcctcctgggttcacgccattctcctgcctcagcctcccgagtagctgggattataggcgcccaccaccacgcctggctaattttttgtatttttagtagagacagggtttcgccatgttagccaggatggtcttgatcccctgatctcctgatccacccacctcggcctcccaaagtgctgagattacaggcgtgagccacagcgcctggccaacttccttaatttattaatctcatgttgacttggcttctcaagaaggcttaagaatcctaaagggaagctgggtgcggtggctcacgcctgtaatcccagcagtttgggaggccgaggcaggcggatcatgaagtcaggagatcgagaccatcctggctaacacggtgaaaccccatctctactaaaaaaaatacaaaacattagctgggcatggtggcgggcacctgtagtcccagctacttgggaggctgaggcgggtggatcatgaggtgaggagatcgagaccatcctggctaacatggtgaaaccccatctctactaaaaaaaatacaaaacattagctgggcatggtggcgggcacctgtagtcccagctacttgggaggctgaggcaggagaatgacatgaacctgggaggcggagcttgcagtgagctgaaattgcgccactgcactccagcctgggcgacagagggagactccgtctcacataaataaataaataataaaataaggctgtgcatggtggctcacggctgtaatcccagcactgtgggaggccgaagtgggcggatcacctgacgtcaggagttcaagaccagcctggccaacatggtgaaaccctacctctacaaaaaatatacaaaaattagctgggcgtggtgccacccacctgtaatcccagctacttgggaggcttaggcagagaatctcttgaacccaggaggcagaggttacagtgagccaagatcatgccaactgcactccagcctgggcatcagtctaaaataaataaataaataaaattcacacctaggacatcacaataaaatagatcgcttgagcccaggagttcgagaccagcctgggcaacctggtgaaacactctctctacaaaaagtacaaaaattagccaggtgtgatggtgcgtacctatagtcacagctacttcggagactgaggtaggaggaacacttgagcctaggaggtcgaggttccagtgagctgagatcttacccctacactccagcctgggtgataggacgagaccctgtctcctcctcagaaaaaaaaaaaaagcattacttaatctcttagcctcttaatggccccctctggaataggcaaataagggggaaactgtgggggaaagcccaatacctacacttcccttttgttttttctggaagtcttcccctttttccccagctggaatgcagtggcacaatcatggctcaactgcagccttaatcccctgcgctcaagtaatccttagcctcccaagtagctgggactacaggtgcatgctaccatacacctggctaattaaaaaagaaaaattatttttgtagagataaggtgttactgtgttgcccaggctggtctggaactcctcacctcaagggatcctcttgcctgggcctcccaaagtgttgggattacgggcgtgaaccactgtgcctggcctgaagttccctttctgaaggcagcagtctctcttgcattccaggtctatcttgttacttttttttttttttttttttttttgaggcagagtttcactcgttcccaggatggagtgcaatggcacgatcttggctcgccgcaacctccacctcctggattcaagcgattctcctgcctcagcctcccgagtagctgggattacaggcatgcgctactatgcccggctaattttgtatttttagtagagacagggtttctccatgttggtcaggcttgtctcgaactcctgacctcaggtaatctccccgcttcggcctcccaaagtgctgggattacaggcatgagcaaccgcgcctggctttttttttttttttaaatagagacagtgtctcactatgttggccaggttggtcttgaactcctggcttcaagcaatcctcttgcctcagcccctcaaagtgctagattacaggcatgagccattgtgcccagttgttacttttctgattccttcaaacagatgttaatattttgttcactttttccagttgttctgtagtgggaggggtctgaatgacttggtttcctagaagggaagtaggtagtttctacctttctgttacgtagtctagtataatttctgtgtcttttcttatttcagtatgcctaatgatattcttcccagagccgctgtgaatgactgcataggttgaacacaacaacacagtgaccctaatccttccgataccttggcttcttagttccttgacctctattcctgggatcctgttctctgccctacctcagccacccattcctttgagttactgttacctgaaattcatacccttttatctctgtttcagacttagcactctacatcctcctgatctttccagctgatgcccttccagcatccctgtgatctttgactccatcatgacgtcagttcattgattataccaccttttcccttgatgtttcttacgcttttgttcagcttaaattccagtcattagaacacaacctctcctcctattcctttgtcttcttgtttcattagttcttttggctatgccacaacctgtgttttactctcattccccggaaaatagagcatacaacaaagcttttactgggctaatactttacttgaagttagaatgaaggggaaaatagaaagtgagacaggaaaggagggaaagcaaatacagagtgctacgttatccagcaggctacagcatcataagaaccttagctggctgctcagtcatgttggaaatctctggagaatcatggcacctctcagaatacttctggggacaggtttgagggaggatggctgagagatttatttgttggctccctctcatatcctgtctcttactggtcagagttgcctgaaggatcttaattattctatacttttgggtttgttacttggcttctctatgcagctgctggaaaagcagctgatttggggtaacagggcttctgccacagcaggcacagtgaggaccaccaaagcctacctgttaacactggggaggtagagaccactagtggtaggctgagttcatatgatcctcccagattgcaggattttgcttgtgctgctgagcctgcttcagctgggaagtagaacagcaggcaggaccgagtggattttggaaagtgtgtatgagctgcatttgttataccttgtgtaatccaactttttgcctattctttgcttgctttcccatagctcaatgtggctggagaaaccatactgatcactctgacttcacagtcatgattaccaagaccaagaggcttttattataggttatagtctgttttcctattccaattactcttctagatagtttaaatgtcttactttaatcctctaattctccctgccttatcctccctttatttcattggggaaaaaacctgaatcaattagaagaaaactactcactccccttaccagatgtgctacctgtctacatctgtgcctggtactctgccttctgtaactgctagctaaggccaaaccctgtgcacgtatactaggctccatgcttttctacctgtttaaggataatcactccagtagttcatcctttatttgcatcatcaaatttttcatctctgttgtatcattcttatcagcgtattaaacgggctattacttcttgtttaaaaacttttttgccgggtgtggtggctcacgcccgtaatcccaacactttgggaggccaaggctggcggatcacctgaggtcaggagattgagaccagcctggccaatgtggggaaaccccatctctactaaaaatacaaaaattagctgggcgtggtggcgggtgcctgtaatcccagttactcaggagactgaggcaggagaatcgcttgaacccgggaggcagaggttgcagtgagctgagattgtgcccctgcactccagcctgggcgacagagtgagactctgtcttaaaaaaaaaaaaaaacacacacacacaccaaaaaaacaaacttcttttggttattctgattctgtatattctttcttttctcctattcttttacacatttcattcaggcttttgcccccactgctcctctagagttgctcttgaggtgatcaattgctccatgttgctaaatccagcaatctgtttgcagtcttcaccttatttgaaatatctaacccaagagacatatgtgtctgtgtgtgcgtgtatatatatatgtatataatatgtatgaagggtttatatatgcataaatttaaaaggggtgtgtgtgtgtgtgtgtgtgtaaaattgaccgacatgactgtgaaggccaggaagtcccaaaatctgcagctggcaatctggaatcccgagatagctgacagggtaagttccagttcaagtccgaaggcacgagagccaggtgagccagtgtctcagctcaagcagtgagacccagaggagttccctcttaaactcagcctttttgttctcttcaggctttctgtgggttgtatgagtcccacccacattaaggagggcagtctgctttactcagtccacggattcaaatgttcattttatctgaaagcactgtcacagatagacccagaataatgtttgaccaaacatctgggcactctatgctgtagtccagttgatgcataaaattaaccattacagaaccttttcttcacttgacatttagaacaggatgccaatatagtccctataagagctagtccctggcttcagctccactacccgctcccccgcttttctctctctctctctcttttctttttttgtttttttggagactgagtcttgctctgttgcccagtgactcactgcaactccaaaaaaaaaaaaagccttactaataaaactcttagcctcttagtggatccctctggaatgggccaataagggggaaagcccaatacctgaacttctcaatgaaaatcctgggttcaaacaattcttgtgcttcagcctcccgagaggtgggattacaggcacccaccgccatgcccggccaatttttgtatttttagtagagacggtgttccaccaagttggccaggctagtctcgaactcctgacctcaagtgatccacccacttcggcctcccaaagtgctgggattacaggcgtgaggcaccacgctcggcctccccttttctctactgcagtcagaggtgccaacttgctctttttttttttttttttgagacggtctcgctctgtcacccaggctggagtgcagtggcatgatctctgctcactgcaaactccacctcctgggcccaagcgatcctcccacctcagcccctccccaagtagctgggactacaggcgtgcgccaccacatgcctggctcatttttgtattcaacacgctgtttcctgaccgtagctggataggcttctgtgttgggggctttgcactcattcatctgcctgaagtgcctccttgctgctgggcacctcctccccatccacatagcccatggccttattcttgccacgtgtactgaaatgtgacattctcatgagggttttcctcatcagtctgtctcagttttcagctgcatccccggcacttcctgttccccttccttgtttttcttttttctcatttactcttatcgtcatctaacacacttccttatttatcttgtttattgtatgattccttcaactagacggtaaactgtgaggtgagaggagagctttttaaaatcttgttgccttaacagcctcccccccccccaccactgcttctagaatagtgcctggtgcaaatttgcctctcagtaacaagttttctgtttatttaaaaatacggacggaatttcgaagctttgtgatagagataaaaaaaatggacaggagcttttcccaggaggtatacaaagtataggtgtctggcctggaactctccacaaagaatacctttattgctctacaaatgctatttgtagtctaaacatggatgagctgatacaattctgaaggcaccttgcagccttctctccttgcttctagctccacgtgtgtgcgagtctgcatatgtgagtgtaagggcagcactgtgttaaagagatttacaaacatctttttaatcctcataacaatcctacaccacacatgtcatcatcccctttgtacagaccataaaactgatatttagagagcttaaacgtcttgcttgaggcctcaagtggtaagtggcagaactcagcttgaagtgacttgactattattacattatatgtgacctcctagataaagagatgcctccttattttgtgtaaggcagaagtggggagtcttgggcagattacttaaccactgctatagtttggatgtggtttgtccttagcaaacctcatgttgaaatttgatctccagtgttggaggtgggccctaatggaaggtgtttgtgccatggggctggaaccctcataaatagattaatgccctcctgggtgaggggtgagtgagttcttactcctttagttcctacaagagctggttgttaaaaagagctggcgcctctctcttgctgcttctctggccatgtgacctcttcacatgctggctccccttcaccttccgccatgtgtggaagcagcctgaggctttcaccagatgccccatcttccagccggcggaatcatgagccaagtgaatttcttttctttgtcagttacccagtgtcatgtattcctttataggaacactaaagggactaagacaacccctttaggtcctaatcatatacatacttatagattcaaagtatctgcttagcatgtactccattcaaagcaactgttcaaaggtaagaatcctatcagggatcagtgcagaaatacgacaccttacacatttctcagctttcaccttcccagagcttcctcggattggtcctcctgttagtttcctggatctgaaggtaatacctcatccagaagataagaagggtagtggggactgtcaccacgaaggagctttccttttctggttcaagttatttcccagctccactcacctccggactgtttcatgaagaattccagaagtccccttctccctcataggaaagtgcaccgaaccactcagatttaatggcttaaaacaactgctggtatttgaggatttgttcaggtgggcagttgtggttctgggctaatgggggccggtgtcatctgcttgctccactgtgatctggaacagctgggccttttttcttggttactgtgtagtctcacgacctctccttttccagtgaggtctgcagtaggacctgatggcttatgcagtggttcagggcaaacattcccagaggaaggaaacagaaactgccagttctttttgaagtgtaggcccagaactggtatatcatcacttctgtcacatttccccgatgactttgtgtctctgaccatcccaaactcactgtgagaagtgactgcatggggtgtgggagtaggtccattgggagtggactagtccagaccttttttttttttttgagacggagtcttgctgtgtcgcctgggctggagtgcagtggcgcaatctcggctcacggcaagcctcgcctcccaggttcacgccgttctcctgcctcagcctcccgagtagctgggactacaggcacccgccaccatgcccagctaattttttttttttttaagtagagacggggtttcaccgtgttagccaggatggtctcgatctcctgacctcatgatccgcctgccttggcctcccaaagtgctgggattacaggtgtgagccatcacgcccggcccagtccagactatttttgagaataaaaaggggcctattaaaaattatgtcaggttgacagacataaactggaactgtcctcacctagtctggacatgtgggtatcattatcatctctacaacttggagaaaacaacacataggtgtgaccttgaatcttgaatctgttttcctgcagttctcctaatgtgaaaatgtgactgcattgagtatgcatgtgatgttttaaattgaatatagcttctaagcagaacccatcaactcttcttttctgttctgttctttacttttctttcttttttttcttttctttttttgagacagggtctcactctgtcgaccaggttggagtgcggtggcgcgatctcgtctcactgcaacctctgcctccagggttcaagcgattctcctgccttagcctcccaagtagctgggactacagactacaagcgtgagccaccacgcccagctaatttttttgtatttttagtagagacggggtttcaccatgttggccaggctggtcttgaactcctgacctcaagtagtctgcacgccttggcctcccaaagtgctgggattacaggcgtgagccaccgtgccgagccaccatcagattttcttggtgggcactgaatgatgacagaaagagtttaatttaacactggagggaaaaattggctttgaatttcctgagaaataatttcgtttgttgggttttttttttttttttgagatggagtctcgctctgtcacccaggctggagtgcagtggcatgatctcggctcactgcaagttgcgcatcctgggttcacgccattctcctgcctcagcctctccaagtagctgggactacaggcccccaccaccacgcccggctcattttttgtatttttagtagagacggggtttcaacgtgttctcgatgtcctgacctcgtgatctgcctgcctcggcctcccaaagtgctgggattacaagcgcgagccaccgcgcccggccagtttgttggtttctaatagagagctttcctgaaggatttttcgttcttttttcttttttcccccctgcaaggggaatttttcaagactgattttgactgcatgctatcctttcctttcctttcctttcctttcctttcctttcctttcctttcctttcctttcctttcctttccttttccttttccttttcctttcctttccttttcctttcctttcctttcttctcccctcccctcccctcccctcccctcccctcccctcccctctcctcccctctcctctctcctctctcgtctctcctctcctctttcttttcttttttttgagacaggatctcactctgtcacctagactgagtgcagtgaagtgattatagccccctgcagcctcaaactcctgggctcaagcagttctcccacttcagcctcctgagtagctgagactatttgtgccactacatctggctaatttttaaattttttttacagatgggggtctcactgtgttgcccaggctgatcttagactcctggacacaagccatcctcctgcctcagcatcccaaaagtgctgggattacaggcataagccactgtgcctggccagctgttttcaacctatatgctgacctggatctaatcctctcataagataaaatttcactctgctgattaatcagatcattttaaaggtctcatctagctctaagagactctaataatccaatagaaagtggttacaaacaccgaaagtacaattgggaagatataataaaggctttcacagttcatatgtgatctggggtcagatgggattcaggaaactccatactttgtgtttttctaatattaaaaaaatttttatatagagatggggtcttgccatattatattgcccaggatactgttgaactcccaggctcaactgattgtccctccttggcctcttaaagtgctaggattacaggcttgagccaccatgcttggctaccccataatttgaaggagagttagttgcaattaaaaatggaggtttttttttcttttctctttgagacggagttttgctctgtcacccaggctagactacaatggcatgatctcagcttacagcaacttctgcctcccgcattgaagcgattctcctgtctcagccttcttagtagctggaattacaggcgttcgccaacacgcccggctaactttgtatttttagtagagacagggtttcaccatgttggccaggctggtctcgaactcctgacctcaggtgatccacccacctcagcctccccaagtgctgggattacaggcatgagccaccgtacccagtcctggagtttgttcttaacagaatatcaaatcttgagaagttgactataaaagaaaattctaaaattaaaaattctattctctgtataatacatagaaggtagatttttgaggtatgacatttaagatgtgaggtgcctctaaaatgtacacatacatgcttgtgtactccacgtaattgtgcctcaaggaggtagggtgaggctttctgtctttcctgaaacatgttactcttgttcagtgcttggaaaaaggatgtggttagatggagtactggcttgatacaattctctgtcttgcccagggttgagggtggtgtcaatgaaaattctcaatttgaatgccatgtaataggctccttattaatcctgactacagtataaaaaacaggctgggcttcatggctcacacctgtaatcccagtgctttggttggccgaggcaggagggtcactggaggccaggatttcaaggcttcagtgagctatatgattatgccactgcactccatcctgggtgacagagcaaaaccctgtctcaaaaaccaaccaaccaaccaacccgcaaaaccaaaacagatctctccaagcttcggcagatttgagtaattatgtgatctcttcttgactgaacaagtcacttgtcagatgaatatctggttcccactatctagggacagaaggttcccactaacattgatttcaggtaatgcataacaaataaatactaagttttttgacatctttccacaacatgtttatattacgtgtgtgtgtgtatgtatgtgtgtgtgtatgtgtgtatatatatatatatgtatatatatatacacacacacgtacatacatatatatatgtgtgtatatatatatattttttgggacagagtcttgctctatcgctcaggctggagtgcagtggcgcgatctcgactcacgacaacctctacctcccaggttcaagtgattctcctgcctcagcctcctgagtagctggaattacaggcacgtgccaccatgcctggctaatttttgtatttttttttttttttaagtacagaaggggtttcaccacgttggtcaggctggtctcaaactcctgacctcaggtgatccgcccacctcggcctcccaaagtgataggattacaggtgtgagccaccatgcctggcctttttttaaagagatggagtctggctgtgttggcctggttggtcttgaactcctggcctcaagcagtcctcctgccttggcctcctaaagtgctaggattacaggcatgagccattgcacccagtccaatgtttcctagtttttcttatgcaaacttttaaattcttctcagtatatatgtctaaaatcttctgttacaaaaaaatactgaagctgctgcacacggcggctcatgcctataatcccagcactttgggcggcccaggcgggtggatcacttgaggtcaggagtttgagaccagcctggccaccatggtgaaaacccatctctactaaaaatacaaaaagtagccgggtgtcatggcaggtgcctgtattcccagctactcgggaggctgaggtgggagaactgcttgaacccaggaggcggaggttgcagtgagctgagatcactccactgcactccagtctgggtgacagagtgagactttgtctcaaaaaagaaatggaagcaatgtatatttattaaaatatgtatatacatatacagaaatgagctaaaagtagctatattattattaaaattgtatgcaataatgattgcatagcatgttggtatgaatatgaccataatttgacgcaagttgacacatttttttttctaatattctgtattacaactaatctgcatggattgtttttctgcatgtaatctctgcttacttggtttaactttttggtcgagtcctggaagtggaattggtgaattaaaaatttagatataaactcccaaattgagccaggcgtggtgtcatgcacctgtagtcctagctgctaaggtgggaagatcacttatgcccagcaattgcagtgggctatgattgagccattgcactccagccttggtaatgcagtgagaaacataaaagtttctccctccctccctcccttctgacagagagtctcactctgtcgcccaggctggagtgtagtgtcaccactgcaacctccgcctcccaggttcacgccattctcccacctcagcctcctgagtagttgggactacaggcacctgccaccacacccggctaattttttgtttttgtatttttagtagagatggggtttcaccgtgttagccaggatggtcttgatctcctgacctcgtgatctgcccgccttggcctcccaaagtgctgtgatgataggcgtgagcaaccacacccggcagtgagaaactgtttctaaaaaaaattttttttaacgtagaaatcttttcctttttttgagatggagttttgctcttgtcgcccaggctggagtgcagtggcgtgatcttggcgcactgcaacctctgcctcctgggttcaagcgattctcctgcctcagcctcccaagtagctgggattacaggtgcctgccaccacaccccgctaactttttgtatttgtttactagagatagggtttcactatgttggccaggctggtctcgaacttctgacctcaggctatttcttcccccagggcctcccaaagtgctgagaatacaggtgtgagccactgcgcctggccatagaaatcttttcatatgtttgtagatcattcttctttgagtattctctattttttaccttcacccgttttactgagtttcttattggtttataagaattttttttgctgggtgcagtggctcacacctgtaatcccagccctttttggggccgaggcaggcggatcacctgaggtcaggagttcgagaccagcctggccaacatggtgaaacccccgtctctactacaaatacaaaaattagctgggcatggtggtgcacgcctgtaatcccagctatttggaagactgaggcatgtggatcacttgaacccgggaggtggaggttgcagtgagctgagatcgcaccattgcactccagcctgggtgacaagagtgaaactctgtttcaaaaaaacaaaacaaaacaaaacaaaactctttgcatattgaaggaacttactagcaagccttttgacatagactttgtaaatgtttttcttttgatgattatatatatggttagtttggctgtgtacaagttttttttgtttgtttgtttgtttttttatttttttttttttgagacggagtcttactctgtcgcccaggctggagtgcagtggcacaatctcggctcacggcaacctccgcctcctgtgttcaagcgattctcctgcctcagcctcccgagtagttgggattacaggcgcccgccaccatgcccagctaatttttgtatttttagtagagacggggttttactatgttggtgaggctggtctcgaacctcctgacctcagttgatctacctgccttggcctcccaaagtgctgggattacagacttgagccactgcacctggccgcatatatatattttatttttttatttaaaaaaatgtttctgagacaggatctcactatgttgctgaggctggagttcagtggtgtgatcatggcccaccgcagccttggcctcctgggcttaggtgatcctcccatctcagcctcccaagtagctaggaccacaggcaccatcgtgcttggctaatgtttagtatttttttgtagagtcgagatttttgccatgttgcccaggtagtctcgaacttaggagttcaaaacgatttgcctgccttggcctcttcaagtgctgagattacaggcttgagtcacctcacatggctgcaaagcgattttttttgagacacatttagttttttcggtgatgtcagtaattttacaattaaagaaaaagttatctgaacaaagggagagtgcccttaaattgctaagagggagcattgctttgtttttttctagtttcgttgtgtcttacagtgttcaaacactgtactggaagtaaataattaagtttaaaataattttcttctccagtgtttgattatccatttctttttgttccaatttctgtatctgaaaaacaatattggcttcaaaaacgaacaaaaaaaaatttaacttcccccagattgcagatttaccatgtaaatgtgtttccaccctgttttcaagctaatgtgacaaatttgctacattataaagaacagaaacctgtgtacagattttggggatagcacacataaaatagtccaaggacattatcaactcaggtgcagaagttcttgctgaagttctattaacaattgtgtttaaaaacaccagatgggagcagatttaaagagggagattctaatggaaggttagttgggatttgtagggaagagagagaaggattttaattgaaaagatactagaccgtattcttacctttatagcgttgtcttcttttctttcttttctttttttttgagtcatattttcgttcttgtcacccaggctagagtgcagtggtgtgatctcggctcactgcaacctcagcctcccgagtagctggaattacaggcccctgccaccatgcccagctcatttttgtattttcagtagagatggggttttgccatgttggccaggctggtctcgaactcctgacttcaagtgagctactggccttggtcttctcaaaggttgggattacaggtgtgagccacctcgcctggcctatagtagtgtttttttttcttttcttttctttttttcttgagacggagtcttgctatgttgtccaggctggagtgcagtggcacaatcttggcttactgcaacctctgcctccctggttcaagcaattctgctgtctcagtgagtagctgagattacaggtgcgaaccaccacatccgggtaatgtttgtatttttagtggagacggggtttcgccatgctggccaggctgatctctaactcctgatgtcaggtgctccgcctgcctcagcctctgaaagtgctgggattgcaggcgtgaactactgtgcccagcctagtagtattttctatccaagttttggatgtaattctcttgggatttttttcctaatttgtacagctaccactgtactgttcatgactgtatccatgggaacataagtaggatgacataagtttataacttgttgctaggcagatctagcttgtaatgtattaagattttcccattaaaaagcatttggatggttttcttttgtgcggtgaaggtaactaaacagcgtaatttggaattaaaactgtgaagttgtataaattccttctaggagaaccaactactctttgttttctttctttcttttttttttttttttttgagacaagatctctttttgtcacccaggctggactacagtgacatgatcaggtttcactgcagcctggacctcctggacacaaatgatcctcctacctcagccttctcctcccctttaccagctcctccccttcccttccccagctctccccctccagtagctgggaatacatgtatgcatcagcatgtctggctaattaatttattttttaatttttatttatttatttatttatttatttatttatttatttatttatttatttattgagatggagtctcgctctgttgtccaggctggagtgcaatggcgtgatcttggctctttgtatcttcctcctcctgggttcaagagattctcctgcctcagcctccctagtagctgggattacaggcacctgccattatgcctggctgatttttgtagttttgtggagatgcagtttcaccatgttggccgggctggtcttgaactcccagcctcagaagatctgcccacctcagcctcccaaagtgctggggttacaggtgtgacactgagctcagcctattcattcattcattcattcattcattcattcatgagacggagtctcgctctgtccccaggctggagtgcaatggcatgacctcggctcactgcaacctccgcctcctgggttcaagtgattctctgcctcagcctcatgagcagctgggattacaggcatctgccaccacacccggctaattttgtgtttttagtagagatggcgtttcaccatgttagtcaggctggtcttgaattcccaacctcaggtgatccgcctgcctcagcttcccagagtgctgggatgacaggcgtgagccgccacacccagccatatatatatgtattttttatttgagtttgcgttttgccgtgttgcccaggctggtcttgaactccggaatttcagatcgcccacctcagcctcctaaagtgctgggagccgctgtgcccagcctagtcatgtttttaattaattgaatgtctgaaatggaagataatgagttaaaataattgtgtcttaagcctgtcctcttcagctaaaacagtcagtatttagatatgtatgaacgagatgtgaacacttgatccatcctaaagtacatagcagatttcaagatgatgacaggtatcttgggtagttcttccgactctcaaagacttggtggactaaccaagaaaacctcatggagatcgagacacctgtcttgtattttggttgcaattttttaaaattaatttttaaaaaatgtaatattagtgtaaaataactaaatttcaaaaaagtttagaatgagatgtaattgaggtcacatagctcttttctgcagaggctatcacacttaacaccttatctgattgtaatttaaagaattttttgaggctggacacgttggctcacgcctgtaattccagcattttgggagactgaggtaggagggacacttgagcccagcctgggcaacatagtgaaaccccgtcttacagaaaattaaaaaattagctggctgtcgtagtgtgcacctctggttccaggtactttggagtctgaagtgggaggatcacttgagccagggaggttgaggctgcagtgaactgccattgcactccagcctgggtgacagagcaagatccctgtctcagaagaaaaacagaaaagaggctgggtgtggtggctcacgcctgtaatcccagcactttgggaggctgaggcaggtggatcacgaggtcaggagatcgagaccgtcctggccaacatgttgaaaccccatctctactaaaaatacaaaaaaaattagctgggcttggtggcgcgtgcctgtggtcccagctacttggaaggctgaggcaagagaattgcttgaacccggaaggtggaggttgcagtgacccgaaattgcaccactgcactccagccttgcggcagagtgagactcggccttaaaaaaaaagaaaaccagaaaagaattatgtaagcagttattcaataataaataatatttatgcagctgggcacagtggttcacacctgtagtcctagcacttttggaggctgaggcgggtggatcacttgagcccaggagttcgggaccaacctgggcaacatggcaaaaccccatctctacaaaaagtacaaaaattagccggttatggtggtgttctcctttagtcccagctattcaggaagctgaggtgggcggatcacttgtgcccaggaggttgaggctgcagtgagccaagatgtcgccactgcactccagtcccaacaacagagtgagaccctgtctcaattaaaaaaaaaataataatatttatgccgtttttttgtaccagctactatgataggtgctttataggacaatttggggaagtaattgctgttaactccattttactcatataaggaaagtgacgcttgcacaaggtttaatatttcttgcccactaacatgtatgcttcaagaaagcaggggctatgtgttacttctgtctagccccctcctgtatctagcatagtttctttggggtttgggtagtgtgtcaaatacagtggaaaggctggttttacaaagatgattgttgtatcttcatttattacctttgaacttgtagcttcatagggaaatcatgggaatttgagcagcactgaatctgcatgtattaaaaaaacttgcatcatttctggatttcatgtggtgaatatttgatagtacctctcgtgatttgataaggtccattatttggggacaagggtggttaacatagggattgatggaattgtgactccattctgttgtggcgtgtttagtttttacctctttccctttactcctcgtgccccagctgcgtctgtgtccattgtcctttcagtttcttactctaattgaaagaatacataggtaaagaaggaatctgatagaaggaataaacttctttgacggtattaacaagtgtctgatcttgattagtgtaagttgtattcagtgcctcatgtttcttacctttgaattgtagaaaataaaattttagatctggttaagattcttgagattatttggcaggaggaaattgaagcgcagttcagttccatagaatgttgttgaatgcgtttcttcatttgttaagagtgataatatttgtctcatagggttgatacaaggaggaagagatactctttataaaaaagtcttaggccgatttgatgataatactaatagttaaacttgttcagaagttaatctgggctgggcatggtggctcacacctgtaatttcagcactttgggaggcagaggtgggaaggatcgcttgagcccagaaattccagaccagcctgggcaacaaagtgagacctcgtctctataaaaattataaaaataagccgggtatggtggcacatgcctatggtcccaggtactcgggatgctgagatggaaggatcacatgagcccaggaagtcgaggctgtggtgagctatgatcattgccactgcactccagcctaggtgacagagtgagaccctgtctattaaaaaaagttagtctgtgttagcatagtatcggcagaaaagtattctgacacagtataggagggatcagggtatgggggaatgagtcaggaaggccattttaaagattttacagtgtcctaaacttgatagtgaaggctaagcattagaaatggaagagattggctgggcgcagtggctcacgcctgtaatccctgcactttgggaggccgaggcgggcagatcacgaggtcaggagatcaagaccatcctggctaacacggtgaaaccctgtctctactaaaaacacaaaaaattagccgggcgtggtggcgggtgcctgtagtcccagctacttggcaggctgaggcaggagaatggcgtgaacccgggaggcggagcttgcacagtgagcccagatcatgccactgcactccagcctgggcgacagagcgagactccgtctcaaaaaaaagaggaatggaagagattagaaaagatgtgaacaaaccttatagagcttccaggaaaggaagaaaggtaaaaacattgagatttggaatgttgagtaatgggatagtataaacagtatagcagtatagagatgtcactaatgttttagaaactgaaataatagattaatgcatggtaattaccttgccagaactgaaaagcggtggtagtgatgctggaggaagcagattgctgctgcagaactgcagcaaggcctaggaggtggaggcaccaggtatcttcagaggcccaggtgtggtgtggttggccctaagctgatgggctgactgaaagtctccaggaattcttcctgtctctagattatgcttcattccagcagtccaggaattagactttccctagcctagcacaagacaagtttacttttggtagagtttgaaccagagctgtaccctagacttgaaatggggaggacgggtggaaactatctggacgtggtgggggagacgtatctatgaagtgaaagtttgtatattgaatggtcattccagaattcttaatagcctggcttatactctccagcaaattagaaggttcttctttgggagaaaactggcccagatgctaacaattgagtgttaccctgtattccagttattaccgcctaacaactgttgctgttactattgtctttaaacaacaacaatcgttttattatctcacactttctggtgatgaggatttaggaagacatcagttgggcagctctggcttgggtttctctgacttaagttgtgttcacatggtggctggagctgaacagtagggtgctgaagtggccttggctggccagacagctttcttcctggtgtctcagcatgggctgatttgtgctcctcacaacattatggcctctgactgcttacaagaaagtgcaggcttccaaagcaagtatcgcaagaaaactgactattaactgattcacttttcatgacccagcctcggaagtcacataggctcctttccgatgtagtcacaagtctagtcagcttcaagggcagggaacatagattccatctcttggtaggagtacagaagtggaattgcagtcagagtgtaaggggtccctgtgggatgacatgagaaacattctgtgaccacctttggaaaacacaatctaccacattttctcatttggtcacaataattcacattcctccttcttgtcacttgtgctcacaccctctcccatcacatcgctcccccttcctgctatggcattaacttcaagttcagcatcttgtcacctgaatcaagcccagttgtggccacccaaagctcctcaggtgtggttcctctagagctgaactcatgtgacgtcaagagaaggaatctgttgcttcctctgacttaaaatggcaggacaagcttaggataattgctgtagacacatctgcccagaaaagaggaaacaggaggcacagtagtttctcatccattgccattctgaaattcagcagggcacacgttaccaattccttgatttggtctcagttctggtgcctgggaatgattgtttcaggctctggtttctgctgagaattttgttttgtcttctgagttacccttttccctaagaaatggctgatttttatagctgagtagttttcttagcctttgtgctttcggtagttttggaggaacaaaaaaaccttcccctcattttgtactgtttttgtctctttcagtccaaactggtataattcctttgaaaattttgtgggctctctctgtgtcaatttgtaacctactacattagacaggaaccacacttagcctgtttgtggtaggtccttcatttccttgggctccttgtgtgtcaccagccttagtattcttagaagccctgttgtttgatggagaggatcttaaaatccttagaaggctcttggtctcttggaaaggacagtgcagaaccttcttagatctttttgaggttttaagaaagtattacagtcacagtctgggtttgttctttaccactgagaattttgagaattgtttctttttttaaaattctgcctggaaatatccttaggtagatcatggagtttattaggtgcatttcctgttttccacatttctaaaggccacattttccactacttagacaacaggggacccttttcctgtaatgtacaatagtagttttcatagtttctattaagcttttcctgatagtttccttgttgaggcccttcaggcttttgctgatagcctcttaaaggccttgcaatttccacctgccacccagccccaaagccagtagcacagttctgggtttttgttgcagcatctcacttccaggtgccaaaatctgttccttagtcttgctgcctgaaaaatgacccccaaaagttagtgacttaaaataattccgtgatttctgtaggtcaggaatttaggaagagcttgattgggcaattgtggctcaggttcttgctttggctgcagtcagatggtagagctgaagagtagtgcacaggcaaggcagtgtgcacagctggagagggccgagctgagccgcctccacaaggtctctgtgtgaatttgtttgtgctgcttcttcagggcactcagactgcccacatagctttgtgtccaaatgtatgtcctgtgggaggatgagcagaatctgtattaccttttatgatgacttagtcttggaagttacatcacatcatttctgctctagtcaacaacttgcctggggttctaggggaggaaaacagacctcatatcttagtgtcagttggccacactgtaagaaggtgatatggggtgggagataatgtgatcagctctagaaaaatgtaatccaccatagctcttagtgaaacagttacatccctgtctgatcaccttgcaggggagtcttgccattaataagcaccagctgtgtatgtgacattaaaacttactttttagtacttccttcttaactgtgacttaacagtcaaggattatcaggcacatgaagaaaaagccataacagtctaacacagacagataaaaagaaaccaagtgaagaaataggaaatacaggttgcataagaaaagctcaaatttgaaaaaacaaaaaagcttgaagagctaagagaaaatgcatgacataaaagcaagaaggtataaagtaggggtccattcagagaacaagaaagagctcttggaaaataggattgcaggacaaattttcaataggaaaccaaggaaatcttccagaaagtagtaggcaaagacagacaaaaagagaaagacaatgcctgattggcttcttgactgaaacatatttaggtgggaagaggaagtgtggaaatgtgaataaggactgtatactaatgataatgaattaatattaatttttgcttaagtgtgataatagcactgtggttatagaggagaatgcccttaggcttagaagatgcatactaaaggaactgtcatgatatttgcatttttcagatggttgtgtgcacacacgtgcgctcacacacagtgggagagggagggagaagggagagcggttatgtacaagagagacaactaaagcaattatgatataatattagtaattgatgatgaatacaaaaacaaaacagaagggaatactttagagttaatggattggttcaggagctccaacatctgcactgttagatgttctagagagagaaaagataattgagaggaaacaatattaaatcaacacattaaaaatgttcagaagtgaaaatcacaaatctccacattgagcagacccactgagtgcccagcgcagggaataaaagaaaaaatagattggtacatcacactgagatttcagaacactgagaatagagaagatctcaaaatcctccagtggaagcaagtcaagttacagcagtggactgagaatctgtatgacactagaatctaggtgacagtggagcagtgtcctcagaattctaggagcatacccatctaggatttttttttcttcttttttgagatggagtctcgctctttcgctgggctggaatgcggtggtgtgatctcggctcactgcaccctccgcctcctgggttcaaccagttctcctgcctcagcctcccaagtagctggggttacaggtgtggaccaccatgcttggctaattttttgtatttttagtagagacggggtttccccaccatgctggccaggctggtcttgaactcctgacctcatgatctggccaccccagcctcccaaagtgctgggattacaggcgtgagccactgcacctggcccaatttaggattctatgccaaactgtagtatgaacataaagacatctttatttttatttatttattttatttatttttgagacggagtctccatctgtcgccctggctggggcccagtggcaagatctccactcattgcagcctccgcctcccggattcagggagttatcctgcctcagcctcctaagtagttgggactacagacgcgtgccaccacacctggttaatttttgtatttttagtagagacggagttttgccatgttgaccaggctgatctcaaacttctgacctcaagtgagccgcctaccttgtgctcccaaagtgctgagatcacaggcatataccaccatgctcggcctattatttttaatttgatggtcatattattccagatttggccaatgggatttccttcaagctgactcctgtgtccttttgacaaatatctataatcctttatttatttttatttttttgagacagagtcctgttctgtcacccaagctggaatgtagtggcgtgatctcgcctcactgcaacccccgcctcccgggttcagacaattctcctgcctcagcctttggagtagctgagatcacaggcatgcgccaccacacctggctaatttttgtatttttagtagagacggggtttcaccatgtcggcgaggctggtcttgaactcttgatctcaggtgatctgcctgccttggcctcccgaagtgctgggattacaggcatgagccattgcacctagccctctataatcctttaaatgcttgtttatggtatcttagaatatttcaaatttatcttgtatgttctctgcctcatcctggagtcaactgtttgtctaaggaggagccattctcttgaagtggagaatagtattatagaaaccaatatcttggcactagctgtatttattgctgccaggatattgttgttttcagccctcttagtgggcagaacaagtagatctatgtgtatttatttattagacatatttattgtctatatctctgcctacacatatatataaccatgaattttaccacaaatgccaccattttgatccaacatcataggattcattttagcccttttcctttccttatttgtagctctcgtctctgacagtgagaatcttggttctcatccttaatatagttactcatttgcttaatctccctgaaagcttggcccagacatggaatccagcaaaggataaggtgaagggaattcttaaagagaaatcttgggataatagctgtgtaggcattcaccagttagtccagattggtgagtgaagacagggctccaaaggggtgttgtcaagaaataaacaaccaatagatagcctgatgtgttgagacttacacatgtagtagaagtttggaggtgaattagtgatacatatacagaaaaccaaacaagcaaaaaaaacaaaaaaaaaatagaattattaattccaggtaaaaaaatcacacataatcacaccactgaactctggcctgggtgacagagtgagaccctgtctcttaacaaacataaattaaaaatcaggtaaaacaaattgtacaagaatggacttacaacaacagaatgcaacaggattcagctatgaatagtatttactagtcataaactacgagagtgccataacactgaacttagggagcaatttagggaataaactgagaaaaaaagtacacaggggccttaggacctaagcagctagtgtgatatcacttgtggatgtttagtatgcattttgggtaccagccccttttgaacactgtctttgaggggaaattgtccactccacagtagaagctattaatatgttttcccatcctctcttgtagtttgtcatagatgtgtgacttctattccatgcaccagggcaagactaggattaggaagcaagtgatgtgaagtagacaagcatggctgccaggtttcagaggcagcgttttctagcggtggtgtccactatgcactgccaagtgtccttgtgtttaacacctgcagcagttaagacctccactgaagcagttctgtggggtaattctggtgttgtcctagttgcatggcttgtaaatctggtttgatgaccttcctgtagagccatttagttgcttatattagctagaatgggctttgtttactgtaaaaaatctggttgacgaaattggcattaggaatgatcctcaagaaaatgaattggttatctaacttggttgtgtatgaaggcagtgaagaaaggtgagagcttaaagaatcatagtggccttgggccgggcgcggtggctcacacctgtaatcccagcactttgggaggccgagatgggcggatcacgaggtcaggagatgagaccatcctggctaacatggtgaaaccccgtctctactaaaaatacaaaaagttagccgggtgaggtggcgggcacctgtagtcccagctactcaggaggctgaggcaggagaatggtgtgaacctgggaggtgcagcttgcagggagccgagatcgcaccactgcactccagcctgggcgacagagcgagactccaccgcaaaaaaaaaaaaaaaaagaatcatagtggccatgggcatggtggctggtgcccataatcctggcactttgggaggctgaggtgggagaatcacttgaggtcaggaattagaggcctgcagtgagtgccactgcacttcagcctgagggacagagcacagagcaagatcctgcttcaataaatggatggatgggtgggtgggtgggtgggtggatggaggaatcatagtgatcagcagtgcttaatgactgagattagtctattctgaagtatgttaataaagcttgaaggatcagaggaagagagtaggaaaaaagcacacacattctacaaacctcgccacatccactcagttaaaagacagaacaggattcccttggatgttgggaaagggaagtcagacgtgaaagttgtagacaggattaagccacttaattttcctattaaatggactctagagagtaagttcatgcttctcattttactgatggagaagcagtaccacatacttggtgaaattcctgtgtctgcaaaacattggttattctgcaattgttatatataaagggataaacattgaagttattggtctcttccttctcattggtattgtgggtgttctttaccaactgagttaggaactgacttgagatattttaaacttacgggacttgatttagagcacttactcttagatgttaaatatttggtttgctctttattgaataacttaattatcttattactaataattcctgtattagacaatgagacttagactcataatagaatacaggtatcttaatgagaatgttctcatttaaaacactaactcctaattcactagcagctaataaaactaacattgttgcacagtacattgttgactagttagaagaatttgacagtatgtttggtgctgagaccagctcggtcggggagaccctaacccagcggcgctagaggaattaaagacacacacacacaaatatagaggtgtgaagtgggaaatcaggggtctcacagccttcagagctgagtattgctattaataaagggtgtagaatttgaaaataggccaggcgtggtggcccacgcctgtaatcccagcactttaggaggccgaggaaggcggatcatgaggtcaggaggttgagatgagcctgaccaacacagtgaaaccccgtctctactaaaaatacaaaaattagctgggcgtggtggcgggtgcctgtaatcccagctgctcaggaggttgaggcaggagaattgcttgaacctggaaggcagaggttgcagtgagccgagattgcgccactgcactctagcctgggcaacagagtgagactccatctcaaaaaaaaaaaagaaaaagaaaaaagaatttgaaaatagcttgagagactagagaagaagtgaactgatttattttatatttatgtatcttattttttggcttgttgaccagaagtgaattgatatgaataagcacacttgcaaaataaatgggttatttatttatttatagagacagggtcttgctttgtttcccaggctagagtacagtggcaccatcatagctcactactgctgctggcaacttctgggctcaacgggtcctcctgtcttgacctcccaaagtgctgggattataggcatgagccgtcatgcctggccccctaattatttagatagccctgtagacctgatttcttgtggctgaaggtctctcaaattgattctcagtaggcttcataaataaaagggaacttacactggaggatctttatgctgaattggcttagaataagtagaaattgctaggaatgttttatttttgtttatttaatttgctaaatctgctttagatatgagccttgtaactggatttcttaaaagtgtccttatgattgaatctatttgtggtgtttggattgattattttaagttcctactatgtaccagacgtttgctacttgttttaacttgctgtttaatctctttgaagaaggaactgtttcctccatttttatagaagagaaaattgaaacttaaagagattagagaactctccttcagtctaggcagagctgggattccatttcaggactgttatgctacaccaaataaatgcttgctgcgttaaagaatgacttaacagtgaacaccttaagtcttcattgcccagttacgtgaatggaagaaaggctgagcagtgaattacaaacactctctcctctagtcttctggcagtgttcctttacctaattctgtgtcctcaaacgccctgttttctttaggtgattatattatttgtttcttttaagcttgcctgtctgcttgttcttctgaacagttcccttcaaatgttacaccatccacccacatctgtatttcagtattttattgtgtcctttcattgagactctaatttgggtgaaaattctccaaactacatttctttttagcatattctatttttgtcacctagaatcagcctcccagctgactttttcccatagatacgtaacaaccacctgctttaacattttctatcttccacttaacaaaaatattactgttgataaataatgaatacttagcatgtataactgtgcaaataaaatgggaggaatgtgtatcgggaagatttgaggggagtgtggataaaaaactgtttgaaaataccagctgttgaattttatagtgttactctttttatttttattttttagttttattattactattttttgagatggagtttcgctttgtcgccaggctggagtgcagtgacgtgatcttggctcactgcaacctctatctcctgggttcaagcgattctcctgcctcagcctcccgagtagctggaactagaggcgcgcgccagccaatttttgtatttttagtagagacagggtttcaccatgttggcaaggatgatctcgatctcttgacctcatgatcttcctgcctcggcctcccaaagtgctgggattacaggcgtgagctactgcacccagcctattattattttttaattgagacttgtcttactttcacccaggctggagtgtagtggtgcaatcttgcctcactggagcctccgcctcctgggctcaatcgatcctcccacctcagcctcctgagtagctgggaccacaggcactcgctaccgtgcccagctaattttttctatttttggtagagacagggttttgccacgttgtccaggctggcctcggcttcccaaagcgttgggattacaggcatgagccaccacgtgcagcctatagtgttattctttagtagttcctaaaaggcttgtgttagatgtttatagctgatagttgtggtttgaatctgtgtccccagccaaatcttgtgtcgaattgtcatccccagtgttggaggtgggggcccatgattggatcatgggggtggatatcccccttggtgctattttcatgatagtgagtgagctctcgggcgatcgggtcgtctaaaagtgtgtagcacctccctcttgtctctcttgctcctcctctggccatgttatatgtgcttgctttccctttgccttccaccatgattataagtttactgaggcctccctagaagctgagcagatgccagcatcatgcttcctgtacagcctgcagaaccttgagccattgaaacctcttctctttataaattacctagtctcatctcaggtatttccttctttctttctttctttctttctttctttctttctttctttctttctttctttctttctttcttttttttttttttttttttgagacggagtctggctctgtcgcccaggccggagtgcagtggtgcgatctccactcactgcaagctctgcctcccgggttcacgccattctcctgcctcagcctcccgagtagctgggactacaggtgcctgccaccacgcctggctaattttttgtatttttagtagagacagggtttcaccgtgttagccaggatggtttcgaactcctgacctcaggtgatctgcccgcctcagcctcccaaagtgtcgggattacaggtctgagccattgcgcccggccaggtatttttttatagcagtgtgagaacagactaatacaatagccatcatgtaaaatacagtttccattttgagccaggcacttgggtaaaaatgaagagtaggtaaaagacaagatgtagttctaatttgagcttgtcatttagtatttgagtaatgccgcataatggctgtgggtttccgatgacacacaccttttcatgatgtgggtggcctagggagtagtgtgtttgttggaaccacagttctctgcagagggaatatgattaagtctgatctttgtaatttagaattaatgaggccaggcgcactagctgacacctgtaataccagcactttgagaggcgaagatggggaggatcacttgagcctgagtttgagaccagcctgggcaagatagtgagaacctgtctctacaagaaaataaagaaaaaaatttttaaaaaaagaaaaaaaatatagaattggtatcttggccacacctctttccctgtggttgagttttttttttttttttttttcctgttcttttcctttttttttgagacaagatctcttcgtcacctaggctggagtgcagtgacatgatcaaggcttgctgcagtgtcagtctcctgggcttaaaggatcctcctgtctcagtctcccaagtagctgggactggaggtaggtgacactagcctggctcactttaaaaacattttttgtagagataaggtcttgccatgttgcccagggtggtctcaaactcctggcctcaagccatcctccctcctcagcctcccaaagtgctggggtctctggcattcaccaccgcggacaacctttttttttttttttttttttttttaagctaaattttgttgaatatttggataggcaatacaggcatatggtacaaaattaaaagatgcaaaagggttatgcacaagagaagtacatttcttaggcattcctggccttccattttcccttcctggaggcagttttctgatttattttctacaaggattctgtttaaatactggagaatatctgacctgttgtactttactttagaatggcaggaagctgaatgactcatgggcatttttccctttgtgaagctcattgacattccttcctctcaataccttaactatggcatgttttataatttgcttttgtttttgctttatcacagtattttcctatgttttttatagtcttaatttttaagcactgctttaggtatctattaatagttcagaaagttgcgaagattacaagctcatatttgtgaaagtgtctggcacataataggtgatcaataaatatttccttctagcttgtctgtcccctatctcccactggttgtatgtatgaaacaaaaaaatgaaggagaaggctgagcatagtggctcatacctgtaatcctagcactttgggaggctgaggcgagcgaattgcctgaggtcaggagttaaagaccagcctggccaacatggtgaaaccccgtctctactaaaaatacaaaaattagccgggtgtggtcacaggcgtctgtaatcccagctactcaggaggctgaggcaagagaattccttgaacctgggaggtggaggttgcggtcagtcgagatcgcgccactgcactccagcctgggcaacagagtgagactttttgtcacacacacacacacacacacacacacacacacacacgtgaaataaacctatgaaccaactaatgcagtggattccaaaattaagattaagcttgtgtaagttgtaatgtttcttgatgtacccatttatttgagtggaaacagattcttttcattctttgaaatcactttgctgagatttttttattttttttattttttttttggagacagagtctcgctgtgtcgcccagactggagtgcagtggtgtgatctaggctcactgcaacctccacctcccgggttcaagcgattctcctgcctcagcctcctgagtagctaggattataggcatgtgccaccacactcagctaatttttgtatttcagtagaggtagggtttcaccatgtaggccaggctggtctcaaactcctgacctcaagcgatccgcctgctcagcctccctgagtattgggattataggtgtgagccacggtgtcccgccaagctgagacatttttaagaaaatgtttctgtttttttgtttatttgtttgttttgagatggagtctcactctgtcacccaggctggagtgcagtggtgccatcactgcaacctctgcctcctgggttcaagcaattctcctgttccagcctcctaggtaactgggactgcaggcttgccaccatatacctggctgattttttgtatttttagtagagatggggttttaccatgttggccaggctggtcttgaacttctgactcaagcgatctacccacctcagcctcccaaagtgctgggattactcccacagcacctgctcagaaaaggtttcttttcttttctttttttttttgagatcaggtctcactctgtcgcccagggtgtagtgcagtcgcgcaatctcagctcactgcaacctccgccttccaggttcaggtgattctcttgcctcagcctcccaagcaggtgggatttcaggcatacaccaccatgcatggctcatttttgtatttttagtagagaggggtttcaccatgttggccaggatggtcgcgaactcctgacctcatgtgatccacccgcatcagcctcccaaagtgctgggattataagcgtgaatcactgcacctggctagaaacatcttctaaagcctaatcttttttttttttccttatataatttaggttgactatgtaaacccaaaacacatagggtagaaactcgtgaaaaatatttttgaggatatctttgcaaagtgttgtgcctcacggtgctggatatggatgtgtgcttagtgtcagtgcatagatttaggatttcccacctgtatgtatgcttttggtgagtccttttaggcgatatgtcctcatgttcaaggagtaatggcatactggttcatttaaacccatgttttaatcctaatttaagaccgatttacttcttcttggagctaatttcttaacttttctgatgatgtttttgttgcttaagttaagactaatataacacagaagtcttactcatcctttttgatattagagattttggtttattaatctagtggaattttaaatatcattttacatgtttactctcaagatctgatgattgactgactgggtgcagtggatcacacctgtaatctcagcactttgggaggccaaggcgggcagatcacttgaggtcaggagttcgagaccagcctggctaacatggtgaaaccctgtctgtagtaaaaatacaaaaattagccggacttggtggtgcgtgcctgtaatcccagctactggggagacagaggtgagagaatcacttgaaccccagaggcggaggttgcagtgagcctagatcactccattgcactccagcctgggcgacagagtgagactccgtctcaaaaaaaaaaaaaaaaaaaaagaagattgaattaagggcaaacttggaacaggccagtttcccattatattgcctctctgaaacaagtgaaagagttttctttatgaggggtgttctttttaatttaatttaattaatttttatttatttattttgagacagagtcttgctctgttgcccaggctggagtgcagtggcatgatctcggctcactgtaacctctgcctcccaggttcaggtgattctcctgcctcagcctcccaagtaattgggattacagatgcccaccgccacacccagctaatttttgtatttttagtggagacggggtttcaccatattggtgaggctggtcttgacctctgaacctcagatgatctacccacctcggcttcccaaagtgttggggttacaggtgtgagccactgtgctgggccttctttttaaaaaaggtttttctggccaggtgcggtggctttaatccatatgtgtgagaccaggcacggtggctcatgcctgtaatcccagcactttgggaggcagatcacctgaggcatgagaagtgcttgaactagggaggtaagaagttgcagtgagccaagatcacaccattgcactccaggctgggtgagagtgagactctgaaaaaaataataataaaaatggttttcttacttttatgacttgaattatggaaagtttttagaatgtgactcttttctcaggaacaggatggctacctacctaccccccatccttttcctgtatgctatggattatcagacccctcacttgggttcctcttacatcaccaaggtgtgcttgtcaatacccagaaaccaacactgatacattactaagttccacattttatttagattccaatagttttcccattaatgtccatttctgttctagaatccaatccaggttactgtatgcattgcatttaattatgatgtctccccagtttgctgtttttcacatgactagactagggttatgaatttggggaattcatatgattggagtggtgggaggtgtagtgcatgctactccatgatttattgctggtaatgttaatcgtggccaaggttgtttccctactgtatacactcaccaccttccatacttatttttttggaaacaagttagtaagtccaacctacactcaagtcggggagatttaagctccatctcctagaggggagtggggaatatttacataaattatttgaaattctcccacgaggaagctgctttttctaggaaaggtctttgcccgttattctaccgacttactggactttttatttgactttttaaaaagaagctctttagataaaatctccataaatacttagataaattactgcaattttatatttgcatatgaacaagtggagttttgttgatgcagggttgcattggccttcactatcaaaacaaatgtctcatctgatcagcatttataaatagtgaggtaccagaatcattaaggctcataaagtcttccgtttttattttggctattctggtggtgggtaacaatattaacaacaataaaaattcatcttattttactggagattcctgcaaagtggcagaataccaggacaaggaaccaattctggcacacatgtgtcaaacaagaaagctctgggaatgtaataatgtaataaagtgtggtcgagagagctctgggctggaataggcatggggtccttgacactatcacctctgccaagacacttcatgtgtatggtttccccacctttaagtaaactctatttatgaagttctttgtagctttaatagtttctagagttgcttgaatttggggtgacttcttgcaagggtaatgtgaagtagtgtcacatggacagtaacggagaggtatctgctgctgccatttatataataaatctgaatttggaggcagagaaaggaggcagaaagtttggtaaggacgttattgcaacctgaataagccacttagggcctagatcagtgtttgggaatgtgggagaagacagccatagtcaagaagcgtgaagtagttaatgttgagttatttttaggtggtttttctgttctttttactccagacactgactttcgtaataagataaataatctggtgagtcgcatgctcatggtgtgctgaggcatttagccaagcagcttatgcatgtattatctcatttaattctgtcactatgaggtagagattatctttaaccattggttccaaatgagaaagccctgtttgaaataatttttccagtgtatttaaattttgtaggtacacacctagaatttcaaactgatggtctgagttctgagcccatctgtttaattcatcctaatgggttatcttgtggatatgctgattatagtaaaacaactttaagaatgtgatatacattatgagtgatacttgtggtttgaatgggtttttttaaacaacatgaaaatttgaagatattttgcatagatttgcttttgggtaaaacttttttttttttcatatcttctgtaattaacttctttccccccttttttgagatggggtctcattctgtcacccaggctggagtgcagcttgatgtatgatcatggcttactgcagccttggactcctgggctccagcaatcctcccaccttagcctcccaagtagctggaagtacaggagtgcaacaccatgccctgtagagacggagtcttgctgtgtttcctaggctgatctctaactcctggcttcaagtggttctccctacttggcctcccacagtttgattagagatgtgaaccactgtgcccagccaaaattaactttttaatctattctaaatcaagaagaaaatagatgtgtcttttctgggactagtaatgagaaattgacagcatctggtttttggctgttgttaaagtgtgattattactatactggtatgctgataaagagattgcatggtaattttcatcctttcatctaaaaacataatattataaggatagatatttccttagtatggggtgacttgtgtagattactatctcataaattggttcagattagtttttaaaaagggcaaaattgtatattagtgatattgctcagctctttttcaaagggataaagcactgtaaagagagaatgtgggggtagaagtctaataaaatcctcacaaatctggatcagtaacagaaaagtcagttataggccaggtgccatggctcatgcttgtaatcccagcactgtgggaagctgaggcaggtggattgcttgagcccaggaattcgagaccagcctgggcagcatggtgaaaccctgtctgtactaaaaatacaaaaaattagctgggcgtgatggtgggtacctgtagtcctagctacttgggagtccaaggtgggaggattgcctcaacccaggaggcgcaggttgcagtgagtcgagattgtgccgctgcactccagcctgggcaacagggtgagaacttgtctcaaaaaagaaagaaagaaaagtcacttataattatgtgggctttaaaaaacctgactgatagtgctctgtttttagtttcaccaaaagataggtagtacttccatcctctttcatgaaactacagtatgtctattctcaatgtttcaaaaccttgtaagactcagagggaagaaatagtttctcattaagaaaaatttagtcaacagtataattatgtattaagtgcttcaggaaaagcaatgggggaaagtatttcctacagtattaggtctctcattagaggtgagcagagggagttccttcagcgcaggacgggcatttctgcaggtgaagtgggatgagacaaccggctatagcaagatgttagcatatgtagttagcttatggaaacataatttgaattggacatgagtttttgtttgtttttgaggcagagtcttgctctgttgcccaggctctattgcaatggcacgatcatggctcactgcagccttgaactcttggactcaaggagttcacccacctcagcaacccaagtagctggaactacaggtgtgagccacaatgccttgctaatttttttttttattttttgtagtgacagggtctcactttgttgcccaggctggtctcaaattcctgacctcaagcaatcctccagccttggcctctcaaagtgctgggattataggcgtgagcactgtgccctgcctatgagttgttatagactgggtgattttgtagtaggcagcagtttgttgtcatttgcatgttgtacttcatgtatggttttcccaagtcattaaatgtacatacttctgcaactttttattttttattttttctggtgaaaagatatacatatatttagaattagccagctggactcagtttagatgaccccaattttgttggcaacatccaaagcatcataatcaggagctagttgaacgtatgcctccttctctccatcaggccgaatcagggtgttgaccgggccacatcaatgtcatagagcttcttcacagcctgtttgatctggtgcctgttggctttaacatctacaatgaacacaagtgtcttgttgtcctcgctcttcttcatggcagactcagtggtcagcggcaacttgatgataatatggtggtcaagcttgtttctcctgggggcgctcttctgaggatatttgggctgcccctggagtcgcagtgttttgggccgctggaaggtgggtgatgtgtggatcttttttttttccggctgtggacgcctttcaacactgctttcttggccttcacagcctttgctttggcttcggcttgaggaggggcaggagcttccttctttgctttcggtgccatcttgtgaaaagggctctgcagcttttaatgtgtacagtttccatgatatgattgtaccagattataagattatgttggacatttgagttctttccaatttattgctgttttcagcagcacttgatgaataactttgtagataagtttttgcaaagctttatgaatattttcttttgggataaattgctagaggctcgggtaaacattgccaaactacccttcagaaagcctgaacttatttacagtacacttatggtatggtttggctctgtgtccccacgcaaatctcatcttgtagctcctataactcccacatattgtaggagggacctggtggtagataattgaatcatgaggccagatctttcctgtgcttttctcttgctagcaaatgagtctcatgagatatctaatagttttaaaaaggggattttccctgcacaagtgctcctctctgcctgctgccatccacgtaagactgagttgctcctccttgccgtccgccatgactgtgaggcttccccagctgcatggaactgttaaatccagttaaacctctttgttttgtaaattgcccagtctctggtatgtctttatcagcattgtgaaaacagactaatgcaacttctctcaacatttctagtggacaggttttctatgttcccttctaacatcctgttttgccaaacttttgcaaagaatttcatattgtcttttttcctaattcaaccttttgtaaggaactcttacaacattggtgtaaaggtatgtccttagctggtggtacagtagttagaagttttctctgggttatggtgatattgggagtaattgtgttataggataatctgggctctctgtatttcataagattgtggtgcctcaccatcagtcagactgtagcttcagggcttttttttctcttggattgcttggtggtgaaatatcaatacagccttgcccattctgattagtgtgttacattactgatagggcagtgttaagagaaataggagaaacctgagcctaaaacatttcactgtgaaattaattggtctctgaagtgttttgtctttgtttaggtttgacgatcgtatgtggcgaaattacattggtggtaaatgataagcttgttatattgataacatggaagaaaagtgtttctggtttctcttagagaaaatcgattcccagtccaaggcacctgtgagtccaagagaatgagagaaggtaagatgttattagttagaaactgactatacaattccagtttctagtgcagagttgacttcagtagcatttgattagcatctaacttccttcttgggggaatcagaaaagggacatagattaggcattagctgaactcagattactggaaagtgattgagtcagttctattttttatttttattttttgagacagtctcactccgtcacccgctggagtgcagtggtgcagtcttggctcatgtcaacctccgcctcctgggttcaagtgattctcatccctcagcctctctagtagctggaattgcaggtgtgagccaccacgcccagctgggtttggttttttttgcatttttagtagagccaggttttcaccatgttgtccaggctgttcttgaaatcttgacctcaaatcgtctacccgcctgagcctcccaaagtgctgggattacaggtatgagccaccatgcctggctttgagccagttctaagggaaattattcatttatttttgtcagcttgtaatattgcaaatcatagtatttttgaaataaccttcccatgggaatagagtttatgcccttaaagggtagagtgctattataaagagagatacaagaagagagggagtgggtggcattccagagatcaggtctacatgagttgctgcccagccttcttggttctcaaacttgtcggtctggattgctgtgtttaaggaaagggaatagaacaatatactccctttctaaaatttttcattaattggctacctaacctatgttatgcatattaatttacttaacatttatgaagtacttataatatgctagacactgaagatactatggtctgaaagatggcaaataatagaggagaaagaaaatcataattgctattatttatgaagtattaagtacaggcagttcttaagcattcgacttagtatttttcaactttaagatggtacaaaagtgatacacactcagtagaaactgtattttgaattttgatcttttcctcggctagcaatatgtggtgtaatacccttacatgagatattcaaccctttttttttgttgttttttggagacagagttttgctcttgttgcccgggctggaatgcagtggcgcaatctcactgcaacctctgcctcccgggttcaagcgattcttctgcctcagcctcccgagtagctgggattacaggcatgcaccaccatgcctgactaattctgtgtttttagtagagatagagtttctccatgttggtcaggctggtctcaaactcctgacctctggtgatccacccacctcagcctcccaaagtactgggattataggtatgagccaccacacctggcctcaacactttttttttttttttttttaaataaaataggctttgttagatggccttgcccaactacaggctaatgtaagtgttctgagcatgtttaaggtaggctaggctatgatgcccattaggttaggtgtattaagtgcatttttggattacaatattttcaatttgtgatacatttatcaggactaacactgttgtaagctgaggagcatctgtatgtaccaggtacttaatattaaggtggcctttctaattctcatagaaacccatgcaaggtaggcattatcctctccatttttctttagggttagtgaagctaagtagcttgttcgtcatcactcaataacaaagtggttaaaatgggatacaagtccaccatgggattgagtcccagatgggagttcagatgctgaccagtgttaggatctaagtgcaagtcacttaactcctcttttcaaatgtggactacaacagttcttatctcatagggcttttttggtgtgtgttatgtgacagataggtgaagtggttagcccagttactggcacgtagtaatagttaataattatattagatcatactggctcaaaagccattaatagtagttactgctggtagttgagtcttacaaagccattgttttctccacatgtctttatgcaaatcattaatgacaagagcctaaactgtgatagagaaggtgtccccagtgttatgagagtattgaagaggaatggactgctaacctggactaggagagtaagcagacttacaaagatggtgatccttgaggggtcttgaagcattattaggagttagctggtgggaaaagataaagagaaggaagtgggttagaggaaagtcatggcaaagcaaaaaggcccagaaatgtaatgactgtgtgagggatagagtcctgagggtgagacataggttagaaagataagcaggccagattatgaagggtcttgcatgccatgggttttttccctaaagacagcgggggaagcagcagaaggactttttattttggaataattttagatttacaggaaagttgtaaagatagtacaaagagtttccatataccctacacccagtttccccgttattaacatcttacattagtatggtacatttgttacaattagtgattgattgatttgtaattattacctgaagttcataatttattcttatgttcttagtttttacctaataccccttttctgttccagaatcccatcgaagataccacattacatttagttgccttgttgctttaggttcctcttggctgtgacagtttctcaagatttttcttgtttttgatgatgttttagttttaagaagtactaatcagaaattttgcaggatgtttctcaattgggatttgtctggcatttttctcattattgtactaaggttatgagtttggggtaggaagaccacagacgtagagtgccatttcatcccatccaagggtacataccatcaacatgactgatgactgctcatgttgaccagtgttgcctggcggagtactttacagtggaaacgtctgagtttgtcagaagtttcagctgtaaagtactcttccatctcctgctccgcccctttccatacaacccccttttttggaaagaggtcactatgcacagcccacactgaaggggaagggagttatgatccatatctcaggaaggacttttaacgtggaaagtgatttgatcagaattatgttccagggccaggcacggtggctcatgcccataattccagcactttgggaggggaggcaggaggatcagttgagcccaggagtttgaggctgcggtgagctatggtcatatcactgcactccatcctggacaaacagggcaagaccttgtttcttaaaaaaataaagaatgggctgggcgtagtggctcacacctgtaatcccagcactttgggaggccaaggcaggtggatcaagtgaggtcaggagttcgagaccagcctggccaacatggtgaaaccccatctctactaaaaatatgaaaactagccgggcgtggtggtgggtgcctgtaatcccagctgctcgggaggctgaaggaggagaattgcttgaacccaggagatggaggttgcagtgagctgacatggtaccactgtgctccagccttggcaacagagtgagactctgtctcaataataataataataatgataataataaaaaataatgaattgtgcttcagaaagattgctctagctagtggagaaactgaatctggggagaccgaatttagcctgcaacctttaagacaggacaagatgagaaaccatgaagttggaaactgaaggtcagtggcagcagggttggagagcgatggatttgagaaaagtcgaagagattagtggatggggctcagtgggttttgcagagtgtgtgtgctcgagtgctagtagcagatgaggggactccaagatgacttgccagccatattgctgggagttggtgactatacaagtgatagtgttaatttttttaggtaaacaagaagaaacagcttgttgttgatagtgggaagggtgaatgagagggcaataagctgtgtcaagatgctttttgagttgttcttggcttatatgcgtattctgtcttgagataaagatttagaagtcattaccataataaatgtggtttgagaaatttgcagtgttagatgttatggcataggaagagtaattaataccagatgaaaaagaggaacccagggaacactgatgtttaaaaaagtggtagagaaaacgtggggaaaggtcaacttttgttaaaatctcttattcatgtggctgtttaattcctctacatcacatcctctcttctgttcaccctggaggtgtaaaacactataccaaaggacagaacacactatacacgtttagaacatttcttctgaggatagttactgctgcggtaatgcaggtactgttgtggtgatgctaatgagaataaatcttgctaaaattaagaatcaagacagctgaagacctatggaaagcaattgaccgaacagtactacttcaggtcaggtaagcagtggcagtacaagaatgaagaatggattctttgttaccaagcaattaacaatctagttgggtatttactgggtaatacaatacaaagtaagcaatggtaattggttatgtgtatgtcagttgtggcatgatagtttctacctcggctatctgctgaagccctttctgtctgtcttctctccctgtccagctttgttcttgcctgcctttttattttttacagtccctctccttttttgcaggggggcggggcggtgctagtgggagtatacatacccctcgttaaccacctgtgatgtaagttaagatttttttttaaatgtttctgttttttaaaaacaagtgaatagagcatttattatcatggaggataaaatcctcaaagaaaaaatctgtttagcttttaaattcttcgtgaaatcgctaatctttgaggcgaaaaattttttcccgtaaatttaggagaacatgagatttgagtttttaaggactttatagcgtgcctatgtttattgtagattttaattccagagagctggtgattggaaatcatggacctatttgttccaatttaaactttcagcatttaaaaaggaagagataagagagaaccagacaggaggtatatagtttgtagaaagatacagatatttaatgtaatcccagcactttgagaggctgaagcgggcagatcacctgaagtcgggagtttgagaccagcctgaccaacatggagaaaccctgtctctactaaaaatacaaaattagccaggcgtggtggcacattcctgtaatcctatctacttgggatgctgaggcaggagaatcgcttgaacccaggaggcggaggttgcagtgagctgagatcgcgccactgcactccagcctaggcaacaagagtgaaactcggtctgaaaaaaaaaaaaaagagaaaagaaaagatacaggtattgaaataccaaagttgcttctgacttcctcattttatagagagtgaactgttgtcagttgagaattcttaagccatttaacttaaatgctaaaatacttaatgtggatatcatggggaggaaaaatgttctttacattctttggtttttgatcataatgtatggtgtctttaaaatctaggcattgtagcataatggttaacaccaccgactctgtcttctgctgttttcatacctcttccttaagcttcgactcagcttcactgctcataggtgtgatgttgggcagcttacttcatctctctgtgctttaattttctcatctataaaatggatagtcgtaagattgaaatgaactaaggcacgtcaaagtacacagtgcctagcacatagtaagcatttataactgttacagcaatagtaatcatatatactcttgccattccctttgatttctatctttttgattacccaacgtcagaagccaaaaattttggagtcataaaacgttttttggtccctaacataattaagttaaatttactcatgcgtagcatctcaggatatattgaaagtatgggtggccagtccatacatttaagaataagaattataagaatttagagacagagccttgctttgtaccccaggctggagtgcagtggtgtgacctcagctcactgcaacctctgcctcctgggttcaagcaattctccggcctcagcctcctgagtagctgggattacaggtgtgtgccaccatgcccgactaatttttatatttttagtagagacggggtttcaccatgttggacaggctggtctcaaactcttgacagcaagtgatctgcctgccttggcctctcccaaagtgctggggttacaggcatgagccacttcacccggccagaatttacctttttaaaaagctttatttattatctttttgagtcctactgatgagtaatttggagtttcatgtgtcctttttatataggtattagagtatgacaatgacatctataatgggatagaatttaaattttaaagcaaaccaaacagctgtcctatttatgagtgctaacttaaagatggtttgataacatgaaggtaacggtactatgaatgtgaatgtaatgaccctatatatacacaataaatatacacaatatatatacagttctctgtttatacttttcagcttcagttttcttgttctgaatttaagcaagaaggtagcatttaattcatagcttattgtgctactcctgttttcatacctcttccttaagcttctggtaaaattaaaacatttcaagtagagtttaggattgtagaaaacaaggcatgttgttaaaacctgtaattgtgagcgtgtcttaaaatgacaagattattatatatatatatatatttatttattttacttatttattgattgattttgagatggagtcttgctcttgtcgcccaggctggagtgcagcggtgttgtctcagttcactgcaacctctgcctcccgggttcaagcaattctagtgcctcagcctcccaagtagctgggattacaggcacctgccaccatgcctggctaatttttgtatttttagtagagatggggtttcaccatgttggccaggctggtcttgaactcctgacctcaggtgatccacccatcttggcctcccaaagtgctgggattgcaggtgtgagccaccgcacccagccctatcttataattattgatagcaagaaaagcatattcaccatttgtttcagttctcattgttttcgcttccccttctgtgtttatccatttggccattctctttcttgtgttcatctttctgttctgactcaggtcattgaggatatggttggaccctgaatggtagaaacacaactccctcttcccctcgactccacagacttaatgtgattttttagggtataggggagggggttatgagaatgtgggaacccaagcaggtgttctaatggctgtggagtaacctgtcttctccttccagttagtttctgtgttttgtttgtttgtttgttttaaagagacagggtctctccctctgtcgcccaggctggagtgcagcagggtgatcatagctcactacagccttgaactcttgggctcaagcaatcctttagcctcaccctctgaagtagctgggactacaggtgcttaccaccatatctggctaacttttaaaaactttcagagatagggtctcactgtgttgcccaggctggccttgaacttctggcctcagctgatcctcccacctcagcctcctgagtagccttgctttttaaataacagctttactacaataaaattaacaaaacacgcagttcacttatttaaaatatgcaaaattcagtggttttcggtatattcagagttgtgtaactatcaccacaaatcaaatttaaaacattttatcatcccatgaagaaatgctgtacctgttagcagtggcaccctgttatttcaaatgccctacagcctctggcaatcactaatcatctttctgtctggacggttcatgtaaataaaatcatacaataggctgtggatttttgtgcatgtgactggctgctttcacttagcatagtgtttcaagtttcatactgagcatgtgttagtgttttattttcatggcagtataaagttctgtcatatagacatactgcatttttttattcaatcggttgatgggcatttgggttgtttctaccttttagctgttgagtaatgctgctatgaaaatttatatacaaattattatgtggatatatgtttttatttctttgggctgtatacctaggagtggattttctgggttatatgataattttttttcttttttgagatggagtctcgctctgttgcccagtctggagtgcagtggtgcgatctcggctcactgcaagctccacctcctgttacgccattttcctgccttagcctcccgagtagctgggactacaggcgcccgccaccacacccagctaatttttttttgtatttttagtagagacggggtttcaccatgttagccaggatggtctccatctcctgacctcatgatccgcccgcctcggcttcccaaagtgctgggattacaggtgtgagccaccacgcccggcctctgggttatatgataatcttttgaggaatggcaccattttatattcccaacattttagccaaataatctgactaaaaacaggcaaaagagctgaatagacatttctccagggaagatactcagatggccaataaacttatccaatatgctcaacctctttattcagggaaatgcaaatcaaaaccacagtgagagactacttcacacctgctggctagaatcaaaaagtcagataataacaagtgttggtgaggatgtgtagaaattggaactctcataccctgctggtgggaatgtaaatgtaaattgctgttctgctcccaaacagttgacaagtaaaatatagcattatagagtgagaaataactcagagtttcagagtagaactgaaaatatactagaagagtattttccttagtgttggactagatgattttaaatttgaacacagacattgtatcaggtaacatcaaatcatacagtgaagggtttctcacaatgtacacaaaatagtatttgtctgcttaacactgggatttgcaaagaacagtgaaatattacagtgttacaaagcaagatcttcctctctttaaatgcctgttaacctgattttaagaatatctttattgtatacatcttattctttaaatgtaccccataactaatagtaccaattttatgttttcaacatttaagttatgatattatacatttcctttaacttgctttttctattcaaactggttgatagctgtagatctgattttgttttctatatttaattcccttgaagtcacataccacggtttatccaatccctgattttttttttttttttttttaagacagagtctccctctgtggcccaggctggagtgcactggcaggatctcggctcactgcaagctccgtctcctgggttcacgtcattctcctgcctcagcctcctgagtagctgggactacagtcgcccactaccatgcccggctaatttttgtatttttagtagagacggggtttcactgtgttagccaggatggtctcgatctcctgaccttgtgatccgcccgccttggcctcccaaagtgctgggattacaggcgtgagccatggctcacgtgagacagagtttcactctttttgcccaggctagagtgcaatggcacgatctcggctcaccgcaacctccgcctcccgggttcaagtgattctcctgcctcagcctcccaagtagctgggattacaggcatgtgccaccatgcctggctaatgttgtgtttttagtagagacagggtttctccatgttgctcaggctggtctcgaactcccgacttcaggtgatccgcccgccgccgcctcgccaagtgctgggattacaggggtgagccaccgcgcccagcccccgttgatgtattttaaagattttcctctatttttgtcctatagacgattctgtagtaactatctatgttattatgtagatagggttcttcagataaacagaactactagaatatgtatgggtgtatctatgtgtacatatattcagagatttattttaaggaattggtttatgtagttgtaggggcctgacgagtctgaaatctgtgcaggcctataagaaggagttagggccttagtctcaacttctggaaaaatctcaatttctgctcttatgacctttaggtgaactggataaggcccacccacattatggagggtaatcaagagattatagatgttaaccatatctactaaatacttttcacagtaacacctagattaatgtttgattaaataactggctactagagtctagccaagttgacacagaaaactaagcaacacactgtccttccatgtgcaccagagactttcagactttaaaaaacctccaccaatagtttatacacatacttaatgaaaccatatgctgatgttttctgttcttattcttttttttaaaatgctgattaggaacccaaaattcaatgtgagtagatctgaccagcaatttgaaaaacattgcatatatatgtagtctagaaatggaattgctggcttgcaaggtatccacacgtccactttactatacattgccagtttttttctctgaagtagttgaaccactgtacagccctactagccgtgtgaataaaccttctttcttacccccttgatggcaactggtaattgcagtttccttgtagacctaattattccagataggtctgggcttattttttaaggtctttaaaacttgataaaaatcgactttaggccgggcacggtggctcatgcctgtaatcccagcactttgggaggccgaggcgggcggatcatgagaccatcctggctaacacggtgaaaccctgtctctactaaaaatacaaaaaattagcagggcgtggtggcaggcgcctgtagtcccagctacaggctggggcaggagaatgacatgaacccgggaggcggagcttgcagtgagccaagatctgcactctagcctgggcgacagagcaagactccacctcaaaaaaaaaaaaaaaaaaaaaaaagtcaactttaaacaaagagacctgcctgtgttggcaccttcagcaaatattagtatctacccagaaattaatgacatttctttattttcattgtatttatattttttgatttacatatagcaaaactgaataatttttggtgcacatttttgtgagtgttaagacatgtatacaatactcctcccttatccatgaaaggtatgtttcaagacctctggtggatgcctgaaactgtgggtagtactgaaccctatatatatactatggttcttcctatgcatacatacctatgataaagattaatttataagttagacacactgagagatcaacaacaaaaaataataaaatgaacaattataacaatatgccaacatcgccaatactttggggctgttagtaagtaaaatacaggggacttgaacacaaatgctgcgatgctatgacagtccagctgataactaagatgacccaagtgactaatgggcacatagcacctacagaggggatgtggtgcacaaatggatgattcaggtactattcctggaattttcatttgaatgttttcagaccacagttgatcatgggtaactgaaatcacagaaagcaaattccaatgcggggcaccactggagtttcatataccaccaccacaattaggataccaaagagttccagctcctccaaaagctacctcagactttcttaagcttcctcacacttctagaccctggaaaccttggatctattcattatccctgtacttttgcctttttcagagtgtcgtatgaatgaacttgtactggcttctttcactcactgtaatgctttggaagtaggtctaggttgttgaatatattagtagttcactatttttgttgctgtgtactgttccagtatatggatgtactacagttggtttatccatttacgcattgaaaacatctgaatatttcacagtttttttttttttttttccccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcgcttcccagtaggggcggccgggcagaagcgcccctcacctcccggatggggcggctggccgggcggggggctgacccccccaccaccctcccggacggggcggctggccgggcagaggggctcctcacttcccagtaggggcggccaggcagaggcgcccctcacctcccggacggggcggccggccgggcggggggctgacccccccacctccctcccggacagggcggctggccgacccccccccacctccctcccggacggggcggctggccgggcagaggggctcctcacttcccagtaggggcggccgggcagaggcgcccctcacctcccggacggggcggctggccaggtggggggctgatccccccacctccctcccggacggggcggctggctgggcggggggctgaccccccacctccctcccggactgggcggctggccgggcggggggctgaccccccccacctccctcccggacggggcggctggccgggcagaggggtcctcacttcccagtaggggcggccgggcagaggcgcccctcacctcccggacggggcggctggccgggcgaggggctgaccccccacctccctcctggacggggcggctggccgggcggggggctgacccccccacctccctcccggacggggcggctggccgggcagaggggctcctcacttcccagtaggggcggccgggcagaggcgcccctcacctcccggacggggcggccggccgggcggggggctgaccccccacctccctcccggacggggcggctggccgggcagaggggctcctcacttcccagtaggggcggccgggccgaggagcccctcacctcccggacggggcggctggccgggcggggggctgacccccccccacctccctcccggacggggcggctggccgggcagggggctgaccccccctcccccctcccggacggggtggctggccgggcagaggggctcctcacttcccagtcggggcggccgggcaaaggagcccctcacctcccggacggggcggctggccgggcagggggctgaccccccccccacctccctcccggacggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggtgctccccacatctcagacgatgggcggccgggcagagacgctcctcacttcctagatgggatggcggcggggaagaggcgctcctcgcttcctagatgggatggcggccgggcagagacgctcctcactttccagactgggcagccaggcagagaggctcctcatatcccagacgatggggggccaggcagagacgctcctcacttcccagacggggtggcggctgggcagaggctgcaatctcggcactttggggggccaaggcaggcggctgggaggtggaggttgtagcgagctgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccgtggaaggagaccgtggagagagagggagacgagagggagagggagagggagagctgtttcacagtttttgatgattgtgaataacgctgcctatgtgtgcaggtgcttttttttgtttgtttgttttgaggtggtgtctcgctctgtcgcccaggctggagtgcagtggcgcgatcttggctcactgcaagctccgcctcctgggttcaagccattctcctgcctcagcctcctgagtagctgggtctgcaggcacacaccaccacacctggctaatttttgtatttttgtggagatggggtttcacagtattggtcaggctggtctcgaacccctgacctcaggtgatcctgagcctcccaaagtgctgggattacaggcgtgagtcactgctcccagcctgtgtgcaggttttattgtgaacatatgctaattctgtagggtatatggctgaacagtggggttgctagatcagtcatttggtaaatataattatgtctttgtaaaaaactgcaaaactttcccagaatggctttataattttgcatttacaccagcagtgtatgagaatttcagttgttcccattcttgtcagcactttgtagtgttgatgccttttattttagacagcctaacaggtaaataatggtttctcatcatggctttaatttacattttcctaatggctaatgatgtagagcatcttttcatctaatataccccctttatatctactttggcgaagtgactgttcaaatcttttggccattttaaaaaaattgtgttattttccttattgttgactttgaaagttctttatgtattctggatagaagtcctttgttgcatatgcgatatgcaaatattttcttacagtccgtagtgtatctcaacagtgccttttgcagagcaaaagtttttaaattttatttttagtataccattaaaaaatgtttggtggattgtgattttggtactgtatctaagatctcctttcccaatccaaggtcaaaaagatttccatgtgtttttctttagaaattctataatttttcagttttacacttagttctgtcatctgttttgagataattttgaggtatggatccaaatttttttaaaaaaatgtttgttttgtttttgcatgtgaatattcatttgttcctgcatcatttgttgaaaagattattatttttggcttgattttgccttcgtgcctttatggaaaatcatttgatcctgtatgtgtggttctgtttttggactctattccatttatttccctttttttttcttttttttttttgagacagaatctcgctctgtcacccaggctggagtgcagtggtgcaatcttggctcactgcaagctccgcctctcgcgttcacgccattctcctgcctcagtctcccgagtagctgggactacaggcgcccgccaccacgcccggctaattttttgtatttttagtatagacggggtttcatcatgttagccaggatggtcttgatcccctgacttcatgatcctcctgcctcggcctcccaaagtgctgggattacaggcgtgagccactgcacctggccttttctctgtctttatgccaataccatacattcttgattactgattttttgtaattagtcttgatttagatagtgtaagtcttccaactttgctctttttcaaaattgcattggctgtctcatttactttgcctttctttatgaattgtagaatatttatcaattacggcaaaagaaggtgctacaattttgattggagttgcattgaatctttagagcagtttgggaagaatgccttcttaataataagtctatatctatgatctatttcttcatcttcttagatcatctttagtttctctcagcagtgttttgtagttttcagtgtacacatcttactttatccctaagttatttcatatttgatgctaatgatctttaattttgatttttgattttttttttattgctggtatatagaaatagaattgactatttactattaatattatttcctacaaccttactaaacttgtttattctggtaccattttgtagattctacaaaatgtagattttctacacagataatcgtgcagttttgattgtacctttccactgtggatgcctttatttttgttttactttagacttttattggaaatacagcaggacttatttgtctttgtattccctttggggtccctccccacacatacctttgatgacttttgttttagattctttgtagcgttagcattgttctgaagtcagaactatgtatatatctataaaaaaggtatacttgggctgggcgtggtggctcacacctgtaatcccagcactttgggaggccaaggcaggcagatcatgaggtcaggagttcgagaccagcctggccaatatgatgaaaccccgtctctactaaaaataaaaaattagctgggtgtggtggtgcacacctgtagtcccagctactcaagaggctgaggcaggagaattgcttgagcctgggaggcagaggttgcagggagccaagatcacaccactgcactccagcctgcgtgactgagtgagactgtctcaaaaaagaaggtaaactcaaaggcggtcactccatcttttttgtcatatttctttctcatctacatcctcttcccatctgcaacagaaattcaacttttaattttacctaattcatacttttcacactttgggtccttttcactattctgttacggttctttaaagtaactgcctctcagattttactaaaaatgtaaaatttcctctttatgaaacctagaacacattggtagacaaaattaaagatgggagatctggtggtatcataaaagaagaaattcgtcaaccagactgtgggtttcctagatttttgtttatagtaggttgtatgttatatttagttgcatttttccccctagagtttaggttccataactttcatcatattttcagagtaatttatttaaaggaaaaaaagtggccaaaattaacctttagaatgaataagtctgggcctaaccagtgtgaaggtatggtcactgaacctcctgtttctcgagtctttgccttctgaagatatgtgtattgtaatagatgacagccgcttgcggttaattcagtaatacatgtcagctccacccctggcacttttaaaccttttggcctactattttgcaaaacagatttttaagaattagtatgcattttagaagtttcctttcaggttaaactttttaaatagttattctttaataatgctgttaaaagaattttgggatttctattgccaagtcactaaaaagtaactcaggcagagaagggtaagggtgctgcaagcacacatgaagaattaacattttaaaagaacctttgagcaccttggcacctgtggatttcttcttggatgtctcatgcctaaaagcagagcagcatactgtaaaatcagtaaaagtaggaaaggacttgcaagtagaaatgtttcagcagactctcgcctcccccatctccatcctcactctgatgttaagtgtggggcccattgggccagatacaggtaaaaaggtgggtgatgtcattaaaaggtattgttacttatagcttattatatgtgttaaattttaataagaattttcttttttctttctcccaagccaaactggcaagacgcagtcaagaacgggacaatcttggcatgttggtctggtcacccaatcaaaatctgtcagaagcaaagtgtaagtcttggagcactttattttccacctttcttgtttaatgtaaggttttaaaggtacctttgaaggtaaaagcttctatatgtattaaatttcttttctattttaagataaataatttaaagagttttaaagtgtatatttctttttttaaaattttttattttttgagatggattctggctctgttgcccaggctggagtgcagcagcacgatctgggctcactgcaatctctgcttcctgggttcatgtgattctccagccccagcctcctgaatagctgggattacaggcacccattaccacacccagctaatttttgtatttttagtagagatggggttttgccatgttggccaggctggtctcaaactcctgacttcaggtgatccgcctgccatggcctcccaaaatgttgggattacaggtgtgagccactgcgccctgtgatctgttccatttttgaacatgttctttcttacagagcactaaaaatctgcctccctgtaatttgtaaaagctttgttttcctgaactttgctaaataagtttgcttccatatgtgtcctttaaatgttcagtcatcgtatctcctttactgtctgagtccaagctagttgcttcaggtgccttttcagatggtttttttggggatctcttttcatctcctgttgtccttctaagtgtgttccagttggccacaatgtccatcttaaattgtactcagaactgaatatgaagaatactgagcattttttgaacctttatgccagcacagtactaaaatgtttttcatactcctgtatcattcagtgttcacagtaacccaggaggaagattttttctctgttttacagatggcatcccatagttcaaagagtcagagggttgtaaaagtagcacagatagtgagtggcggaaccccaagtagttcactcctgggtcataatctcacttatttctcaggctgtgttcatttagcctgttagccactatctttctgttattacagtttaaagttgtattagtcacttttcctattgtattgcttattggagtctttggagtcagaatttaattttaatgttatcttatttttcatagacctagaagaaaagggcagaatatgtaaagttaattgatttttaaacagtggtgttgcctataaaataaatttacagttttattgtaagccctgattacaatcgttttaagtttaaagttggttaaaactttaaactttaaaaaaactaacctgtccactgaggctcccagtggacagcgagctcggcttgtggctgagacacacttgagccaggccagaggcataggaggaccaaatttgacagatatcaatacacgattcttactgaggcctttgaaacggacccttgtcctggaattactgtcagaaaagaaccggccagaaaaacagactcccgagccacgagtccaggtttggtttcagaattggagaggtggagcacggaaaagaagccagagcagcgccagcgtggaggccacctgggcgcaggtccccccgatcccagaccctggtcagcctggggtgctgacccctactgttccaccagcggggcttccccgggggtcccaagcaatgtgggcaacttctcttgggaatcggaggatgctttgggccaagctctcctctgggggcgcgctgatgttccgtgcgcgaatgtggcccccgctgacctggagatggcagccagtgcgctcggccacgcttagggagatgtcccttgatctccgccctcgggcccagtgctgcttccgggtccctcttgccaccagcccttcccacagctggaagctggcagtgctgggcctcaagttcatcccggggcacccggcctgctccccatacaccagtccctagctctgcgggggctggggctgcaccctcctgctgtggagcagcagccgaggtggggctggcagctgggggaggcgcctgggtgcgccgtgacctgggagcagccctctccgccccagcccccgcagctctgaccgtatcccgcctctctgcctctttcctggccatagtcacagccacagccatcgcaggacccggctgagcgctaggaacaggttccttgtcttcctccagaatccaactcgcacgggaggccccagcacccctgcccccaacccgctgcggagtctgaacctcaagcggctgcatagcaaacccgtggaaatgacctgtcagtgtcaggcagtggaagacagatgaactaagcaagggctcatcggtagtgttcacgttatgaaaattgaagagaaatatcaagatttatttactttgtcacggaagggcttccagacatacctttcagggaaatcgagttgttagggtggaagggccttggggtgcatgagacctaggggttttccttagatggcataaaaaaggattgactttatagaatacatctgtctttccatttattaaccgagtaaacacggagcactgagagtgaacaaagtccactagcgagaaggcaggatgaggacggctttgtagaaatgcattattttctatcaggaaagagcaatgatttctactctgggaaaaaaacaaaacaaacacttacctaaaagtaatatttacatattgttgaaagttcatagataaaagtataaagaataaaaaaaattcacctattattccatcacccagaggtgataatcgttaaacattttggggtatttcttccaattttttttgtatgtatttatataagtgagatgatagattatctgtgtgtgtgtatgtgtgtattgtcttcctgagcatcggacctaagcagtttccacgttgttaaaactgcttataaaggttttaaataactaggtgtaatactttattacatggatatgtcagtatgtttaacaattactctattgaaaatttaggtgtctcagttttggaagaatatggaagtcttggttgtccagcatttattctgacattaagtagaaataagtgatttaggacatatttctagcagatactaaaaaactgtgtataggatgtctggagatccctggcttttcttgtgtgtgtgtgtgtgttttttttttcctcttcttttcaaagtggctgttcagagttctgcctcttagggttactgaaagcttataaagttatgttgtaattataaaaataaatgctattttagaaaattcaaatagtacataatgcataatatataattgttttccacaaaatgtgaactgttatcagtctgctcataagtacatctgggactttgtttcatctcagtatatctacagttatctaatttttttttactgtaactagtatggatgtatcataatttagcctttttttaaacaaaattacctgtattacctattgatgaatatttataatcttagttctttttttaaactctgttttttaaaaaacctgatccgtagaatgactctagtttaacattaatgaattgtacatttcttttttttttttttgagacagaggtttattcttattgcccaggctggagtgcagttgtgcgatcttggctcactgcaacctccacctcctgggctcaagagagtctcctgcctcagcttcccaagtagctgggactacacacgcaggcccctgcacctggccttgaattgtacatttcagaatagctagaagagggctgagtgcggtgtctcacccctgtaatcccaacagtttgagaggctgaggcgagctgatcacttgagctcaagagtttgagaccagtctgggcaacatggtgaaaccccatgtctctcaaaaagtccaaaagttagctgggtgcgtggcatgtgcctgtagtcccagcacttggaggcagagatgaggatgcttgagctcaggagttcaagaccagcctgggcaacatagatctcccctctattaaaaaaaaacggggaggcgggggctagaagagaataattttgaatgttcctaatatagagaaaatgtaaatatttaggattatggatatcccagttaccctgatttgattatatgaatgtatcaaattatcacatgtaccctggaaatatgtacatctgatatgtatcagtaaaataaaatacatacattttaagagaggatcttggctctgttgtccatgctggagctcagtggcacagtcatagctcactgcagccttgaactcctgggctcaagctgtcattttaaaaaaagcaatagtgaagatttttgccccttaatacatttcttattttcttgtttaaaatagattttatattttagagacattttagcttcacagctaaattgagcagaaggtacagagtgcccatttatcttctgcccccacacacccacaccctcccccagtgtgaacatcctgcgctggagtccaccaaagggatacgtttgttacaatcaagcagcctacagtgacacattcttatcacccgaaattcatagtttacattaagcttcactcttgtgttgtatgttctgtggattccgacaaatgtataatgacctgtccaccaatgtagttatcatcgtttcactggtttaagaaacctctgtgctccacctgttcatctccctctctgcctcctaaaccctggcaactgttgatcgttttactgtttctgtagaatgccttccagctggaatcatatagtatgtagccttttcaaattggcttctttcacttagcaatatgcatttaaggttccactgtctcttttcatggctggatagttcatttctttttagtgctgaataatataccgttgtctagctatgccacagtttatctggtgtattgtcatgctaggaacccctctcccacccccacattacaaacagactgatgtcttctgtcgtcttctccttttttacatcgttgtttcaactgaaattattggattatattttttccttcacttacattaaactcatacatactttgtgcctggacttcattcttttcagtgtacctggctctatatttattcttttaggtgaatcttagatttgtggtaacaagttctgtccaaaagtatctcaattcagattatacggaattcgtgtttatctactgagttttcatttacgttttatattgaacagctttttgtctgggaatgtaccaggagtgaaaggttcaggaatctcatactgtaatggagagacagaaaaaatgaacatgtgagcaaataatttatgtgtagttttcctaggcaactcttcctttttagaggtagaaacactggggtctacagaagtaaagtcaagtgtttaaggtcccatagccagttattacagtagccaagttttagctagatctcttgtctccagacaatatttaccacacctgtctgcctttgtaggctgcttcatttaataaactgtaattcaacgcttaaaacattaatactatactagtttttttgggctgtgtctaagtaaaacccatttaatgagagatataacttatgggatatgcctagaaaatgtggcctgtagagagacatttcatgttgaggaagcgtaaataattcccaataacatagattagaacaatgagtttaaatattaagtgatcatggaaaattacttgatgaaaccatggcttgagatttcagcaacaaaggagtgaatgaagtacaatctgccatcatgtgtaatctggagggtggcagactgagaaactgaaaaatgttcacttattggagaagagtacagttgactcatatgatttttacatcaagcatctcccatgtaccactgagtcagtattctgatgttcccgttgggactcagcagaaggtgctagctttcctaggtagaaacaaagagttgaagatggttgacatttgattgaaatgtggaagaatgagtaggagtttgctggctggaccaggggcataagtgcacactagacagaagaaatgatagcatttcctttttttttttttttttttgagatagaggtctcgctctgttgcccatgctggagtacagtggcgtgatcttggctcactgcaacctctgcctcctgggttcaagcagttctcctgcttcagccctgcgagtagctgggattacatgcgtgtgccaccacacccggctaattgtgtgtttttagtagagacagggttttaccatgttggccaggctggtcttgaactcctgacctcaggtgatcctcctgccttggtctcccaaagtgttggaattataggcgtgagccactgcgcccggccagcattttcatttttaaaggtgtgaagatgtggagaggaaatccagcacttaattttggagatttgcctgactgtgacaagtgttgtcctggggcagagagaaatgaaactagaaaggcaggccagcttcttaaaggtttggaggatctcttgacggagttttagctagaactgatatgatttacactgaaaagctcttgacagtcctgtggtttagagaagagtagagaagaggtttattggtggtagtaaggtgttgatgcaattccaagtcagagaagttgattgcctaaccgggtcagtgctgttaaaaggcggcatgatggaaattcaggaagtcaagtcaggagtatcttaacttgccccaaagagatggagaccatagaattgtgggcttagtgactggttcaggcagcctttaacatgcctgtaaagactattaaatgccgttaagtataggtgcactgttccatcatttactccacacgtttctgttgaacccctatgaggcactccgttgctgtgatacggtatcatctctcctcagtccccactgtgatattgtgcagccaccctttgcatggattccacaccctacctctgcacatcctgtttataccattccaggctgcccgcctttggggactccatcctcattccagttgatctgcaccctaaatgcccaccttgctcagccctacccaccagctttaggataccacctcttgccttcatgcagacaccactgcactgcgcagtgtacttttgacagtcccctcttgtcactgtgcttacgtgtagacctacctcaagtttggacttcgtttgtttagagaagcagctgaacgttaacaaagtgggcgtattagagtttaaaatatatgtagagtttaggccagattgtaggcccagtctggttccttttactgacttaggaaaaacaaagtttacccaggcacgtgtggttaaatataatgcaaaactgtggtccaagggtcttaatgaaatggatagattaatctgaggattttttttttgttgcttgattattattattttttttaaggtagggcttgaaaagaaggggagtggaactagaggggaagctcgggtatagccttgtctgttgtttatagtctgctttttaaaaatatataatcaactaaattgctcatgctgaatgatgttgatagttcccagaaggagcaaatttctcagatgggctgctgttgccttgggtgtagaatttagcaaggtgacttttggctattggatatccatagaaacagatggtcttgctcatttatgcattatgcattttataagttatatatagtaagtgtttgtgcagttatttaagtgtttgcattttgggttttttattttataaaaatgaggaaaaactggtccagtggtaagaatcatggatctctgtgttaaaatagacaaaaatggaaatcgttagctgtgccaaaaacaagctggctgatttttttgagacagagtctcgcactgatgcctgggctagagtgcagtggcgcaatctcagctcactgcaacctctgcctcccaggttcaagctattctcctgcctcagcctccctagtagctggaattacaggcacccgccaccatgcccagctaattttttgtatttttagtagacacggggtttcaccatgttggccaggctggtctcaaactcctgaccttgggatttgcctgcctcagcctcccaaagtgctgggattacaggcgtgagtcaccgcgcccggcctgattttttttttaagctagctattaactatataaggaaaaaaattgcatgtaacatggtggaggtagataatttaaagttgtgtcaaaagacaagtttaagttagggatttaaaagtaagttttagctttcttggaataagagccgtacctatgacatacgcacaattcatttctactttaggatgtttgacttactatattgtacatgaaagtttagagtaatatgaataatgtgtaatatatcatatataattctaaactttcatgtagatacatagtaaatgtcaggtgtctctattcagagcatcccagtagcttttcaattcattgtaagttaaagtcaaaagaacctgacacaccctgggcagcatggcaaaactccatctctacaaaaaaattaaccagtcatgatggtgcacacctgtagtcccagactgttgggaggctgagatgggaggatcacttgagcccaggaggtccaggctgcagtgagctgtgattgcgccactgcactccagcctgggcaacagcaggaccctgtcttaaaaaaaggaaaaaagaaaataataataacacaaaaaaagaacttgatgtccacatggctcaccccccagttcattctggttattgcttaagtgtcactatatcagagaagccttctttgaccacacaaaccactcactgtcttaactcactttctttcattctgcttatcatcaccggacatcgtattatctactttatgtctctcgtctctctccactgtagtgtaaaactgagtggaggaacttggtatgtgtgttcagttctctgtcagtcccctcttggcatgtggtgggtgtataataaataagttattgaatgaatgagaaggtggtgggagtgcaggattcccctggatagagatttgcaaatacaggcttttctgccatttgctctgtaacttgggttgtctggaatcttataacatttccttctttgtcccttaccttgtggctatcatttgtttactcagtaacttgcacaactgcttgtgtaccaagcgctagcaggcactggcgaaatacacgaacagtccgacaagtccctgcccaagtgtagcttacagtctacgggaagctgcactggtaaataagttcattgagcgccgtgaaggagaagtgtgcttaaacaaataccacatattctcacttacaagtgggagctaaacattgggtgcacatggccataaagatgggaccaataaataagacactggggactacctaggatggggagaggtggggacaagggcttaaaaagaacctgtgctgagtgagtcatgggttcatttgtaccccagacctcagcatcacgcagtgtgtctttgtaacaaacctgcacacgtgcccccgattctaaaataaaaagttgagggaaaaaaacaaaacaaaacaacttattctttgacttgggtgtgagcagcagtagcgatagggtaagcctatattggcctagttttcagctttttaaaaatatatggctagaagaggttgaaacttgtgattaaaatgagtcttttgagtgtgtgaaaagtattttcatcactttaatttttttaagtgctctagaactagctaaaatgggcaaaacgtactagaataaacatagctgaatgagttgaatttacaaactagtggaagccttctattaaacagtaatttaccttgtaatcatattaatgtctaatctgtatctttatacagaaaaacgtttcattgtgttcagttttagtttatcctttctgttgacagtggacatccattatcagttcttgactattacaaatattactgctggggaagcattcttggacctatttcttgatgcccatctagaatatatatgctaagttctgagagatcagtgccaaattattttcaaagtggtcaaactggtttacactgctaccagcaaaatgcagaatttatttgctccacatcctctccaataattgctgttgttggacttatacgtgttagaccagtctagtgtgagtataacactgtttcatataccaaggaattttgctgttttagttaggtctgttaatggcattggtgttatgaaacaaatattcccacattttaaaaagaggtgtatattgatatatgtagggatgaaatgaaataattgggatttactttaaaattcttcagcacatgtaaagcacattttgggatcagttcaccaaattgttctgtggatgcagattaaagtattgtttccgtgtttaatttactgtcctgtggttatgtaggacagtatacctacccttagaaaacacttgctgaatgtttaagagtactgggtcataatatatgaaagctgctctcaagtagttcaggaaaaagttaacacacacacacacacacacacacacacacacgcttatttttattattaaaaatagcctctaacttaccccaccatgtggacataaccactattaaagtttgcttccggatcttttcggtatgcttatatgcactctgattttaagcacaaatggttacatcttctatgtagtggttttcaactttaattttcctgcaattaaaaattaaaccgagttttgatcctgaataatatcacatcttgtagcatactttattcaactacatctctccttccttccttccttccttccttccttccttccttccttccttctttttctttttctttttttttttttttttgagacagtcttgctctgtcgcacaggctggagtgcattggcacagtctcagcccattgcaacctccgcctcccaggttcaagcaattctcgtgcctcagcctcccgagtagctggaattacaggcatgtaccaccacacctggctaattttcatatttttagtagagttggggtttcaccatgttggccaggctggtcttgaattcctgacctcaagtgattgacctgcctcagcctctcaaagtgttgagattacaggcctgagcttctgctcccagcccacatcccattcttgaacatttagatgttcttcttttttcctcctataaataacacaagtacacaggaatttataatgtcctctccccagttgaaaagaaagccctccttaattctgcagatcaggtttctcaattatgtgcattcatagttctttttctcggtcacttacgacaattggaattcatttgtatgactatttctctctctccagtcagacatgcgggttccataagggcagagattgtctattttaatcacagctatcaaagcagcaccaggcacacagtaggcctgaaagatttgttaaatcagtggagaataatttcaacataaacaatatattttataaaagatcactgtgttgcaacttactttgaaagctcttaaataacttgtttgtatagcagtgcttatggaaggctactctattggatgaagaatagaaaaccctccacattgcaaacagtgggacttaacagtgggagggcctgcccctcccaactccctctcacaggcaggagagcctgccctctcatactcagtctcacaatggggtttagcttccttttcagagctaaagaacccacccagccttcctataacacagactctctttcatctttaatggacagaatcaagattattgctgccagagatagaaagttggggaaaagtcctcgagggtccccttctttgtttggagcaatttgatgcaggtagcttgtatttctgtttatctgcttcctgtttcgtcttttatcttttatccatcaccttaagcatttatgcttttttttttaatcttaagaaatgggggttcactgtgttgcccaagctggtctcaaactcctgggctcaagtaatcctcccgtcttggcttatcaaagtgctgggattacaggctataagtgtgagccactgcatctggccaatcttttgttttttgtatgagggtagctggagcacttttaattttctaaggttaaaaacttacctttgcttcacttaaggaaaccatgtgagagatcttgaaaaatgcacttttcattttcatcactgccctaccagcaactactggtgtactctgccaagataagcttcagacaagtcacttctctggggattggggttggagactgacttattctgtaaagtgggattttaacaaactcccactaagaaatagctttaaaaaatttatttttttgagatggagtcttgctctgttgcccaggctggagtgcagtggcacaatctcagctcactgcaacctccgcctcctgggttcacgccattctcctgcctcagcctccccagtagctgggactataggcacccgccaccatgcccggctaatttttttgtttttgtttttgtttttgtatttttagtagagatggggtttcaccgtgttagccaggatggtctcaatctcctgacctggtgatccacccgcctcgtcctcccaaagtgctaggattacaggcgtgagccattgcgcccggccaagaaatagcatttttataaagaacgtacattttgttacctacttggaaggacggattgatgaaatcctcaggcagagtctctggcttggcttcctgtgctgttttccaccccagagagggagcgttcagatgtttactgtagtaatgtctgtacccaccaggtggcacaattgctttacttaaatgatttaagctcattttgattctcagcgaggtgtgataactcatttcttattttaataataaaagatgccacaatatttgttactgtatttttaaagagaatttttgcatgttcagttgagtgatgagagagaaattggtgtcatgtttcctctgtggtacctaatcctacagcaagagtttcaaaaatatttttttaaaaaagctctaagaaggctataagccttgtcatcagcccaccatatggtgccagcctattgctttgcatagaatatccaagatcacacagtgttctgaatatctgcagtatctagggggagggaagggtgagttaaggttactgtggcaattttcatctgcatttctcccttcttttgcacttgagacttactgagggtactagggcatttcgttcattgaattaaaatgaatatagaaacaattgaagtttagcgtccatctgtttcttacccctgctttctgtcacttcatcaaccacagttctattaacttcattcaagctagatacagtatgttgattagccttggttccctgtaccaaggaggctgttctaatctgaagagcccttctgcctctatcttctctcctcaagagatagaactgtgttggctggtccgaagtagtgagttatctcaactgattcttcacaattgcagatggaactccttgttcttctctcttcctgcttctcactactggacccagctggtcttttttaaaagaaggaaaggagggaaggagggaggaattgtgcatagaggttgtttgtttttgtttttgttttagatggagtcttgctctgttgcccaggctagagtgcagtggtgcgatctcggctcactgcaacctctgcctccctggttcaagcaattctcctgcttcagcctcctgagcagctgagattacaggcatgagccaccatgccctgctatttttttttttttttttttagtagagacggggtttcaccatgttggccaggctggtttcgaactcctgaccttgtgatccacccacctcagcctcccagagtgctgggattataggtgtgagccactgcgcccagtgcatagaggtcttaaaccttataccttatctgatatttaccagctgtgtgaccctagccagactacttctgtgagcctcagtttctttgtgaatgagagtgataatggaactatcagagaagattaaaaaaaagattgtaaagagcttaaaacaatggctcataaataataaattctcagacgttagctgttgtttctgcttgtcagtatagatgccgaacctttaggaagcattccttcattgatcattattatcatctgatgacttggcattcccatactgtcctacatctgtgttgttatttcgtgtgtttgttctcttctgttgcctgtgtgttgtctcaagctactgtgggaaatcggttcatttttgcttatttcggcttgctatttaatacagtgctttgttcatggtaagtttaattcagtacatgcttgattaggcttttggaattttataaattttcttgaagaatgaggatttcacattctgtctttaagtgatattatgaggaagcccataactcattcacctatgctctccataatggtaaaacgcagtggatggattcttgtgcttctgactgacagattggaatgtcggccaggttgcacaggcaggcctgctttgcgcaccctgtacactggggaagggtgatgggtgcaaatgcctgggcccatagaaacgtgctggcattttcttgagcagcgtggactttgctcattgtcctgattagcgtttacttcatgagtccctgccctcagtggctcctcacttccagattggtgaatttttaatcgataagggacagaattaagattgttgttgccagagttggaaaagtccccacggatccctcttttctttaagagcagttttttgtaggtagcttgtatttctcctgctcctcttccttcctgtttcatcttttattcactgacttttaagcatctgcttatctttttttttttttttttttttttataagggtagctgggaacacattttattttcttgggttgaaagctttttttttttgcttcagttaaggaaaccacgtgggaggttttgaaaagtgcacttttcattttcattgctgtcctaccagcagctactggtataactctgtaaaggaacagggtaggtggtgggaagggaatagcatcagggattctgaaaagtatggcagctatgcatgtcccttgattaaagaaaacaaaagctgaggattatgtagagcaggaatacagtaagagacaaggtctgtcaacagcattgcttgtgcagatggctatattctgagtaaactctagtccagaacattctgtgaggagaggaggaggagtacctactgtggtgtcattttcccagttaggtgataacctggctttattggtgagaactaattcttgggaaggtcagggcgttgctaaagataacatagtcatacagtgctgactgtgtgccatgcactgctagacaaactcattttattttgagacagagccagaatttgacccgggtctttcttaccctgtacataacctgtgctgccttttatcttgtgggacaggaaacctcatatgttgacattgtacataatacagcaccccaggcattcattcagcaaatgtctgtctgatttttgttggacattgggaacaatgaaaagaatgaaaaagtgtatatttgctagtaggtattagatggtaattccttttacaggttagagggctcctggtacattaacttacttcatcacaaccttccgagcacctagtagacacaccatgtgtcttcatttaagtagttactacagtagagtgctttcttcctttactttagatttgagtcatcagggtgatcttccaagaattttttttttttttttggacagggtctcgctctgttgcccaggttggaatgcagtggcacgatcttggctcactgcaacctctgcctccaggattcaagcgattgtcctgcctcagccttccaagtagctgggattacagacacgcaccaccgtgcccagctgatttttgtatttttagtagagatggggtttcaccatgttggccgggctggtctcgaactcctgacctcaagtgatcctcttgcctcagcctcccaaagtgctgggattactggcatgagccaccgcacccggccatccaagaaaatccaaaagttacatgactttaaaggttaccttagtaagaataccttattgtttacaatatggcagatgtcctatataacctcagctgcagcattcgggatctactgttactgtcttgttgttcctgtcaccagctgattcttaagatataaagcaaaagaggagttgaaaatggagtagcattcaacaaatgcttgtgtgtgtcttaaaatttgtagctaaatctggttgcagacagtgggcacaggcattacaggccttgttactgatgtagcaggagggactctgagcagataacatatgcccaagaaccacaggcaggactagcccctgtgctgggccactccagggactcctgcatcactttttcagcctgtgcatgtgtttgctcaaagatcgtgctactggtgatcatacatacattccttactcagttaaggtagataatagtgtgctctgagacttgagatttacagcagaagcttaaggttcatttgttgttcattcaccaagtatttattaaaggaaggaacccttcaagccagttttaaacaagcagaccttctccagagttgaccctcaatttaccgcagattgttttcgccttctgtccttacatattcctgagtgcatctcatgacctggtttttaatcagctggcctgctgtctgtttctaggtctggtatgctgccatttgcatctcatctcctccagtatgaacccccatattacctgtgtctctctgcagggttctggccaggtatacagaaccacctgttcgagcagcctcatctgacattttttagaatctgagagcacttttatttggcataatctaatgtattgtgaaggaaaaagcaagggacacactttggagtaattccctgccctgcctttttttttttgagatgaagtcttgctctgtcaccaaggctggagttcagtggcacgatcttggctcactgcaacctcagcctcccaagtagctggaactacaggcatgcgccaccacgcccagctaatttttgtatttttagtagagatggggtttcaccatgttggccaggatgatgttgatctcttgacttcgtgatccacctgctttagcctccggaaatgctgggattacaggcgtgagccaccgcgcctggcctctgccctgctttttaaaatcaccagttatacttttgtgacaagctatggtcatttcatttgtcatttgctgaccttcaagtaaattgaaattttactgtaatctgagtgaagtaaccagtttgtaactattttaaatattaaatcggaaattagtggcttagtattagaattaatattgagctgcagtatataattagttattgtttgaattaggttgactttttcttttgtcaatggaatatttttccccaatttttagaatacatgcttctataagagttggaattctttttcaaaattgatttctgtttcctaaattggttgacagttctcccagagctgggagcatgcttttggtataatcgcatggcaaactaagttgtagaagctcagacttttattaggactcctctgtttactctttgtgtcatagtgggaaagtggatcactctgagcctgttttctctaagtttggccattgtacctagagagtaagatttaggagccaagagggaataggggctagtcaggattttactgcctacttcatacagttctatgctccttgattttttttttttttagcttgtgttgttgttatttttttaattcataaaggaaaatcatgcatgaacatatggcagtgctattgactagtgcattattttttcttgtacacttgggaagaaagactagaatatcctcagggaggaaattgattcatctttgggggtggcagcttctcctagaggttgagtcaattcattttccttggtattttccatggttcttgaaagctagccaccttatattggagtagtacatatttgaaagcaaataccaagcactgggtcacgtaatctatctcttaagaattttttaaaacataaagaatagtttgttcattattcaacctgagctgaaactaaaaatgacgcccaatttcatatttctttttactgctagacatgttgtttaaagtagtacttgtttgttgtagaaagttttaagtagaactaaagattttgtcttccttttccctttttctttttttgagacagagtcttgctctgtcaccaggctggagtgcagtggtgcaatcttggttcactgcaacctctgcctcccgggttcaagcgattctcctgcctcagcctcccaagtagctgggattacaggcatgtgccaccacacctggctaatttttgtatttttagtagagatggggtttcgccatgttggtcaggttgctctcgaactcctgacctcaaagtgattcgcctgccctagcctcccaaaatgctgggattacaggcatgagctgcagcatccagccctgactaattatttttaaaaattatttgtagagacaggatttcactatgttatccaggctaatctagaactcctggcctcaagggatcctcccgcctcagctttccgaagtgttaggattacaggcatgagcctttgtttttctcttttaaagaagactcataatctcatcaccaggtgatactgctgttaatatttgagaatattcattcagacgtttctctgcaggatcaataactattataatggttctgttttgttactgtgtgttctttatttttagtcttgtacaggacaagtgtattagtccgtttttatgctgttggtaaagacatacccgagactgggaagaaaaagaggtttaatggacttagagtttcacatggctaggaaggccttacaatcatggtagaaagcgaggaggagcgaggagcaagtcatattttacatggatggcggcaggcaaagagagcttgtgcagggaaactcccctttttaaaaccatcagatcttgtgagacttactaacaggagaatagcacaggaaagcccatcctccatgattcagttacctccagttgggtccctcctacagcacttgggaattgtgggagatacaaatcaaaatgagatttgggtggggacacagccaaaccatatcagcaggcctgaaatatacacgtatatcaattctagcagaccatagggtgtactctgtccctcagtttgtttaatggcatctcttcttgtttttcagtggatgaatacattgccattgccaaagaaaagcatgggtacaacatggaacaggtaatatcatggttttctttcttttgctgttaaaaaatgagtatttgtaactaaataattatatttttttcttctttgtattgagtagcagtgtttcttcattagcaactttttggtaattactagtagtgttacacaaactctggtcttctttttcttgttcaagatgaatattagaggaccctttgatttgaaaggcatatctgtcatctgcagatctacagcctttaggacactgattacttagtgattactaaggagctggatgcttgagcataatgctttctcatttgaatatgtgatttgtttgtcattcttctggttgtatcatgatgttttttgacgcatgttttcacattcttacctaaagtgttttaatattcaccattttgaatcattttcagtttgagatggagtctcgctctggtgaccaggctggagtgcagtggcgcatctcagctcattgcaacctctgcctccggggttcaagtagttctcgtaattctcgtgcctcggcctctcaagtagctgagattacaggtgcacaccaccacgcctggctaatttttgtatttttagtagagaaggggcctcccaaagtgttgggattacaggcgtgagccactgcgcctggccaagattttcttttaaatattgtttggaatgtactaataagaaatccacaagatttatttttctgcaaaagtgtggtgataccttatttcagctttaatgatttattttaaacacatcaagttggattaatgctttccatggcattaatctagatcttacaacctggaagttactgacatttcttatttttctgaatgatggaagttaccaagagtttagattatgtgaaattgtaccctttcttttggacttggccttacatttaattactctatcctggtcattgaagctacttttgattgcaaaatatacctgtatgaattcttaaggatggtagtcttgatcatttctcctttaaaaatgatcattagcatgaaaatttcctatattataattccagcataaaaattaccattagcaaagtattgctggatctcatcttacctcttttgttgcttattctatttctactttttttctttctaagctgagaagacctttatatatcatatatataacatataaatatatataatttttaaaataaaagaataacagcaattgttctttcataaattacttttttcatttatatattgaggcagtaaagtgtgatacttgaagagcacagatcctagaactatgctggttctgtgaccagaggcagggaaaggcagtgcctcagagaagaccttcagtttatactcaggctgatcctcacaatggaggcaagcctacaaccaaaagaaaacaaaactgtagtaaaaacatagcaaaccctgaggaagagtgtgattatgagtttactacattattagattcagatgtccaggttttaacagaaaaatcacagagcatacaaagaaatggtaaagtatgcccattcagtagaaaaaaattaatcaacagaaactgtccctgggaaaagaccttagtggcagatctactaggcaaagattttaaaacaactatcttaaagatgtttttaaagaactaatggaagatacagaaaaaatcaagaaaatgatgtatgaacaaatggaaataacagtaaggaaatggaaaacctgaaaggaaaccaaaatgaaattctagaccctaaacacttgaaatgaaaaattcactagacgtgctcaaaggcagattggaagagtctcaacaaagaacatgaagaaaggacagtggaaatgatttgagtctgagcagcaggatgagaaaagattgaagagtgaacagagcctaaggtaccctagggacacaatcgggtggactaacatatgcatgtggaagttgcataaggagtaagagagatagggacagagagattacttgaagaaataatggccaaaaatttcgcaaatttgttgaaagatgtgaatataaacaaacatccaagaaactcagtgaactccaagtagaataaactcaaagaggctcaccagagcacataatgaaactttgaaaagacagagaatcttgatagcagcaagagagaactaacctattacatataagggatcctgaataagcttattagggtatttcttgtcaaaacctttggaagccagaggcaatggtctgatatattcaaagcagcaagagaagaaaactgtcaactaagaattctatatctgagaaaattctttcaaaagtaaaggggagaaatgaagatattgtcagttaaaagctgccggagagtctctctgaagagaccacagtggagctgaacttgccaactggtaatcccatggtctataaattggacaagaacttgaagcccatcaagcccatgaataaaaaaagttcctggggatgaagagaccattcataaagccatggaagctgtggctgcccagggcaaggccaagaagtgaaggccagcaggctgactgctctctcaaggagcactctccctgcccaacccattcttcttcacctccctgctgcacatgccacaccgaccacatctgcaggcatcttacgttggagctgcagatgggaactcatggctcccattttcattgtaatcagttttgtctcctgcacccactcccttcatataatctagtcagatagcacctctggtgcagggagaaagctcctcttatccaagagagttgagaggtagtgactagggcttttgccagggcttgtttactaaggacctttgtgggaggaaccatgctgtcatgaccaaagaggagaagcaaagagggcctgcttgaccccaggacccaatcctgtactcttctctagtcatgccactgtcaggagagctctgctcattccagtggaagatgacagtaacctgcacggtgatgtgaaaaaacaacgatttcctccctgatcccagggtaggtggctctagaaggttgagagcaatcctgtattaagttcatgtgttggatttacttttacaaaaaattgtatgtataaataatacaaaacaaaaacccttctgagattttttattttatttttttgagatggagtctcactctgtcacccaggctggagggcaatggtgcgatctcagctcactacaacctccgcctctcgggttcaaacaattctcctgcctcagcctcctgagtagctgggattacaggtgcctgccaccatgcccggctaatttttgtatttttagtagagacagggtttcaccatgttggtcaggctggtctcgaactcctgacctcgtgatccactcacgtcggccttccgaagtgctgggattataggcgtgagccaccgcgcccagcccccttctaggatttttagtggcagttcaaatagtcccacatgtggtcatcagaaataagccattccatcctggacaacatggcaaaatcctgtctctacaaaaaattaaaatcagccaggcatggtggtgtgtgcctgtggtcccagctacttgggaggatgagatgggaagatttgttgagcccaggaggttgaaaccagcctgggcaatatggtgacacctcatctctaaaaaaaagtttaaaaattagccaaacatggtagtgtgtgcctgtagtctcaattactctggaggttgaggtgggaggatcgcgtgagcctagaaggcagaggttgcagtgagccaagatcatgtcattgcactctagatcacaactctatatcaacaacaacaacaacaacaaaaaaaaagaggggggaaagaagccattcctcacaccaatatgggataagctccttgacctctaagggataggattgcatcctgctgtgggttttcgaatctctcccctaccttgttttgtggctgtgaaatgcctcatgatcatgtccaagtatgtctttcactggctgatttccgaatcacgttctaattgcttggccctgccatgtggacccagtattcattttgagcataactgtactaaatctttctttctagatcagtgtaataaaggtgtaatgtgcaacttaaaataaataaaagcttgtgtctttttgtttgttttgttttgagacaaggtcttgctctgtcatccatgctggagtgcagtggtgtgatcatagctcactgcagcctcaaacccctgggctcagtcaagcagtcctcctgcctcagccccccaagtagctgcagttacaggcgcgcaccaccatgcctggctaacttgttgttgtttgtttgtttttcgtagattcatggtcttgctaagttccccaggctggtctccatgttctgagctcaagtgatcctctcacctcggcctcccagagtgctggggttacaggtgtgagccacaacacccagcctcagaaaatagctatagaatatatacacaaggaaatagaaaggaatttaaatctttcactataaataatcaacaaaacataaaaaggaggctggatgtggtggctcacacctataatcccagcacttcaggcagatcacttgagctcaggagttggagaccaacctgggcaacatggcaaaaccctgtctctacaaaaaaaaaactagctgcgcatggtggcacgcacctgtagtcccagctgctcaggaggctgaggcaggagaattgattgagcctggaagggagaaggttgcagtgagccaagatcatgacattgctcctccagcctgggcaaggagagtgaaaccctgtctcaaaaaaaaaaaaaaaaaaaaaaaaaaaacctaaaaaaacagtaattcaggaaatgaaggacataaaaaactttaaggaatgtacaaaacaaatagccaaatgacagaagtccctccttatcagtgattactttaaatataaatgggttaaactttccaaaggacagagattggcataatgggtaaaaattacaggatcccagtatatacaagagatttacattagttccaaaaacacaattttaaagtgaaagggtggaaaatggtatcccatgcaagtagtaaccaaaagaaagcaggagtgattataataatatcagtcaaaatagactttaaatttaaacaggttgtaagagacaaggacattcactgttggtgggaatgtaaaatggtacacctggtggggaaaacaggatggcagctccttaaaaaattaaaaatagaattaccgtattatccactaattctacttctggccaaagtgggtagatcacttgagcccaggagtttaagaccagcctgggcaacatggcaaaaccctgtctctacagaaagtacaagaaattagccgggtgtggtggcatgtgcctgtatcccagctacttgggagactgaggtgatcaaggaggattgcttgagcctgggaggtggaggttgcagtgagtgccactgcactccagcctgggtgacagatccagaccctgtctcaaataataataataataataataataaattttttaaaatttattttagaagaattatttatagtttctctgtgaccacttccctgatgatacatatgttgccatacttaacaaataccaccttcccttgttgctgtacctaacaagttatcaccatcctgaattgtatacttatcatttccaagaaaaatatttttattgtatgtgtaatttccaattaaaacatattgcatattgtttgaaaattaaataatttatttaaattgcttcactctttcttgatacttatacctatattaaaagacattatacctataataaaaattacatcacctgaaaaaaaagtatgtgtatattaccacagttacaaagaatagaaaaaggggcctctgacagtgtctgccacttagcgctgtagatgagttagtttgtctaaatatgaagtcgtttttacttttcttttgctggtctcatttccattttcattgttttttgtttgatctaaaattttactgatatcatttttgtaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatggtaagtagatgagaccactgagttctattttttttctcctatctaactctcttttgcagcatacttgagatagggatatcatactcaaacataaatattcccatttttgataaagttcccctttagattcagcttagtacatgctgctctgtggatgggagttttccagttacaggagtaaagcacttctagcacttcccatcctgtcgtctgtgactggaccctccccacccaccccagtccctcttgttgggactcccaaaagattagacccatacgaaggactttttttttttagacggagtctcgctctatcaccaggctggagtgcagtggcatgatcttggctcactgcaacctccgcctcccgggttcaagcgattctcctgcctcagcctcctgagtagcttgggactacaggtgcgtgccaccacggccggctaattttttgtatcttttttttttttttttgagatggagtctcactgtgtcgcccaggctggagtgcagtggcgcgatctcggctcactgaaagctccgcctcccgggttcacgccattctcctgtctcagcctcccgagtagctgggactataggcgcccgctaccacgcccggctaattttttgtatttttagtaaagacaggatttcaccatgttggccaggatggtctcgatctcttgacctcgtgatccacccgcctcggcctcccaaagtgctgggattacaggcgtgagtcaccacatccggcctaattttttgtatctttagtagagacggggtttcaccatattagccaggatggtctccatctcctgacctcgtgatccgcctgccttagccacccaaagtgctgggattacaggcgtgagccgctgcgcccggccttaaacatttgatttttaaagattacttttttatttaaataaaccaactcattttttatgtttagcttccagataaatctatagcaagtctggtgaaattttactattcttggaagaagacgaggactaaaactagtgtgatggatcgccatgcccggaaacaaaaacgggagcgggaggagaggtgagcacatggctggggtgttgtctaaccacttaggggactatctaagagccccagatacacaaaggcaaggcagaatgactggttttccctccgcgccttcctggtggaaccacatgttcatgagatgtattagagcgtgtcacattattcaggtattttttctcaccactctttccctgcagtcagtgaacttccattttgagtcagttaactttgacccattttttttccttcccatttagaaggggtggctccttttaataaaaaagaatcttttattttgtagtttgaggtttaacgtggtatatttttacaagattcatttggtgtgtttttatgtttgccatgtggaaacaaaaatacaacttagagttgctgcttctttttttgaccatctgttttttgtgtgtgaatgagaaagagaaacattttataatctcttagtaaggatattagttttaaggatagctcagtatggagaatacttcttaaccatcacttcctcagtcttatatgtagcatagagaagtagaaatggccaggtactcacactcagaaatgggctctggtctcagctctgaagattccacttacatgccacaggctacactgggatgtttaaggtctttaatttattttttaaaatgtgtaaaattgtacatactcacaggcaggtgacttcaacatgcgtcttccccaagcttctgttttccttaactctaaaatgaagatgtttgaagtccagaaggcagcatgcagacctagtggtttccttgttagggtggtgagatatataggtgggttttaaaaaatcctattttccacatttcctgtaatatttttatcaattaataataaaaaaataaaatgaaggaggatgaaatatatggtccccggtgtcccatctcaggatggaattttatcatttcaaatgaaagagtaacatgtgagaacacattgaaagttgagtatcacttttggagaattcaaacctcttggcccaagtataaattgagagtgatgttaagaacatctccaaagctcttttaattgtaagagcctataaaattatcgaccatgatacatctgcatatttttgcctctgacttatatactagtaggtttatttatggatgagtactcttattaacttttaatgaagctttttcatttccctagtttactgtctatatagtaagtctgttactataagcagatgcagtttactaagcagcaatcaaaattaaataatacagagtgggattggatatccttgagtgtgaaataagaatacctgccaacacttccattcttactccctggaggctttttttttgcattagtcccgatggggccaggaagtgctttgcctccacctcccatgtgcacctcaaccacttttgggatgcggggatggaggtgctgcagcagcacctgataaattgttggctttctaacaggacttgcctgtgaaagtcatggcagggactgggacaaaattcccttagccgaaggctctttcttgttgtggacactctttcctcagctagagcttcctgctaccttggtggaggatggggaggaggtggcgcgtagtgggcatggtcccgtgggatggattccagaggcagtgcgaggtgggcaaactggggcaggctacttgacttctgtagacttagttttctttttttacagttgcattcctacctacatcggggcttttcttgtttctttgttttaaattaaatgaaatactacattcaggatattacaaaaagcatttaaagtgctataccaatgtaagttttctttttaaaattaaacataattttaaaacatcagttgtccaggacaccagaaaagcctcagactttgtgtggccttgggtagaaagacggtacttggaaaaggatttttttactgttagcaggtttattcccaatgcagtggaaatttattctcccataatttctcagttttgtttagtaatcatatcctagtcctcaatagataattatgagaaaataacatgtaaatgcattttcattttgatattttcagtttacagatatagagcaatagtgttttagatctggattgggaagttaggaatctattttagtagtttctcatcacttagactgaaagaactatggagttggtattctgtttgaattacaaagatgtttttatctcagcagcctgaaaacatactaattttatattaaatcagtttattatttatatttggtaaaattagtacaaaattttcagttaaatcaatttatcgtttgtattcggaaaattagtacaaaataatcattcagtaacttgttcttgtcttccagcgaggatgaactggaagaggcaaatggaaacaatcccattgacattgaggttgatcaaaacaaggaaagcaaaaaggaggtattttttccccctagtattgtttaggcgaataaattttattactagtttcataaataaaacattcatgttgcttgttctacttaatatattaagtgctatgtggaaagcagcatgatatgactatttttcaacaatactgtctttgctttatagattgtataattttgtttgctaatagatatgaataaaggaaggcttaaaggatagaaaatagcactaatgagtaatgatgttccctagaacagcagtcctcactgactttcttcgtaagccattagctcagtaggttaacaagtggtctagtgaattccaggcagccttagggtctccattcacgctatagatgccccagcgtctgcccatcctaggcacccatgccgtgcctggggtgactgcagggagctggcagggactcggcacagccctcctgttactcagaagcagcaatttggtcacaccagggggagccaggaccatcctctctcacatggtgactgtttcatcttatcattttaaaaaatcattatacaagagattgtagtttctggattcagggggctcgtgaacctctacaattgcatgtaacttttacataggttcatagaggtatttttccaaagacacagtctatagtttcaaaaaaatttctcagagagttctctctctctgctccaaattataagaatagttattattttaagcctataaaaacagaagggtctaaatttatctaaactttaaaatgacatcagtaatatatgtttcttatagacaaggtaggaaatacagctaactgaaagaagaaaattaaagtgatttataatattatccataatcactgtcaaccttttggtgactttttcctgagaactctttctgtaaaatgtatatgcctgtatattcataattctgaatctagtcactttttaaaaataatataatggaagctttgtaatttttagaaccttttaaatttactctaccttgattttttttttctcttttttcttttttgagacagggtctcctgtgtcacccaggttggaatgcagtggcaccatgactcactgcagccgccaactcctgggctcaagcagtccttccactatggccttgcaaagtgctgggataacaggcatgagccacctccagcccttgattttatttttttttattttgtttttgagacagtctctcactctgttgcccaggctggagtgcagtagtatgaccttggctcactgcaacctctgcctcccagattcaagtgattctcctgcctcagcctaccgagtagctgggattataggcacatgccaccacgccctgctaggtttttttttttgtatttttagtagagatggggtttcatcatgttggccaggctggaccttgaatttttttttatgtcaaatatatttgtatacgtagctatatattattctgtcacatgaatgtttcataattgagttaccttatcctatgtggatttcccagttgtttattcctcctgttttttgcttttataaacaatgctggattgattctcacataactcactatctgtgctcatagatttttttcattagaaccgattcctggaagttgtattgttgagtcaacgtgttctagatacattgttaaggcttttttttttttttttggttgtatatcaccaaattggaaattggtcgtttttttctgcataatttatatgaatgcccaaataagatcctgagggttagctaaattagattgtttgggaaatcaaattgtagttgtagtttttattaagctttgtgttgatgtattgctatttactaggtttttcagtggcacattttaaatgagagaaaacacttgatttcatacatttttataattcttatttatataatttctgattcagaaagaaaatggctaaatcattgttttttttttttttttttttttttggagatggagtcttgctctgttgcccaggctggagtgcagtggtccgatctcagctcactgcagcctctgcctcccaggttcaagcagttctctgcttcagcctcccaagtagctgggattacaggggcccgcaaccatgcctggctaatttttgtatttttactagagacggagtttcaccatcttggccaggctggttttgaactcctgacctcaagtgatccacccacctcggcctcctaaagtgctgagattacagccgtgagccaccacacctggcccgtagtttcttttttttttttttgagacggagcctcactgtgtcgcccaggctggagtgcagtggtgcaatctcggctcactgcaagctgcgcctcccaggttcatgccattctcctgcctcagcctcccgccattctcctgcttcagcctcccaagtagctggggctacaggcgcccgccaccgcacctggctaattttttgtagttttagtagagatggggtttcactgtgttagccagggtggtctcaatctcctgacttcgtgatccgcccgcctcagcctcccaaagtgctgggattacaggcatgagccaccatgcccagccacctggcccgtagtttttttaagtattaaaatgatactagaacagacgtagtcagttggtgatctttattaaacatcgtagtcccatacacagcagtttattgcctactaatatttttgtattacccacttgttgaagaaattatcactaccattatagttttgcagtgtctttagctcagtcttttaaaatatgaagcagaaagtcatattttcagctttatcagtgaatgctaatgcactaacaagatggaattatgagcaattataaaaacttcttgttcttaaaatggttaccagtaagttatattctttaacttgacaagattttactgtgtttcatttctgaaagttttggttttacagaaattaatagccgtcatgcattttaaaatgataaggtatattattttagagtaagttatataagttgccgtaaaaattgtgttatccaaaaatgtgtataaaaagctgtaatttcatgtagctaaatacagatgtgtgtgtggccacaaaactcattagcagagaatacagatttttttctttctatattactagaggaagctgagaattcttattttcattggcttgaaacgatagagtaaggaagtatttgtacaagaaggagtggaacacagtttcattgtgtttagtcaaaactcagtagcccaaattctgtctgtgaactgcctgttagaatttatagatctcatttggttctgatagggcatggtatttgtcttagattgttttggtgccatgttaaggaaataaatatgtttattactgatcatttgactttttttaagtttcattcatcacctgtgtatatcatgcaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacaggtactcata

SEQ ID NO: 163 - DNA, 87891 bp, Homo sapiens
ctgtctaacccccctgacctgaggttcttattgattatcctggacctaattattgtgctgtccctagcacccagtaggtgctttggagaattcatttggtcataagcttgggcgatgggaagggaggcagtttctagaagagctagcaatggaggataaggactggggggaggatttactaggggaataagtctagttcttgctttaactttgtcaggttgccctttagctttagctggaggcttttttagtgatgcaatttttaattcagttttgtttggaggtccctgaataccaatcaagaaatgctacccttgcagtaagccgagatcgtgccactgcactccagcctgggtgacagagcgagactgtctccaaaaaaaaaagaaagaaagaaatgctaaccatggagcttgtagaatcttattccctttcttttcttaggtgcctctccaactattttattcaaattcagtgttccccagagtggcactgaagacctaagtcatcttctgaagttatgccatttagagagtgaggcacaagaattaggactgtaatcagattacatataagaagcagggatttttccagatacaggagagaatttagacttagaggaccccatacgagctggtgatagttggtaggaatgtaatgctgtgcacttcgtgtctcaggtccacaacctgacagttggcggcctccgaacatagacccaatagtctgtgcccctggcaggtggaaaaccagaaataacattgcctctgggtcaaagccaagctctcaggagccaaattcaggatggaagaagaacctcatctggtttcattggtgacccacagcaaagtttgtccaatggacaccagtccaacaagatctgaaaacttccccgcctgtgaggccagcttgaacaacaggccaataaggcctttgcccatgttctgccctaggattctccttcttttgacaagtaacacttttagacagcacaacacaaaacagtagcacaaaaaatagaaaaaaaaataatgtggggagggatgaaaagagatggcctgattcaaacaagggcgccaaacaaataggaaccaataacaaagccagtgactcacctgagaataaatagccaagaaactcaacacaaagagagtagagttcatgcccagggtgtggcatcataggattcataagctatgagtagcaaggcaagaggggccttcgtgaatagtgcacctgtgtgaaggctggagtctgtgcagtgcacagtgcagataggggctctgtggagcctccacaataactatggaaatgaatgaagaccaaccagatgagaataaccaggcatggtttattcagagcctgccatagcaagggagtcagccaccattatttgtgcttggcagaagctcaatggcaggcagaggaatggtaaagctttgtagtgaaaaaagggaagtcttcaggtatgccctattggaggctattggcatggagaagctgcaggcaggctaacgagaaacagagcattctatgtcgttggttagtggtaagtatttgactttacctaattggtcctctgttgtacaaaagtaggtacaaaattaggaaagctgtcagttattaataaagtcctgcttgggggtaattatcacaggtattattgtttagcttcctggatttttgttagaagtagagatctgacaccctacaagtctgacttagaaatagcagactggtttcctgggctgtttaccacagattatgggttgacttcctgagctggttgctgcagattgtgggtcagagttctatttttatatatggcctggccattctctgtttgtatatctagtctcttgcatcaatctgatttattcatgtgtaactattatgagtttccagcatattttagagttttacatgtatcgttgacattatcttgcttgacacttaatggtctcttaaactgaagacttgtgcccatctttagttcttggctattctttcttctctcattgctattccttcattatcaattctcactcactccagaacttccgttacaaacttgttagtttttagatctctcctttacatttattaacttactttctttcttttcacctgattactcctttggctgtattttggaaaaattctttactcaattttccagctaattaattttttccttttaagtgtttatttgatgtttcagtacatctattgagaatttttcccctctaagttatatttttcattctacgaaggtaatatattttaaagattttctaagtatgtaaattatcttttttaaaaatcatattcttatttctattgctaattctttgtctttggatataaattctgccattggttgagtttgcttcttccatggtgtcaaatttccccctatatttgatgatttttatattgtgtgttcaccttggtgcttgaaatttcctgttaaattttccactatccagtatttctacactatgagaccttagcagtgttactattttggatgaaatgtgtctggtgagaatgggcaagggtggattgaatgagttgagtagtagctggcatttggtgcttgagctccctatgtttctgctggccctggaagcaatgtcctgcctctttgatttcagctcccacctgcagaaaccaaccctccatccctacccccacccctatggctgcagcctgggccctgaggagtgatacacaagattttatctctctagagtatctcaacttagcaccctatttgttgcttctggatcaccttcaggttctgacatccaccacctcaatgcatgggacttttaaaaatgagattttttcaattgtttatgatagaattctccttcaaggaatttccctgtcccctgatgcacacatacctagttttcttttctttatggggggtgggggaggcagggtcttactctgttgcctaagttggagtgtagtggcatgatcatgactgactgcagcctcaacctcctggcctcaagtcgtcttctgcctcattcctcctaaagtgctgggattacaggtataagctactgcattcagcctatactgaatttttttttggtacagccatacatttttattttaatgtattttctgtaacttgtctcagtttggcgtaggatgtagaagattggtacacatgtttagtttgcagtcttgtaactggaaactttttagtgtagtaattgttaaagtgtgatccaaggacccctggaggccgcaaagactcttttagagagtctaaaagattcttccttcttcagcctcacatctatgtgaagttgaattctctttatatacttcaaccaacacaacatattgcagcagattgaatgtacacatatgacaatccagctgtcttctattaagtcggacataaaagagatttgcacaagtatagaacattgctattcttctcattgtttattgttttgaaatatatacttatttttataaagtattactgatattaacatgtaatagatatcttatttaatgaattaaatattaaaagaaaaaataaaggttcatatttattaaaataagtaaagattttctattatcttatttttttattttcacaaattcctttggactattcttttcctctcattccatacattccccttaactaatttggtgttatacattgttaccattgttatagtgaatgaagtgaaatttttaatatttacaatttcatgagtctaaatgtaataaatgtattgttttttctcacacaaaataagaatctgttttaaatctgatcattccaatattgatgtgtatgcttttgtatgctacagtgttcattctaaattaatttttacagccctccagattagaaagtaatgtttttgttttccataattaatattggtttaaatttaccattttgcttccctatttctttttccatcttgaatcttccttctgaaataatttttcttcctcctgaaggacatattcttgaagttatttcagtgaaagtcttttttaaactctcaatttttgtccaacaatatctttattttgcacatgttcttgaaagatagtttgttttcccatgtatcaattctagattggcagtgacatttttcacttggtactttacagataatgtcttttgtcattctaatgtctttcgttttccaatattgctctttataatgcaaatatcactctaattcagtgattttcaaaagtggttcttagaccagcagcctcagtatcactttggagctttttcaaaatgcaacttttaaaaatcttattccagatttactgaacccaaactttgtagttggggttcagaaatgtgtttttaaaagtcctccaagtgattctactgcccacttaagtttgagagccagctatctaattgttatttctgtaaagggtaaaggtaattcatcttctatttctggctgcttttaaggatttttgtctttaatgttctacagactctgataggtctataaataaatttacttttatttattttagttggaatttattgggcttcctgggtctaaggattggtggctttcattaattctggaaaactgtaacccattagctctttaaatattgattttaccctacttcctatattcttcggaaacttcaattatacttatattggagcttctcactttacatttcatattttaaaattatttcctcatgttttctatatcttatgtttactatatttgggatcaggttttcagctattccccagagaagatttgtgtttacttctgctagggacacattaaattcaattttcttcttgggtttttggaccacataggtaatataaattcttccctcaaacccatatgaatgcagattgtgttaaaaattctcatgggtaatgttttttctttatttttattctattttatatggcaccaaggccaagatcagcatatctactcctctaccccaattttcctgtttttaaaaaaattcattcactgaggtcattgccttttgaaggtcctggctttcctgaagtttctgagcttacctgtatacttacttccatggcctaggctttgtctactatctcctgaacccacaaactattaaaacaaagacagaaaccaccaaaagattagcagatactctggggcaaaagctagctctagaattagcttaaccttgtggatttttgcttgcttgttgtttttttccctctactaattgggacatttatatctatatcttggtggttgagctatcagtgaagtgcattaattttattcaatattttgaaacatactgagcttcttgtcagttctgttaccaaacattgaggtcacttgaattatctaacccccatgacctcaggttcttatcactacccatactcctcattgaatatcctggacctagtgattgtgctggccctagcacccagtaggtgctttggagaactcacttggtcataagcttgggtgatgagaagggaggcaggttcaaattccctggggaacccacgggagttttgtccataagagtttaggccttattctggctcactgggagttttctggcctgagataacctgagagcaacttggagagggtggggttttggaagtcatgccccccttttccttcagtctcagctcagaaggggcaggcccaagagccatcagagaacctcaaaggagacaggctgcagatcagaacaatgaagtaaaagcagcaatcctggtttcctggatctagcaactgcagtaccctcagatgtggacccagaattgggaaattctctctattatgaatgtcacaggttgtaggatggggggaaaccccatcaatggatacagtaaagataggggcaaaacaaatatttgttgagtggatgagttcacaggaatttttctgaggcttggaatattattggaggttctagtccatgattgatcctgggctatttcagttcttttcattaaaaaagaatttttattgagcatccaaaccagccaaaaggcccaggctatgcttttgtggggtgtagagaagtggcctttttcgatgattgagggggccatatgggatagctaacatatcacctgggagatatcagtgctgatgcaaatgcttccaccaagcacatggcttgagatggggaaatagaggagacattccagaaacagagaaacgaatgtaggataaaagtgaagcagattgagaaaaaatattaacatggaaaaggaggtcaagggtgatggaggtaggctttgcatacacagagaaattgtagagggagtttatgtgttatttatgtggcaaaaagccatgggcttttgaccaaaaatgggccaggatatttcatgctaacaaaggcagtcgactgaatccatagacaggctgagattttatgttggggcaagagactacaggatatccttagagttctctaggagtgattgttgtggttggtttctagggcaggtggtgctgtctggtgtcaataatgactgtctcctgtggccagctgggtgtgacattatgtatccttacattaaatgtgattctggaaagtggcttcatttctattggttaacgttagccagctcctaaatcctagtttaatgctcatccaaagtgctaagttcctttgttcatgaactatttgttaaagtataaaataacttgggaattattctgcacgaaatgtcaagcggcagaacaaataactattcccctcattaatccctatgggcagcatctgtttgagagctttgcttttccataatgaaaatatgtcagccctgaatatatgtttgtgctattgagactgaacagtgaaatgaaatgaattctccactcagccacaggtgaaatatggcagtttgtggtgaatgaggcactgagcgctgtaggaagttgagactcgaactttgagaaaccttagggaggctaaaatcagcgagagaggggagggcagtgtgtgattaaagtgtaaagcaattccccaaactaaattcatcttaattcattctcatttataagagaaagctactccacatagtacagctgggtgtttaagaaatatgtggggcttcgttgtcctcgaagtcatggaaatcaggggaagcccaggggtgagggtttgatgtgcagaaacggtgtcatacagaaaggaaagagcacagactgtcagtgagcacagaatcataggacctcagggacagcccatccatctcacaggtgaggaatgtgaggcccagaaagggaaggaaattgtctaaggaatcagagccagtgaaattcttacccaacagggcctataatcagactagcctattcactcaacactgtgtgcaggatgcctagctctctgtcctctgctctctccagtgcagaaatcagtaattctttaagggcagggtctgatttcttcctcaaatagtgctgggtacctggtaaatgataaatgttgtgaattgatatattactggatttttcctcgaggtccagagtggtatgctttgtgtacagatgggtggagggatgtgtatacgtagttagcttctttttatttatctatattttatttttttaattatactttaagttcttggatacatgtgcggaacgtgcaggtttgttacatagttatacacatgccattgtggtttgcttttattttttaagtcagatcacatagccccacaacatagcagttaagaatgtcagctttggtgattgcccatgcaaggttcaaatcctcactctgccatttattagctgtgtgactttagacaagttgcataacttatctgtaaagtggaatgagacattgtatctacctatagaactgtggtgagacttctacaagataatgtagttgtaggtaagtagtcctggcctctaatgatggttataatgttatttccctttcatcctaactcactcctgcaccagttcccccatgacaaactctatgcagaggctgaactacatccacttgtgacacagtattctcatagcatagctctacattaaggcgttgttgcttttcctagcttgcaaagctgcctccaatcagtgttcttctccttgggagaatagtgtgaaccgctaaatagactgttaatgttgatgtcttcatttgtttttgaaaatggtcacagatgatcaggaggtgagtgaaagctgccttgagcctccaatctacaagacatggaaacagcattaccaaggtccctattttaagaactggccagaattttcataaaaattagacttggttttaatgagtctcattgttttgccagaatgtgattagctttttaaaattaagcttcgatttataggaatagaggtcaaatttgagaaaaataagtaggaagaaaatattcttgttatgtataatcaaatggtctctaagtcctttaaaaaaaaacaaaaacaaaaaggagcccgggtgcagtgcctcatgcctgtaatcccagcactttgggaggccgaggcaggaagatcacgaggtcaggagatcgagaccatcctggctaacatggtaaaaccctgtctctactaaaaacacaaaaaattagctgggcgtggtggtgggcgcctgtagtcccagctacttcggaggctgacgcaggagaatggcatgagcccgggaggcggagcttgcagtgagctgagatagcaccactgcactccagcctgggcaacagagcaagactccgtctcaaaacaaacaaacaaacaaaaacaaaaaaaagaaacattgaatagtaaaactaagaatagtggaataaaatagtaaaaacaactggaatgtcaggaaaagagaaccgccctctgatttggagagcatgtgctgtcagtcgtttagagtctcaagacccattgctgaaaacctttgcaaatcattatatggcaccaggattaccattcaaatttgtgatatttgaacttttggacagtagaagcttgacattgtagatttgtcatcgtggatctacatgaagcccacatgtagtatgattctattttatgaaatgttcaaaaaagggaaatccatagagacagaaaatagtttgacggttacctggggctcagcatgggaaagggaaaggactggatagctgggcatgaggtttcattctggagtaatggaaatattctaacattagatgtgctgtggttaacaactcagtaaatttcaaaaaggtcacacctcaaatgggtgggctttatagtaaataaattattcctcagtaaaactatttataaattcaacttgtgtgaacgatgaacaattcaatctgtgtaaaagtattgatcaaatgtcattgtttctatgaagtttctttttaaaaatatatccaggcagaactaattggtcagttttccttgttcctgttgctatttgctatgttcattattcactcaacagacagtaattgctcatctaccatgtgttgaacactgaggaataagagcaggattttttttttttttttttactgtggtaaaatatatttaacaaaattttctatttttatcattttaaatgtatggttcagtgggattaagtacattcacatttttgtgcaaccatcactgctatctttccccttattattccagatggaatctctgtatccattaaatactaactccccatcttctgttttccccaacccctggcaactactattctactttctatctctgtgaatttgactactccagttacctcatataagtggaatcatacagtatttgtcctttgatgttggctgatttcatttagcataatgtgttcaagcttcatctatgttgtagcctataacagaattttcttttgaaggctgaaaaatatttcattgtacatactgaccacattttctttatccattcacccattgatgaacatttgggttactatttcttggctactgtgcataatattgctaggaatattggtgtacaaaatattgctatgaatattggtgcacaagtatctgttcaagtctgtttccagtttctctggatgaataagtaggagtgaaattactcaatcatgtggagattttacatttacttttttgaggaactgctgttcagtcttctgcaatggctgtcctgttttacattcctaccagcaatccacaagatttccagtttctccacatccttgttatttatttatttggaaatagccatcctaaatggtgtaaagtggtatcccatcgtcgtttggatttgtatttccctaatgattagtgatgttgagggttttttgtgtgtgcttaatgatcattcatatatattctttggaaaaatgtctattcaagcaagtcttttgcccattttaaaaatcaggttgcttttttgttgagttataagagtttttaaaatatattattgatattaattccttactagatacagtatttgcatatatttttcctcttctatgatttgcattttcattctgttcatagtttcttttgcacaaaagtgtttaattttcattaagttcaatttatcaatttttttctgttgcctgtgctttttgatgtcaaatagaaatcattgccaaatccaatgtcttgaagttttttttttttctcttaagagttttatagttttagctcttacatttaggtctttgatcctttttggagttaatttgtatatagtataaggtaagggtccaatttcattattttgcaaaggatatccagtttttccaaaacaattagtttaaaagactattctttcctcattgcatggtcttggaaccctcactgaaaatcatctgaccatatatatgagagttcatttcttggctctttattccatttatctatatgtctgtctttatgccgttaccacccttttgattaccatagttttgtagtaggttttgaaatcaggaagtgtaaggtcttcaactttgttcttcttttccaagatagttttggctattcagggcctctttagattccatatgaattttgggatggtttttctatttctgcaaataataaaaaatcattggaatatttatagggatttgttttgaaactgtaaatcactttcagaaacatcttaatactatgaagtcttctatgaacactggatgtttttccatttatctatgtctttaattactttcagcaatacttcatagttttcactgtaaaagtcttttgctgcctttattaagtttcttcctaaatattttgctctttttgttgctatagtaaatggaattgttttcttaattccatttttggagtttcatcgttctttagaaatacagctgacttttgtctgtcaattttgtatcctgaaactttgctgaattcgtttattctaagtttttgtgtgtgtgaaatatttaggcttttatatatgtgagattatgccatctgcaaacagagttaattttactttttcctttctaatatggatgcttttatttttcttgcctaattgctctgtctagaacttcaaatactatattgaataagagtagtaagagcagaatgcttgtcttgtttttatgatcataaaagagaagatttcagtcttttgagtacgatgttagctaaacgcttttcacacatagcctttattaaatagttttcttctatttctagagtatttttgtcatgaaaaggtgtcgaatttgtctaatcagttgagataatcatgtgttattgtttattcttcactgtaattccaggtatgttatactattgagctttgtatgttgaacaacctgacattctgggaatacattccactttggcatggtttataatttttttaatatactgctgaatttagcttggtagtattgaagatttttacaagaatattattgatactggtctgtagttttcttgtagcatctttggctttggtttcagggtaatattggccttataaaattacgtaggaagtattctgtgaagaatttgagaaggactggtgttatttcttctttaattgtttgtttgaattcactagtgaagctttctggtctatagagtttgtttcttggaaagtttttaactactgattgcgtctccttattagttaggagtctattttgattttctgtttcttcatgattcagtcttggtaggttgtgtgtttctagaaatttttttcattttgtctatttacctagactatccaacttgttggcatacaacttttcatagcattctcttataatccttcttatttatatataatcagtagcaatacctcccactttctgttttgagtaatgtaagtcatctcttttttcttagtcaattaattaaagctttgtcaattttgtgcattttttcaaaaaataaacttttggttttgcttatttttctgtattatttctctattctctattttatttgtctctacattaatctatgtaattttcttccttatgttagctttggctttattttgtccttctttttctagttccttatggtttaaagttaggttgttgatttgagattgttcttctttttcaatgtaaacattcagagctataagttcctctctcctagtactggtattgctgcaccccacaagttttggtttatttattttcattttatttatgtcaagacattccctagtttcctttgtgatttcttttttcacctaccggttgtttaggagtgtattgtttaattttcccacacttgtaagtttcctcatccaagtactaactaggctcaaccctgttcagctttggagatcagatgagatttggtgtgttcagggtggtatggctataggttcacacatttgtacattttctagtttcccttttgttattgatttctaatttcattcaactgtgtttagaaaaaaatactttgtgtgatttctgtctttttaaatatatacaatttaacatcttaataagacttgtttcatgacataacatgtggtctatcttagaaaatgtttcataaacacttgagaaaaatgtatcttctactattgttgagagaagtgttctgtatatgtctattaggtccaattggtttatagtgttgttcaagtcctctatttcctcactgatcttctgtctggaagtggggttgaagtctccaactattattgtagagctgtctatttctccattcaagtctgtttgttttgtgtgttttggagctatgattttgggtgcatgtatgtctataattgttatgtcttcttggtgaattgacccttttaacattatacaatgtccttccttgtctcttgtaatcatttttaatgtaaacttcattttgtataatagtatatccatccctgttctcttttggttaataataatatttacatggaatatctttttccattctttcatcttcaaccatttgtgtccttagatataaagcagagcttcttgttgagggcatagagttagatcatattttatttatccattctaccaatctataccttttgactaaaaagtttagtctatttaaactaattattaataggaaaaaatttactcttgccatcttgttatttctgtgtgccttacagttttttcccccctcatttcctccattactgccttcctttggatgtgtgtgtgtgtgtgtgtgtgtgtgtgtgtgtgtgtgtgtgtgtgtgtttgtgttttggtcagagtcttgctattgcccaggctggagtgcagtggcaagatcccagttcactgcaatatccaccccctgggttcaagcgattctcctgcctcagcctcctgagtagctgggattacaggcatacaccaccatgcccagctaatttttgtaattttagtagagactggtttcaccatgttggccctcctgacctcaggggatccacccatctcagcttcccaaagtgctgggattacaggtgtgagccaccatgcctggccagatttagttgattttttttgtagtcacatgtcttgattctcttctcatttccatttgtgtatattctatagatattttatttgtggttactatgaaaattacttcttaaagttataacaatctattttaaattggtaataacttcaattgcatacaaaaactctactcctttacagctccacccccttcaagtttgttattgttacaaattacatatttatatattgtgtacacattaacctacatttataattattttttatttatttgtcttttaaatctcacagaagctgaaaactgttatgaaccaaaattacaataatattggtttttatatttgactatgtatttacctttacctttaaggaacttatatctttgtatggctctgagttcagcatcctttcatttcaactcgaaggactccatttagcattttttatagggcaggtctagtggtacagaaatccattagcttttgtttacctaggaatgtattaatttctccctcatttttgaagtacatttgtactgggtagagtattcttggcagacagatttttttttttctttcagcacttcaaatatcatttcattcctttctggtctccaaggtttctactgagaaatcagcctataatttattgaggattctttgtatttgatgagtcacttctcccttgctgctttcaagattctctctttggctttgactttcaacagtttaattataatatgttttggtgtggctctctttgggtttatctcacttaaagttcactgagctgtttggatttgtaatgttaggtctctcctcaaactcgagacatttccagctttaatttttcacaagtaatccctctacacccttatctcttcttcttctggaatcttcttttaatgtgcatattggtccatcttatggtgtaccagaagttccttaagttctacttgcttttcttcttttttctttctgtttcttagacctgttaatttctagtgtcctatctacaagttttctgattctttcctctacctgctcaaatatactgttaaactctttttgtgaattcataatttccgttattgtatttttcagctccagaatgtctaatacttcctcttttttttttttttttttttttttgagatggagtcttgcacttgtcacccaggctggagtgcagtggttcaatcttggctcagtgcaaactctgcctcccggattcaagcaattctcctgcctcagcctcctgagtagctgggattacaagagtgcaccaccacactcggctaattttatatttttagtagagttggggcttcaccatgttggccaggctggtctcgaactcctgacctcaggtaatccacccaccttggcctcccaaagtgctgggattacaggcgtgagccaccgcacctggcctacttcctttttgtaatttacatctctttgttcatatttttattttattcatatatcatttttcttatttccttgagtttttggtccatgttttcctctagctttttttttttttttttttttttttgagaaaaggtctcattttcacccaggctggagagcagtggtgatcagggctcactgcagtttcaaactcctgagctcaagcagtcctcccacctcagcctcccaagtagctgagagtataggcatgtgccttcgtgcctggctcctttagctctttgagtgtgtatatatatacatgtacatatacatacatacatacatacgcacacatatattagaccctaatcctctatctcttttatgtcacctatatattttttagtctcttgtttatgttattaattttgatggaggcaaattttttcatcttctccatttggctcatgtgtgctaagacttaagaaaagccttgctgactcctactgtcataagtatatttcttatatacttcattctgtcatttggattttttaaaatttgcagttgaggtgtcagtgaaaaattcaagtagaattatctaaatggcagggattgtttcagaatggagcagaaatcaaaacctacacttgacatacagattgagggcatctcaaaatggagactttaaaaccgtagacatagataagactgtccagagaaaacatgtaaagttagaagtgggacagggatgcagatctgaggtacactcatactaacagaactggttgaacaaaacaatatacaggaaacctaaaaggaatgtccagagaggcaggaggaaagccagggaatgatggataaaaagaaccaagtaaggcaagctttaacaagggttgagtagctactgcccttgacatcaacccgttatgattatgacaacttcaacccttttttttttttttagacaggatctcactctgtcacccaggcgggagtgcagtggtgcgatcatggctcagtgcagccttgacctcccaggctgaagtggtccttccaccccagcttctgaggtagctgggactacaggcacgtgccactgcgctcagctagttttgtttggtttttgttttttgtttgttttgagacagagtttcactctgttgcccaggctggagttcagtggcgtgatcctggctcactgcaacctatgccccctgggtttgagcaatttttctgccttggcctcccaagtagctgggattacaggcgcccaccaccacacccagctaattttcatgtttttagtggagatggggtttcaccatgttgcccaggctggtctcaaactcctgagcttaagagatctgccctccccagcctcccaaagtgctggggttacaggtgtgagccaccacatccagcctcaacctattttttaaaaagaggtattggccaggtgtggtggctcacacctgtaatcccagcactttgggaggccgaggcaggcggatcacaaggtcaggagatcaagaccatcctggccaacatggtgaaaccccgtctctattaaaagtacaaaaattagctaggcgtagtggcacacgcaggagaattgcttgaacccaggaggcaaaggttgcagtgagccaggattgtgccactgcactacagtgtggcgacagagcaagactccatctaaaaaaaaatgaattatttacgtttgtcttgttcaaggtggtaataactttttcaagcaggtaccagatcttactcactttcatattcctagaactgaatatgtttcctgcccatggtgccatccatccatccaacagagtgaaatctataaatctactaattaacctataaaggtttgttgaatgaatattttttaaatctttctttctttaagtcaatatatcaaagcaaatcttaccactaagaactttgagaaagtactgtgacctttatggccagctctataactaaagctggagaattggcttccagttcttccattagtcttggcctttaacatactaacatggcatccatgaaggtgcaactttaggagaaacgtggggttttacctgctgatttgagaagaattggaagtatgttcgcaaacaccaacaactctttaatgtaccctttaactaccttggagactttacattggtccttgttctcctgacattacttattttgtggatttattaagcaccttttcttgaactgtcaatctgtaaattgtctgtaaaatttagtccagagggtaaaggaatggaattattcataagatagtttctacctcagctcatggcgaaattactcactcagggtataattaagtcgtagacacactggcccaaaagtggatagaagggaaacggaaataattcctgttccaatttgggtgctttctgatgtttgacaagtatctagtgtattctcaaagataggggaccctagggtccccataaagggaagagaggtgagttgtgtttttttgttttgttttgttttttcagagaattggagaataactggctggggaggggagggaagggataagcagagtttaaaaaccttagggttgtaaacaggatgacaagagtgaaatctgataggtaaggtgtaaagttggagcctgagcgaggcaaaggcagccaaaagaagggctcaggtgagtggttctagagcagtggtccccaacctttttggcaccagggacgggtttcgtggaagacaatttttccatggatataggggtgagggagatggtttcaggatgattcaagtgcattacacttattgtgcacttcatttctattgttattacattgtaatatataatgaaatcattatataactcaccatattgtagaatcagtggaagccctgagcttgttttcctgcaactagatagtcccatctgggggtgatggaagacagtgacacgtcatcaggcattagattctcataaggagcatgcaacctatatatctagcatgtgcagttcacaatagggttcttactcctatgagaatctaatgccactgctgatctgacaggaggtagagctcagacggtaatgcaagtgatggagagtggctgtaaatacaggtgaagcttcactcactcacccactgctcacctcctgctatgcagccaggttcctaagaggccacagactggtattggtctgtggcccagggtttggggacccctgttctagactgagcaggcacagggcatgcatgtgccaggggtgctgcaggtgccaggccagaccaccggcaggcagacctccccaccacaatcagaagtcctgacagagctttattggctatcccctttgtctgctcatactattctgtagtgattgtgtgcgggacatggcctgctgaatgtacattccacccaatgaaatacaaacactcagatattgcagacaaagtaaaatttattgagacagacagaaatgcacctactcaggactacagttaagcatttactattaaccaaagagttgtgttcacattccagataagtctacgtggaaaagcattcagaatttactaggtttttgctacatcactatttcatctacaatagggacaacaaactgacactcaggatttgatgggctctcattacaatgctatacatttaacaggaacaaacatcagtgactttgagaaaaagttataaaaagaccaaaaccacccactgtagaatgggctcttggatgttactgtacagcgtggtcaaggtaacaagaagaaaaaaatgtgagtggcatcctgggatgagcagggggacagacctggacagacacgttgtcatttgctgctgtgggtaggaaaatgggcgtaaaggaggagaaacagatacaaaatctccaactcagtattaaggtattctcatgcctagaatattggtagaaacaagaatacattcatatggcaaataactaaccatggtggaacaaaattctgggatttaagttggataccaaggaaattgtattaaaagagctgttcatggaataagaataaaactgttcattaagaacttttcaaaagtgaattagtgaggattcagcttaatacctgtatcaaatgaggaagtggtttattacaatatttttataatcagtattttatgtgtacttggtcactatacaagtgacttcttgtcactggtacaagtggactttttggaggactatttccaagaagaagaaagcaaacattctacttctaaggataaggtaactcattacaatctttagtactcatggaaagtattaaagatctttaaaaaaatcgaatgctgtcatgtcaaagtgaggcatgaaaagtattattaatgtggctccatcgatttgggggttccaatctgaggagggctttttatttaatgttttaatgaatcaaaatatcttcttagaatgtctctgaaaatggcatctcattaccttactgggaactgtctattgagcactcttctccatcattaagttaatgctaaggatctttaagtgtcatcttaatttgatacttgtcataagataattaggcaaattaaaatcagtggttcaccctgttcctagaagtttttctaagtgaaatcaatttttcaattttaatttgttctcttgtacattttcctaagctcaaaggagatagtaacaatggttttctttgatgatctaaagtgagattttacaatgtcgtgatttttaatatacttcatagtaattttattgcaattaagcacctgttttctaaattatctcagttttgttcaagagagaaaaaaaatattgaaacaaaggtgatggagttgagatcccaaaacagagtttgcctatggtctgtcttcctatggggaaagtaagtacaaaacctcagggttatttacgaagccaaaggactttgctatatcaagtagttcatttcttatctaagaccaactataggtatgatgctactgtattcaggcaatgccgactggattggaacatgctaatttaaggtgagttggtacatctaaatggtcaatttgggatgggggattggtcagctgccactataatcatgttttggctgaacatatttcttgcttgagtttatgtggcttttgtgtggacaggctgaagttcatgggggaaggcaagagatagatatgtgggccagagaggcttgcttgggtggctgattctgattaggacaccctgataaatgaaaatcagtggcggacagtagcttatagactggtactgaaggaaatgggggaacttcagagactactgtttggtacttgtatctgggccagcttgatagggagagaaatcctaaggaatgtagagatgatgaccctaccaaatttggaactagactccaatgagtttagttaaaacaaacactatggtgaagaactttcttcattagtatcttgtcacttgggggagtgagggggggacagaatttgctcttaaaaacccagggtttgcttccatgtgttattacgatgttctttgtaggcctccatttgggattgagtggttaaaaaaaaaaatctgtacagcttttgtgcccttatcatgatttgtcagtagaaagggagtaaaagcaaaacattgagttcagaattagaaattttcttcttttaaggaacaccatggtactctcagagaacaggagatatgtgtgcatgccttagaaaaagcccttgagtaggtaaggaaggaagaaacctatggcagacaggattgctgcagccaaggggcttcaagcagaaatgaaagagatggcttgtgaagctgcccgtgtcgtgtgggagtcgcatggcttctgcgagaaaagtgatttaggcagacggaggttttttctcaatcagaggctttcagtaactctgctgatgcacagagaagagacttcctcagcctgcaggctacaagagccaactgttagtgcaaaaaaggactttaatacaaatttcttattccagaaattttgttccaggtctggacaagctgagaaatttatcattgtttttcgagtttttaagatacccaaacactttttctgagaggtatgggtgtgtgtgcaaggcacacacatacagtctttctgtacatgcatgcatatttatgcatgtacagggaagtatccagacaccaatttttaataaaatgaattccccaaagggagtcttgactgaattaaggctgttgtttataggaagccagatataatgatgtgaaaaaaactaatttttaataataatcaccggcagtaacgggggcagggggaaaaagtacagtgtggtgtattttttgtttttttctttttcacaacatctacaggacacaagagaagcacttagacactgtaaggctgggaaccatgctgtaataaccaccagtgtgggtaatcaaaaagggtctttgacatttaagagggttggggctccctgcactgtcagaattccacgtaaatcacatgcttgttggaaaaatctcacagaaaggaaggaggctctaattaagccaatgacttccctatccaaaaaataaacaacaacaaaaaaaaaacacaacaccctttctcccatacaaacatatgcaaaatcagaatcctctgggaacaagcagttgtcttccaaaccttaggtcgggtatagagagcaacaatggagaagagaccttggtgccttggagtcttagatacaaatgcaggaataggaagtgacttgcaattttgtgcaaaacttgtgtcctctttcttgtgggcactaccatatgtacccgacctcatcctctttgtcatcatcctcatcctcatcatcctctgtcacggctcgggtgtgcaccctcagcttcccctctttgtcctttggtcccagctcccgttcatattctaggtcatccagcaggaccacggacccaccactgccaaaatcccctgaggtttcctgctcctcttctgaaagattaaaaaaagcattgaggttagtttccacttatacctcatgacccacgtcaggggttcctttgcctgaattgtagggtaaaaccaagcagtttactttctgaaaacagaaacatccctgccccactgaggtgagtcttcagggcatacattacaaactttgttctcgtaagagccctagaattcttgagatgctcctaccttcccaggaggtttacaaccctaaatgagaagtgaaggcagcctaagtcaccctttgtctgcagcagttctgtctctcttctctggtcatagtgagttcctgccacttgccaagctagctacacgggagctcatgtgatttcagggttactatgcctctattataaacttaatgtatactggagttacctctcaacattcttctgcagagatccttatgcagtgaggaaccacaggccacccaggtcattgtggggctcatgcaggaggccttactcaccacagctcacagcaccctgtttcctggagccagccaactcattcccatatttgtccacacaccagcactgccccgtgctgccgtggcactgtgtggctttgtaatagccctcctcattacaccgaggtatgaaggcccctgggggaacaaaaggtgcaactttaatcagagacatgcagatgatactcggggttaatgcccgtcaacacagggaagagggctcacatgtcagaatatctgctgcagggtcagcagcagaggatggggatggttggctattagtcaaaattacagggcccttaacctttagaggcccaaacgcgatgagctctaaggatgtcagtgtttaaacgggaatgataatagctatcatgtattgaatacttctattctgggcactgacctaaatcgtgcttacatatgtatgtgtatatatacatacatttgcagaatctcttattcccacaactctaagagatacataccatcattaccttttaatatgaaactgatgtctaggaaaattaagtaatcttcccaaggcatctgctagtaaatatcaagtccagcattaccaatactttgcccaaccacataaagtgactccgtgaaattgttataaaactttctatacgcattaactactgcacttggttctgactagtaacaaatgttctatgaacaacaccagtctgtggatcatatggttccaagctattccttgtcactgtcttccagcctctaagaaagaggtaattaataatagctaagtgctttacttgcattatttcatcaagccatgccaatatcaccataaggtgttgctattactatctccctgtttgcaggcaaaaaaaaaaaaaaaaagtgataaactggagttaatttgcccaatgttaagcaaaattccttctttgattagttctaatttttcactttaaatcttgaatgggtactactgatattacatttttaatgtgagaaaatcatatggtttttatgctttatatacttttaacaagatggattactagtggcacaaatttacaagtatgttactaagtgattgatatggtttggctgtgtccccacccaaatctcatcttgaattgtagctctcataattcccacgtgttgtgggagggaccctgtgggaggtaattgaacaggaggtaattgaatcatgggggcgagtttttcccatgctgttcttatgatagtgaataagtctcacaagatctgatagttttgtaaagggcagttcctctgcacacgctctcttgccttccgccatgattgtgaggcctccccagccatgtggaactgtgagtccattaaacctctttttctttacccagtctcaggtctatttcttcatagcagtgtgaaaatggactaatacagtgattgaggcatataattttgttttggtgttttctgcattgtttcttttgaagttcctaattcataaaatgattcagatatgctctagagatttttttataaaatgagaatctcttttttgaagaatttgcccataaaaatatcttgagcctggtgctcattttgagggatgaaagtagcattttgattaatttcctggttttgattttggttttgatttacctgggtcttctgttatcaaaatttggtaactgatagtatccatttcaactaggttttcataattgttataaattgacttatagcagtggttctcaaagtgaggttccaggacaagcagcagtggcaccacatggaaaacccttagaaatgcaagttcttgggccccacctgagacttagagagtggggctgagcagtctgttcatttatttaatcctccagctaattctggtatatactaaagtttgagaaccacaagtttacagtattcttctataactgagcttatatcccacttttaaattcatgacactatttgagcctttttacttcttcatattgtcaaaggtttgtctatttcatttgttcagaaaactatctctgatatggtattttaatatttttacttcactgttgtctgctttcatcttattcactttgtgttgttcctatagtttaagttacatctagttaattttattttgatccttttttataaatgcatttgacgctatgaagtttcacttagttgcttcccatgtatttggtacaccatgctttcattttctttcatttctagatattttgtagatttttctttcttcatctttgatcaatttttattcatgaaaccaaatgtatgggggtttagtaatctcatattttacttctattggtattgtgttgtggccggtaagtttgatctgtgatcatttatttgaaatttgttttcttctgtggtacggtctgtggcagatgtttgaaagactacattcaatgcctagattcaggaatacatatataagcatgaatgctaacaaatcttagtctacttgaactgtaggtttcaggaagtggtatgtcaaagtttctgaaaaccactgtggctataattcgcccttacagttctattccattttaagttatgagtatagtcatgtgccacataatgatgttttagtcaacaatagactgtatatgtgacaatggttccataacattataacaccatattttcactagccttttctatgtttagatataaaaataattcccattgtgttacaattgcctgtagtattcagtacgataaaatggtgtacaggtttatacctaggagcaataggctataccatctaggtctgtgtgagtatactctatgatgtttacacaatgacaaagtcacctaatgacacatttctcagaacctatccctgtcattaagcaaggcatgtctatagagcaactgatggcataatatggtaaaagggatatttcagcgagatgattgcattataaaaaacagatttgctttgtcagatattaatgttgtttaaaaaagagtatttaccctcatttaatttcaactttctgtggaattatttttgtataactctcctttaaaatactaatcaataataataaatgtgtttgacctgttcacatttattgtgattacagatattgtgattacagaaatgcttactcttatttctgccaccatatctgtttcctacttactaagttttctttataccttgtcttttttccataggtttaaaacatatattctaatattcttgtggttactcatattttccacaggggaacatagtttttcctagtaaaatctacagttaatctatacagattttttttttcatgaacaaactagaagcttaacacattcttaccacctttttctcacttcccccaattgtctggaattttaattccaggttgccatataactatttttattggtcttagcagaattgtcatttctttttcattattgcatctgaatagttctttctgggatcatttgtttggtagaataaatcctttagtgatatttaagtgagtctggggttagtaagctgactgaatcttagatggtttcagagtaccagagtacctctgtcatcacacttgaatgatcactgggataaattttaaattgtaggttcataattatttccccttggcactttgaagatactgattctcattgtactgtgggtaatctttatttataatagtttttagttttggttttccttacagggtaggtgtgtttcttgatagtgtgcatcttctatggaagaattcttcctctttgtgtaacctgggtggtaacaccatctacatcagcctcctgaaaacagaggttcctgccttccactgtagctttctatgccctaatttaatttctgattttgtgagcgtgcttacattttcaaatttgccttttatttagtggaacaatcccagaataaaagtgtggcatgggagggacagatttctcctattttgaaccaagacttcaacccagacccaggtgactctagggtctagtctagaacatgctactcaccaggctataccaagatgatcatattctcagagattaaatgagaccatggaacaccatgtctatcacttaggaaaggctgctgatgccacagttagaagcttagtggtatccaccctctcattaaggagtgtacgccattgcatgctatcagttttcaaagaacagtagatagaaaagaaggaaaatgtagatgcggtcagtagcccaaaaagagatttgtgaacagattctcaatcaaggactgcagagaaagtgaacatgtagagagctggctcctccttggaccaaaaaaaaaaaaaaaatgggctgaggccctgggttggtaagaagcaggtgctgctctaaaactacaatgcaataattatagctgataataatttgttgattgttttatttatttgactctgtatacccctgactacataaagaatttgtaagcaaatggcattttttctgagtcagctggagtaatctccatatgtgggaaatgtgataaagcaagctttaaaacaaaatgggatttattttaacagaaaggtaggcatttcattcatgtgcactggggtaaatgagacatcttatcacaggtgacccttaccaatgaggcaatgtatgttttaataaacagcaatgtactaattctacaactacctgcagatcataggtacgtcactcaaaataatatcccacatggagaaatgagatcaataaacaaacacaagtctttgcactagaaaatcctatggaggagggatccagccactttgccttcagaccagaaatatatctttatgtccttttactcagcagaagaatgtaggcctaaagagttcgaaatcctgacaactttggggaagtctacatgcattttgaaataactcaaaaaatcctaagagaagaaaatcaccggaattcatagactgcctacatttgacaatctgcaagaaaacttgcccatttccttctctattcatttccttcaaatgaatagagaaacttctgaaatggcaggctgcttggggaatgcatctgcctctgaatgcttcacgggaataattctgtattactgtgttgcagctgacacctctttttttaaaagcaaggaaagcaaagcaggctcctcctttcttcagcaaaccaatgagaatggccagtgtttctatgacaaatgccaggacttcctccacgtgctggagaaaggcaggcttggagctaaaggggacactttgagaggactgcaagttgtgcatgttaggggaacacacattcactcaacccacttgcttccgtggtgtccaaacagcctgcatactttcctggagggattaggtgaaggtagaaataggcttaagcacatacatgtcgttcaaccctgtttgataaattctgaagagagtacagcccatctgcctccttcaacagacaatcctatccggggaatggaggaaatgctataatttttagaccttatagtttgagcacttgagagcaccattcaatgatcttacttagaaaaagccaagatttgttttagcctaagatcagggaggagttagcagtggggaaggtgctggacttcggccctggctgacctctcttcctgccgaaggaacacacagcagttttcaaccagccagtcctctgtttatgtccagctgcctggaagagctctgcctggggttaaaacaaggcatttctttcatgaaacactagccctaattgaataaccattgccatgctgatcattacaagggacatggctggcttaattagttgtttaaatgagtggcaagaaattgtacttacccaacaggcttttccccttactcagcttctgaattctgttcatttcattctggcaagggagacctaaaaaataatttctgaaagtcagcttccagatggtatggagtataatcgctaatgattgacttcactcttgatgtgaaatgtagacaatgacacacctgggagtggaattgttccatatgctgttactatgcaagaaaacaaattcgggccattagtgttactagttaaaaaacaaacctcataccacaatgcacttaaaatagtatttgggggccacttgcattgcatagaaatttttctttctagtaccaactcaagcaaataccaagtatctaataggtggtgtaatggactttttcctttctatcaggaagcaagtaatcagccaaggcttattagtggggaagtgttctgaatccacagacgaactaaccagaggtgacaaatacttatatagcctaggttttcctgtaggaaaggatggataggaatggttacttcagacctcaccacccccaggaaagtaaaataggctttgagggacaactatgaagatacagaagagatctggagaagcactgatgagactttgtatctaggctctgccacctcctagctgaattcacctgtcccagcctctgggtcctcagcggcaaaatgcatgtcatagaaaagaagttagtttcattctaagcaaaatgaaaagtgacctcattcattcttcagagttttaccatgatttgcctttgcagaccttgtggctctgggagttctgctatttgttcatggttcatcctgtccttggcagaggagttctggttctctgagttcttatctttggctgatactgcctctttctgcaggccccacacttgcatataaagtatctaagcaaccatttacaactcttaccctgtagactgcacaatgctacctggtcttgctgcttgttccatgagagaaactgcttgtaaaatacattttgttgacttcttgttttaagatgctttcagagtaaaggagaaacaaatttcatctggattataaaaggtagcatttcctggatgctgtgccacaggaaggggttctggctttcagcaactgcaagagtaagggcagtctatccagagatgtcccatgtggccaggtgaccagctctggcactgttacctccaggcaagcattaacacataggctctgtgttgtaaggaaaccatgctaaaaatcacatgttacaatacgaactcaaacctaaaactatcactagtcttaatgctgagaatcactacaagtatttacactactaaaatttttaaatggctattatcttaacattgattttaggtactaacagatgtaattagaaaagaaaaatgaggtataaaaattgaaaatgaagagaaaaattatcactatttgcagatgatatgattgcacacccgaaaaatctaagcaaaccaaccagaataacttagaaacaaagcaagattttagtaaggtggttgagaacaaaattaatgttgaaaccaccagggagggaatatagtgcaaaaaaacacctatttcagttacaatggtagcaataataaatacaagggaagtataataattgttagaacaaaatttcaaaattaacaccatgggttgatagatcctgttctaaaacaaaatgattccatattatacagctattgatttttatttgattaatttttcctgatacttaaaaattaccaataggaattgtttttaattggataaactgatgctaaagttcacacagggaaagaaacatactaatatccaggaaaattctagaaaaacagtaatggcagcaaaggacagttctaccaggtagtaaaacatattgtaaaacaactgtgatttaaaagtctaaaactgatttattttatatatatatatatagcaactggatgaccatctccagggaggctgggagcctacttgactgtgtaatacacaatctagactgatacagaatttaagtgaacagcaaaaaagataaagtgagaaatacctttctaagctttatggcttcttagaagccataaaatacagagaagcttggctatcttaaaatttctccctaacaaaaatgcatgaactgtaatttgggaaaaaatatttacaatacctatgaccagaaaagttccaatttccttaaaaaacaaacacacaagaacctgatagaaaaaatatacaaagaacatatagacatttccagaatgtttcatttgtacagatgttcaacctaactcataaatcaagaagcttggtaacgccatagagaataggtattctcatatatctttggtgaaagtaaaaattgttaccacctctttggaggtgaggtcaattgctcaaattttaaaaggcacatgccttttgactagtaattttaagaacatatcttgaaatcccatacacacatacttacctttcactgaatacccacgttttttgttgtgtgtgtattgtctatgcatacataacttaaatactttcatattagcagccatcctcctttcctggcggtgggatataccagctatgcctgtagttgtatgttctcccgatgtgggcctgtctcttctggtcccattaactgtgactgccatactcaggtgcaccccccagacagagggaggtaaagtcagggcacctgccactggcttcctgtccttaatctgaatcccccagcaggccaacctgtctgactttgggttatatgaaatatcctggtatcttttcttctattccccaaatcttgcctctttttttcattagctggagtttatttataaccaaaatattcttgtctaggacacttagtataaatctgaacttatcctagagaaactgacaagtgactttctcaatgagaatgattttcattgtctcttacatttttaaggtattttttacattgagagctcacagtgacctttggattatgtcatgaaggtttctatacccattgtatagatgaaaatacggacagttgagagacttccccaaagggaggaacagacagaagtaactgactacttgatttatactcttggtttttctagtataccacattaaaagcagaaataaactggaagaaatgagactttgggcctggcattaaatggaatgaattatttattctctggctgtggctctctgcccaattcatagtcatacgcagtcctcctctgctccagcaaggctgccctgggctagggaccccaaccctccatcccaccttacctccaggcttctggaagcagtagcaccactcattgttagaaagcttgccatccttgaaggagtcacacgagttgaaaagaggcttgatacagggctcgtacttatccaggtagatggcattgatctctgaagggtcaagcaggaggtcatagttcatgtccaacttgttgaacatccagcccagggagtccttgcagatgggcaggatgctagtgtcaaaccctgccaaacaaaaggcatatctcagctgccaccaagcctgatgctttcctccctgctcactccccagctttctgccccaagaagatgccaaggcccacctgactcccttcctgaggctgtttccttcccagcatacagatttagtggttctctagaatattttgtgtttttttgttttgtttttaagtgaaatggtttaaaagtcatcatttgaggaaaatatgttctaaaggggaaaaatccccaatgttaacatatctgtgatataaatatgtgttttcatttgcttaaaatggggtgtgcctgaaagaaataatagaaacatggtgagtgagaggtatagcttatggtaccaaaaactatgctttcgtatttcaaaaaatactggaaaaccaaaataaaatatttttaaaaggatagcagtgaaatgaaacaacatagcataatccagaagcaccgcttgcatcccagaggacctttaaatccaagcagtctgaatgttaatggcaaaacaagccaggtgcctgcctctgttccccactcttctcttctgcaatcccctaaggagatccatgagatggaatccaaatcaactcagacaataatttctttcttatttccctgggggagaagaagttgttttcttaaagaattatttgtttccacaatggaaagtgtatgcactaaaataataacacttagctcaacactcgggatattgagtctactgtagacatgtcccagatttaaaactcaacttttttcagaatcaaaggtcccgtgcaatctcaggttattccataaactggatttctagggctagttgtatttttctggaataccccaatgataaaagtgaacgtctgttgctatatagaaagcatgcttctaagcactttgtacttaattttctcactgaatccttgtaacagtcctatgaaatggtgctatatcattcccactgtacagatgaaaaaataaggctcaaggtcatacaattgtagaatggagattcagaccccggcaagcttaatccagaatctacatattctcaatgacacctctgctagccttctgcctgacttgatcttcctgtcctgaggccatccagttggcctagagtgtcacgtttagggatgggcagtgcaagggggggcctgatggggtcagttgcccatcattaagcattaatgacagcctggtcattaagtttctatgtgaatcactaggaaccctttcttagtgaaatgtagaatacagcaaaatgtacccactctttttttttgagacagagtctcaccctgttgcccaagctggagtgcagtggcaccatctcggctcactgcaagctctgcctcccgggttcgcaccattctcctgcctagcctcctgagtggctgggactacaggtgcccgccaccatgcccagctaatttttttgtatttttagtagagacagggtttcaccgtgttagccaggatggtctcgatctcctgacctcgtgatccacctgtcttggcctcccaaagtactgggattacaagcttgagccaccgccctcggccctgtacccactctttaaagcagcatctttgcagaaaagtcttcactgtctagaagccagtaaaataagtacagcatctcctcctctgagctctcttataaccctatgcttcccctcattgtccatgcttgttaatcaaactataggctccctgagggaaaagactgtcttgtccccttcagcagcctcaggcatgacaggaatatagtgctcaattaaaaaaaaaaaaaaatgttgggagacgttttctagctattgtaaactctattgctttaaaacataaaatctttccatttttaaatttattcaatatcttagaacacattttaaaatacccacccccctctttttttttttccagaagagaggctacgggacataacgtggccccttctttgatcgaatgtcatgattgtcaatagtctttgatgatgctgtccctcaggggctgctgaatgagagataatttactttggcactacacagctctatgcttttgtaaacaatattttacatacatcaattttataggatatcgatattttaatgcataaggcaagaggagtttactgctgactggtcggcaaaaagaagtgccaatctggttgggcagtagtcaaaaagtcaagcgcagcccaccctaccactactagaaaaggagtgcctgcatcttgacatctgtggttgcctgtcatgcaggagaaaggagagcagcccttctagttggccccaagagtgcagggaccaagcagggttccagggcttccccttcagaactcctagactcaaatgccgctcactcctctggccttctgggctaaccaacatcatgctttaacattcccttcactccagttgcttcaggatatcaaacctaaaagcctcttaggggactcaatttgcttttgggcaaaggcaggtcttctggagaaatctccagagactggaggctgcaagcagctgctctcctcacatcaatctgcttttgttgataggttgttcagaaaacccaagggtcaggctgctcctagaggatccaggggaaaaaaaatcttattttgcttttccaacagacccaaccaccaagaaccccaccaagaaccactttggagacacttaaatgctatttttttcttaaggtaaaagatcccaactactaaaataattgtcccctggattgatgttctccactgatatctctagaaggctatgagcagccaaaaataactaaaaattaagaagatcatttttgttttggctgaaaaccagatgctagtcaaactcgggatctcaacagttgctactctaactaacttcttacctactgcattcaatccaggagcattactttcagaaattccaaacaagcaggggatcaggtgaaatgctgttttaaatgatgtgtttttatattttgaccaaataatatcagaatggctacatagagaaggctgtggccaaactacatatatcaaataattgtgtttagtaatctattctgtgctcattggccacagtgtggagaagcctatacctaactgcctttgaattaaaggcatcaaagagactccattgatgtgcaaatgtgaggacccactctgagtgttctctgcagcttatgacaaaactgagtatggtctctgccaactcagcacctgatgctggcgggaggctccttgagcaatctgcatgttatggatggggagaggggacacctgtctgggagtttctgtggaagacaatatgcagtctgactattgtacaaaaagacatagcaccaaagatgtttgctacagtgttacttctattagcctaacattggcaacaacctcaatgtcccaaaataaagatcaaattaagtaaactgttatctccataaactgggattctgtgtagctatcagaaagcagaatactattcacaacatgaaaagatagtcacatttctacatggtaaaagatcataaaacagtctggaaagtatgatccaaactttgtaattatacacacacacgctgtttcatatatgacaccagaaaaaaccttaaagtatgtaccacagcatgcttacggtcattaaaatggtgagatcatatatttttttcaaaatgcctatactaaacattttttaatccaacttttttttgagattgggacatatttaaagtcaaagtatatatttaatgtaatgggtgtttttcacccccaaatgatattgctaaccctaaatcaatgtctaataaattgaggaaatgtgatatttaaaatggtcttactgccttgggctgtgttggagctggtgggcttgatgactctgttcgcatcctcgtggagagctccaaaccaatccttcagccgggaggcaaggttccgcaactccttgtctgtgcaggctagagaaaagcaaacagaacagacaatggggctgggggctttctgccttctgtgtgcagggctactggcaaagccacgttcaaagcaaacctttctatccaaccacgatataactgttacctcacgtggaaaacaccccaaagatgctgttagtacaaacaaagagtgggacaaaaagagagcctagacccccagggcaagcagcctttgttcagaacttgaatttggatggcctctgtgctgtgaaagcaagctgcagtggtctcaccgttgtgtagcatcctcagaagacagacaatcacagatcacttttgctaaccgcataaagcttgctcttgcagttttgccagaggagattacattttccactaaactcatgccaagagattaacacccaggcacagctaatgctcttagagagaggctgcctaggacaccaaaagatcctattaatagcagactcctaattttgtcttagcccaaggtttggatttggggattgggcctattttgctagccttccagtggtctcattcttgactttccactgtaaacagatggatgccttctccatgaaacagtcctttcagcccatctataactatttagtcatttcttagggtaagacagaatcactggggcagacagatactcctgagaacaagaaaatccagacagatggatgggtgggcaggtgagtaggtaggtgcaagctatttgaaggtcttgtagagtgctaaaacttgaggaaagaaatcccaaaggaataaaaatggtgcagagaagggagttgactttccctagcccctccctcttccctcagggcatacgctaattcttggtactgagaaaacctgcaaagggtccaagcagtaggctgctaccaagacctagagaacccagcaatgcatttggggtctttagtatctggagagacagaaatgaaagatctgaggagtcaaaattccaatgagtaaaagggggcaaagaacagagccccacatctgtaacttctcccatattctaaagctacaggagcacactgctaaggagttaagcagaaatgctgttacaaggcacagccaagttctgaatatctcatggtgctgaagagacacagattagggctcagaacctaccagtgcagagggagcctgggggaatccctggggtcttcactggaagccatagggacagtgatgaaaaaggagtagacacagcctcaccaaaactccaagctagccttcaaccaacgcaggacctgattgaattaaggtgatcagcccccatcggcctgccttgcaaaagactaggtgaaacttctccagaagaaaataccatgcagatcctctcctcatttttatcatccacatatgcttatcaggcaagcccatttctcaccctaaggcttgatggagaaccgagcttcccagagctcaggcagaaaaggtctttccccaccctccatattagaggagaggtgaccaggccctgactgggtctctgcaacctggggactctcatttacgacgctgccttctgtccaggtaggatccagactctacactctgcaaagcatggaatgaatgcatgtccagtgtttataccccagtttttaatgaccttaaaacactgccttgcttttaataatcagggtttggctgtattttaaaacaccagccaggaaacaacactgagaaatgtctcgacagggagcaaagaataacttctcaggagtcgcgctggctggaatgaatcccagctttgccactcactggctgggtgacctgagacaagtcagcctccagcacctcggcttccttatctgtaaaacttcggataatatggttatataagtataaatcagacaatgtatataaagttcttagcaaagtacatgatatatggtaattacttagtatgtgccacctatgattttgattattattactattgctatttttaaactgaacatttataggtaacattagggctagcatcacagcattcagaaagccaacaacaaatccacctacacacaactggctttagccacataaaatagttgcttgtgttatctagtaagctgcaattagccatatatggctatttacattaattaaaatttaggccaggtgcggtggttcacgcctgtaatcccagcactttgagaggcagtggatcacctgaggtcagaaggttgagaccagcctggccaacatggtgaaaacttgtctctgctcaaaatacaaaattagccagtcatggtggtgcatgcctgtgatcccaactacttggaaggctgacacaggagaatcgcttgaacctgggaggcggaggttgcggtgagctgagattgtgccagtacactccagcctgggcaaaaagagcagaaactcagtctcaaaaatcaaaatttaaaaaatctaatagatagttcctcagttgcaccactgcattcaacagccccacacagctagtgacctccacactggacagcacagacgcagaatcttcccaccgcagcagggtgtcgtgctgggcagcactgaatcaggttagcgatcattttgggctaactttctggagcatcatcatgatattctgccatccaagtttgttcccgtacttctccccttcaactgtttaagatgagctgagaaagaagataagcccccacaagccaggaaccagcatctcttgctaagccatgctcccaaatagcagggaaggtagttgtttagttgttatgaaggtggagaatcctggcttagcccaggtgccaaggcagatcctcaggagcaggccctcccaacacacttattggatccaactcagaacctcggggccctaggttttcacttttctgacactgccctgctctaagcaggagagaatgtggcctgtttttctgaggaaaataggttgtgcattccgtagtcaatttcacatttgaaaatgggaaactaatagcctctattttttctctattgccatgcgcaccatctattctaaatgttctctgaacagagaaaattgccaagtcaacatgcagaggaaatctcatgcttcaagatgaattagtcagtcgtgtttaactaaaccctgacagatgtgcaggtaatctgtatctttacaagactgctagattttccacaggctccccaaagtacacaagtcttggatgtctgatcggatcaggcactgaaatcctgaaagaatgaatctgtcactcagggacaagtccactagcagggagccactggtgtgggtcgagagagatcagaaacccgaaatggaaagaggaggctctcagttactgggccctgttcactcacaaggtcttcaaccgaatggtctgtatgagaagaaagtcaggcacaggttgcctggagcttgatacatcccaaagaaggaaataatcaaaggcaacagcctgcagagggctatttgttcaaatttggtattctagccacaacacacaggctggtgatgggagaaaagtgcctgccttttaaggtgctcatcatcgcccccaataaaggtgtgaacaggggactgaagctttcagaagtggggacccagaggatacatcccacacacttagtacattcctagggaaaagtaatgttcgtggggtgaaaaatatagtcatatatccccctactattctggtgccattctggcattctaccctgtggcaatcccggcaatttctggagaggggtcctggcgagaggagcagggcacttgggctaccagcatcagactcttcagaggaaaagacggtgctttcttgggagaggatttggattaatcacgaagaccaagacctgctttcttgtgctctcctcaccctcctggatggacacgtgccagctagccctctaattctcccattttcaattacattccctcccgccctccatcctggtttcagcttgcttttcattgctcttgtgctcccagttttcttctcagcatcctactgagaggtgaagccagctagacttcctgggtcgagtggggactcagagaacttttctgtcttacaagaggattataaaatgcaccaatcagtgctctgtaaaaatgtaccaatcagcactctgtagctagcaagaggactgtaaaattaccaattggcaggatcctaaaagtagccaatcacagggaggattgaaaaaaggacactctgataggacagaaatggaacatgggaggggacaaataaaggaataaaagctggccaccccagccagcagcggcaaccctctcggttccccttccacactgtggaaacttcgttcttttgctcttaacaataaatcttgctacctcttactctttgggtctgtgccatctttaagagcagtaacactcactgcaaaggtccacggcttcattcttgaagtcagtgagaccatgagcccactggaaagaaccaactccagacacactacttctcaatgatgtttccccatttaccctactgtttctacacgttatgacgtatcatttttacacaatctccatctgctccaatgggctggtgtgtgagccacgtctctgggatccactccccagcctcatatctgcttcttcccatagtcagaaaatggtaccagcaaatactcatatattctcagggcaaacacttgggaattgtcctggttcacagtgaaaaagttcactgcttcttatctccactgcctctattctagtctccaatgccaccactacctcccaccaggacaactggaacaggctcctaattggtctcccatcttgccccctccctcccccgccatgttcccttctccatccagcagccaaagtgatatttccaaaacggacatttgatcaagtcactctcctgtttgagacacttcagaggctcccagttattctgtaggttaagtctaaactccataatgtgagctaaatggcctgcaggacacactcactgaaaaaccaaatctctcttctgtatctgctcctcctcaaccttcacgctctggccttactgcccctccgacatgctcttctattgggaaacaaacacctcttcccactgccttgctaatgccaattcctccatcagatcttggctttaaagtgacattttcttagaggacttccctaatcctcaaacttgagatttctcttttctatgctcccaatgccttgtttctctgatagcattcataacacccatctcgttcagtgcccatttctcccctagatcatagcaacataaaacatgccctgactctgcccagcactggggacccagcatctaacccagtcagttcctggcatgaagaaagttctcaatacacacctactgactgaatagaatcacccttttactgccttttgtaaacttcaatttttccatctgcaaaatggtgtaataaagcttagctcatagcatcactacatggaataagatgagacaatattagtaaaacatagctcacagctactggcatatagcaggaactcaataaatttatgttccccttctcatatcccaactgtctgcataatatgttagaattgtattgttgtgcgttttttaagcctgaggagatgcttgtgatataaagaataacatctctccttattttatacatgggtcagtagaagtccaagaaatacaggttgcaatatctgtctgctgtggataagttccaggattgggagattggtctgacttccccacacccgtattcttagcacttgctctaaggtactatgtagtagttgttcaaaaatatatttatcactaagtatattttaaatgaatgaacaatagatcacagactcccaatgtcaaacagctattaagtggaagagacaggatttgaatcaggctgtcatcctgctgggccatccccacgtgcaggacttacttcctggatatattggtcttgtgggcagccaatactaacctaacaattaatatacttggtccatactctgggttgaaaaaaatcaaaatatcaggccttgccttgcgtaggaaactctgccaatgatgcaggtgaggtagctagctgagcaatataggatggagggagagcaagtaggctctcacctttgttagctttggtgtgagaacaatggtcttttggaagaactgcgaacagcctgctgcctgtgtcacatgtgtggccactggggcttcattagagaaaggtatagtgccattgcacattactccaaaatgtggaaaaagacagctctctcccccaggaaagcacagcactcaggcagagaagggcccaggtaatttggtgctctcccagtggacttttcctttctgtttggaaaatatgaacaaaatgcaaagagcaagtgtaaataaggcacgttcagtctccatggaaagtacatagccctgggaagaaaacgtgatcgctctccacctggccacctttgccccctccacccaaggcatggagctttatagggctttaagctagactggatttgaatgcagacagtgttcaaacatagcttggagtgcagcatgaggaacgcagctgatgggagggagaaggaggcattgttgtcaatactgtaggacagagaagctgctccagggttaccgcagccttggtggggttgtaagggggaaggggagctctaagttattagtatttgcttatgtggcagttagactccccgggcagtagtctttggaggaaagaagggttgcttcttacctagatgagtgtcagtagtctggctctgcctgtaccccgggaccccattgtccccttctccctggcccctgtgtcctccctcagacaaaaccaggggctagtgaagagctggtgaggaagtttcaaaacaggtaatggttttgaaagtggagaggtaggagctaggaaatccaagcgtctttgaaaaatgctcccaaaggctataactggtgttccacgctggtctcagctcattgatgacttcaagggctgaatgacagtctgaaaagccctttctgaggatttgacaaaaacggggaagaaaaggaaacaatcagtgggataaaaaacatttgggagatgagataaaaaatggaaagggagacagaggatagaaatcctttattcaaagctatagtgttactatctaatagagtaagaagtggcgagcaagtgtgagtgagcgtgtctctgttagaaatcctaactgaagccacatttgaacacccaattggggatgtccgaaaatggcaaatctgacacacaggcatcacaggatagctgtaaacctctgttggggaaccaattactggtatattcttgtaatgcatgaaatctttcagctaaagaaccaaaggataaaaataaccctaccctactcctccccttctgtcacaggaccagcccccctctctcaggcaaacctcaccaatgcgatctcagggctctagcagaagcaaatatgaaaacaatcagaatttagtttaaactttagtgcctccgaaggtgattaaggagttgggcgagactcaagttctctttgggagcaagctcggaggcctctcagaaatggagacctgatgctgattctttcaaactaatctccttcagccctcctaggtgctgttgtgaataattacttaatcagagcagccctggatcaacgtgctcagagtgtttgcaattagtagctcctgtagaaggtccagctgagccttccttagagcagtgatgagttgagatgaaataacactttccagagtctgggttcaagcaaacacaagggtgccttcctgaactgccttgcctgggttgggtctcttccctccatcatggcattctcaggctgctggaagccttcagcagcaagtgtctgtctcccagtacagcatggtaggctcctcctcaccaacagggaccatgtccctcctgtcattcaatatctaagcaaacagaaggtgccccagtgctggaaaaatgtgtaggaacaccaaggagaggatgctacatgccatgggagcatgaatgtggagaaggagtgagtctacaattcccttaggaatgtggaacccaataaacttgaatgcaaacaggtgaagattgattctgcttagcacagtcattctgccttaaaagcttaaaaacaggagagagaaagtaggctctgggctgggcatggtggctcatgcctgtaatcccagcattttgggaggccaactcacctgaggtcaggagtttgagactaacctggccaacatggtgaaaccccatctctactaaaaatacaaaaattatctgggcttggtggcatgtgcctgtaatcccagctactctggaggctgaggttccagtgagccgagatcacgccactgcactctagcctagaagacagagtgaaactccgtctcaaaaaataaataaataaaaaataaaaacaaaaaataggctctggagtcagggctgaacgcagatcccagtggtgccatcctcgctgagactacggacaggttactttttaatcttcagtttcctcatctctagaatgaaggtgataacagaactagtattaggaccacgaggagaatgaaactataatagaatgcacttaagcactcagctccaggcttgccatgtggtagcaccaggccacactcagtagctgtcggctgtgatctgatttgtgtttgtggacacagagcagcatggtgatccaccaaatagaaaagtataggaatcaaggtcatgcatgtgatgttttcacaggaaatgaccacaggaagccatccagcaagataggaatctcttctattgcttttcagagaaggtggatgatatctcccaggtcctacggatggtaaacggcaaaactgaattcaagcccagctctctcaactagagtttcactcatctgctcatctatgacaaccccattctccccaagaaaatacctcctccacaagatacagaccatgcacttgagtgcaaggttgggacccacactccctcagacttccagctctcacaaccctcagtgtacaagttgttgctcttcacgcaagcccttgctcttctctgatcccctgctttttcatctgtaaaatgggaataatgtttgtggtgaggattttgctttcaaatactgacaggcagccactatttcttctcttccaaggagcttcaggggctgggagcacttacccttgagaggctaatagataataagctccttgccataagcagttttgtaatagaaaacacaataggagcttactgaagggatttaaaaaacatatacaaggtgaattgcctttctaattggagatcatctaacagagatctttgagccaggttatgcctgctcaaattaaattgcattatatgtaattccagcttttacttttcactgcctaaaacatcaatatatatgcgtgttctcttatccttagagaatgcgtcattttatgtaaaaacaggcatgagcaaaggaattaggtgccattattcaggaacttgctaataaagtctttaaaaagcaatctttggaagagtttaaaatactgacattaaacttggaataagatgagttatactaattaatggtacaatctacaagcaaagatggataaatttccctattaaacccattaagactattctaggtaagctgatttgaggagactttaatgtttcccttgattctaatgataatctttcatctggaaaaagaaacatttagaacttgcataataacatctgtaaatgtgcattagtggagtaacgcttattttttttttctccctgaataatctagatcagggaagttagctagatgaaataagcttttaaagcttctgataaaatccacagccactttcacactctggggccaaaaaaaaaaaaaattattggatatgcaaaatattggtttaaaatgccaagtctggctttagctgtgctccctagccagtgggtcagcatttccctacatgggagacttgaaatcgattagcagcatcatacccagcagttttactgaaggatttcatggccaaccagactttttaggccctcaactaataaagactaagctgcagaaatgacaactgctgttctcacctaaaatcagcaatggcaaatgctctgagatgagggtgtaaaacaggctcaacctggactactgagagagccatgggggaaggggaaggacagagtcctgggaaaggggctaggtgataatgcctaattccttcatgggccatcccactgtggagagccagactgagtgtctgagagtcattttgccttttgttaatgtatgagctcaactggccaacagcagtcagtgaaggcttcctggaggaggcaagaattgaactgaggctcatacgcagggaggacttagagacattctaggcaggccttagaaataatgaggagcccactttgaataaagtgatttatttttaatgctctgctcaaattatatataccatttctaaatcataaatgtatataaaatcataagttggggccaggtgcagtggctcatgcctgtagtcccagcactttagaaggcccaggagggtggatcacctgaggccaggagttcatattagcctggtcaacacggtgaaactgtctcaaaatacaaaaaattagccgggcatggtggcacacgcctgtaatcccagctactcaggaggctgaggcaggagaatcacttgaacctgggaggtgaaggttgcagtgagccaaggaggcaccactgcactccagcctgggtgacagaatgagactctgtctcataaataaataaatcataagttgtataaatatgtatatttgttctgcatatctgtttaatctattccactatattacataatatatatgcatatatacatctcaagggatgacttctgacaaaggtagcaccgcttgttccagggccaatatatgaacttttatatctgtaagaggttgttgacagaagatgtctttttagggtatgtacaagtctctatttctaatgagcaatttgtgtccagtttgacctgctcagattcaacatccaaatctaggtattattgaacaattttaatttctatattttttccatcccagaagcatcaaaatatgcatgtatgtttttacacttaaacatgaggtaaacttaaattgttatttaatggagcagaaagccacaaagaattggtggaggaccaagcctgggatttgagatcagatcctgaaggtgataggaagcttaggaggtgtccagaacctgggaatggctcttttatttgggagtgggaggagaacactggtacactttcattcacagattacatggggaggatcaggcatagacttaaaatgaatgcagagaaccatgagctccttttaattccccccactactccaccattgccctggtttagagtggatggtgccatggggatatgggttgatggaagggtggtagcattgactctttcttgcaacaaaggtccagcagcatctccaggggtgccagagtctaaggtaagatggtggacatcgagctggagttgaaaattcccacttggaattgaggccagaacagaataatcctggagatgcctggaccagatgcagcaggacacctgcattatcatgcttccagtgaacaagctgatgaaggaggaagatagataaatgagggtctagagacaaactgcctcctgaaaccataaaggtgttttaggctattccaaatcctgcttgcttgggtgtacgacttactactcttctcactcttcaggtcatgcaagtctctcaatcatctccccttctcctgagggcatgattaggtatagtgacttggcatgaaaagtagctggcattcaagcctcaagtgacctcctctgggctcagagaggatcgtgtgactggcacagtgataaaatgtttgctattattattatctctatttctagtaaaactgctatatttgatctacatttcctatttagagatccagtatctaacaacacagcatgacatagctagtaatttctctcttcccctcctgaatgtcatatataaacaacaatgtacccaggaaaaaaaacctaaattttattttcagtaaaactaggagatatatccccaggcttgaacagtacaacagaagccacccagatggaagttaaaaggtccaggtggaccaataaaaacacaatgacccagcaaaaatagacttcctacaggcaaagagctccttctgaagtgatagacttcttgttcagcaagaactaagggatctggaagaagggagagtgcacagattaaacagaagctgcacaggaaagtaaaataagggaaggaagaaaagagcaaaatggcctagaggcagcagatctcagagagcatctacaaaattattcttcttgtaggcaagaggcttgccataaagtaccacttgggtctggcaagaaaattagagacagagtgagcacagctgataagagaaaccctcttagacctgatctgtttcatagaaacagaaaagataggaccatacagaggagccatttttataggaggccatctgtcactggtaaatccctgaagcaagtgcctttggagtgtgaatctataaagatagcctggttcttccccttccatccacaaggcttccttttgaataggtaggccagtaacatctaacttattccaataatagcttttttttttaaaggggctggcaagttgatttttaaagtgagttacaaaagagcagcattgcatctatgttctaggttttgaaaaaaaaaggaaaagagcaaaacttaccacagaacacttagcagaaagatggaaaagacgaacatgtagaccaagtataaaaccatggattaaaatgaaacaatcacctttgtaaagaaagacaacaaagcagtattcaagaactcaggggagagataaggagtcaatgaggaaatggtatggaagcatttagaacccaggggaaaatgaagccaaagtggagaagcacaagggagaacagcacaaggggaaaaatacaagagagaaggatgccagaaatgagaagagtgaacaacatgaagaggaaataaagaaggaattacagaaggttacagagtaacatatagctatagagaagagacaaaggaaaccctatatatggataactgaagcctctgaagaaacaaaagacaacaatggaacatgacataatttaaaatacaattcattaaaccactccagaaataagggtggaatttacatgtttaaaaggcacagcataagctaggaaaaagggaccgagaacggtcaatactaagatctacctaaataaagttactgggttttaaaagtaaagaaatatctggtttgtcaaagatcagatggttgtagatgtgtggtgttatttctgaagcctctgttctgttccattggtctacatgtctgttctggtaccagtaacatgctgttttggttactgaagccttgtagtatagtttgaagtcaggtagcatgatgctcccagcttcgttctttttgcttaggattgtcttggctatacgggctcttttttggtaccatatgaaatttaaagtagttttttctaattctgtgaagaaagtcaatgatagcttgatgggaatagcattgaatctataaattactttgggcggtatggccattttcaccatactgattcttcctatccatgagcatggaatgttttcccatttgtttgtgtcctctcttatttccttgagcagtggtttatagttctccttgaagagatccttcacatcccttataagttgtattcctaggtattttattctctttgtagcaattgtgaatgggagtttgctcatgatttggttctctattattggtgtatatgaatgcttgtgatttttgcacattgattttgtatcctgagactttgctgaagttgcttatcagcttaaggagttttggggctgagatgatggggttttctaaatatgcagtcatgtcatctacaaacagagataatttgacttcttctcttcctatttgaataccttttatttctttctcttgcctaattgccctggccagaatttccaatactatgttgaatagtagtggtgagatagggcatccttgtcttgtgccagttttcaaagggaatgcttccagctttgcccattcagtatgatatttgctgtgggattgtcataaatacctcttattattttgagatatgttccatcaatacctagtttattgagtgcttttagcatgaagcattgttgaattttgccgaaggcctttttggcgtctattgagaaatcgtggtttttgtcactggttctgtttatgtgatggattatgtttattgatttgcatatgttgaaccaccaaaaacaagcagtggggaaaggattccctatttaataaatggtgttgggaaaactggctagccatatgcagaaaactgaaactggaccccttccttacacctcatacaaaaattaactcgaaatgaattaaagatttaaacataagacctaaaaccataaaaaccctagaataaaacctaggcaataccattcaggacataggcataggcaaagacttcatgactaaaacaccaaaagcaattgcaacaaaagccaaaattgacaaatgggatgtaattaaactaaagagcttctgctcagcaaagaaaaaaaaaacctatcatcagagtgaacaggaaatctacagaatgggagaaaatttttgcaatcatcaatctgacaaagggctaatatccagcaactacaagaaacttaaatttatgagaaaaaaacaaccccattaaaaagttggcaaaggatatgaacagacagttttcaaaggaagacatttatgtcgccaagcaacatatgaaaaaagctcatcatcactggtcattagagaaatgcaaatcaaaaccacaatgagataccatctcaggccagttagaatggcgctcattaaaaagtcaggaaacaaaagatgctggagaggatgtggagaaataggaacacttttacactgtgggtgggagtgtaaattaattcaatgattgtagaagacaatgtggcgattcctcaaggatttagaactagaaataccatttgacccagcaatctcattactgagtatatacccaaaggattataaatcattctactataaagacacaggcacacgtatgcttattgtggcactattcacaatagcaaagacttggaaccaacccaaatgcccatcaatgatagactggaaaagaaaatgtggctcatatacaccacagaatactatgcagccataaaaaaaggatgagttcacgtcctttgcagggacatggatgaagctggaaaccatcattctcagcaaactaacacaggaacagaaaaccaaacaccgtatgttctcactcataagtgggagttgaaaaacgagaacgtatgggcacagggagggcaaaatcacacactggggcctgtcggggggtggggggcaaggggaagaatagcattaggagaaatacctaatgtagacgacaggttgatgggtgcagcaaaccaccatggcacatgtatacctgtgtgacaaaactgcatgttctgcatatgtatcccagaacttaaagtataataataaatacacacacacacacacacacacacacacacacacaatcaacacagtagcagaaaagatacccaagtaacttaggagaggtaaaaggaataagtctgccctcagatttcagcacggcaatattcaaaagaggaagtcaatacaacaatatccttaaaacagccaagaaaagaaagttgaaccaaggattttacatcaaactgtgctatcaataataaatacttcaggaaaccagttctatacagttaaccaggaactactgttctcatgagcccttccaaaggaaatactagagaattgtagacaactgtggtgactggagtgacagataagaaggcaaatgctacataccctgtcaatgaagaaatgatacaaacaacaacaaagaggggaagggaggaagaagatgcaaagtacaacaagtttactgatggccttaaacataatagttggagtcagatgacagaattaaaagctgagtaatataatattgaacatatttcactgaacaaagattaaaccctaagaggataattgtatcaactatgatcaagtgtcaggagaaatgaaggggaggctaaactgggggagaagggaagagagagaagaatcatattaattttatcactgttttaagtgagaacattcctgaatatcagaagaatgatacacacacatgccctgccacacaatattaaaaaacgtaaaggaaaatatggaaaaataacagagatgatagtactaaacataactttttacttcgataagtctaaatgagttaaaattcacctctcaaaagaataagattttattttcagaccaggtcacaaagagaagcctaactccatattgatttttacaagaaatataacaatggcaaagtgattcagagaggttgctagatattttgaccccaaaatttcactttgggactaacacctacagataagcatataaatacatttgaagtagcatgtataaggctatctataacagcattatttgaaatagcaaaaggctggaaacattcaaatgtccatggttaaatcaattatagtatatccaccaatggaaaaactataaagctactcatatgagatgcaaagatctccaagagaggtcaaatgaaagtgcagaatagtgtatattctatactatatatgtgttaaaaggtagagagataatctgtatttgcatttgtttctatgtgcatcaagagcctcttcaagcatacacaatataaatacatataaatgagtgagcaaaggcagtgcagggtagtagccctgaggtgggagaaagcttgagtgatatgaacataagagacttgttagctataacccaagacagtttgcaccaatccatctgttctcatgctacacactaacatttttcttttaaaccaaaagggagaaaataattcctaaatgcaggattttttaatcaacacaatctgtgtgctgttctccattctgccctgtgaccttgggcaggtctaaattcaattccagcactccctaaatcagacactctgggggatacaaagatgattaagacatagcccttgcctggtgcttggtctcccctctcctaatttgtaaaaggagaatgctttccctccactgagttggtggaattttaacaaggaagacacagaccctctctctctcagaatcctccttcctgaagaatcaaggtttgcttcaaatatgtgttcacctggggaatcttctcccaacacccatccaagaagagtctacctccccctccttggggtgtccccagggccctattcatgcagttctacttttccatgccatatcacaacctgctgtctcttttggactctgaggtcagatgcagtaagaattctgcagtagtcacatctatactcgcccgagttccctgcagagtgcctggccaaaagtcggcatcaatatatgtttacaggaggtgcaaagggaagaatgtgaatacttaagtgaaaacgctgctccaattaccataacagcaccaagaataaacatgccaaacaggtcatggccagcatgtacgtttgaggatgttgtggagagatagagccaccatggagagggataacttccagccaaacagaaaatggacttgcgaggaagggaggggcagggagaaatgcatgtgtgtgggacactatgatgtagcacagataaaaagacacatattgtctcagtgaagcctcaggatgtcctgggagggtgacactatcatctctactacatacctgagaataccaaggtccctaaacaggctagggggcttgctcactccagcctccagttccctcaccagcacacacataaaggccaaagtgaacatttgacaccaggacaaaataactcaaatctgtgctcttaacttcacccatgctgactaatttatgaaaaatatggcctaattcttctaccacagatatcacgccaacatcccttgcctgagaacaggaattaccaggtacctaccacatgccgaaattgggtctctgggtttatagattgttgctatcccaccctgataacacctcagaccttagcttagcctggtagcagcctgaggtccctggaatgtcattttcatgtttcttcgcatattgtattgagggatgctagaacgattgtacacctagcttgttttgcactggcttctcattcctgtctggatagttaccactaagtaatttagtttatctgtgtctccacaagcttatttgaaaaccatggaacgctgcttacagaaaattaagcttcattttctttaagcatccagccaatagcgcaggcaggagatggtgatttggaggtaactggcttatgcatatgtaaacatgatgcatttagcaaattatatagacttcgcacttcagagcattgaagaaaacaaaggtaccttccaaagaaactttagtgcaattgagtcattctgaaaggaatacagaattactggtttgtgagaatagttgagctcagatatgaatggaaaataatggtgtggagcacaggcatagacaagaatttgaacagggttaattttaggtggtattacggcatctctaaggactcccaggaattataccccataacgtgccttgagattgaattcatggtgtaatgaggttgtatgtttcagactcaattccactgtgactcttcatgctttccacaatttcccagcatgtttttctccctaagcccagagacagaattctagacatgccttgtgttcacaaaggattgcaatggttaaaacatccctgaaatttattacataccttttccattctccaccaggtccttttgcctcagtcccatctaccacatcagcaataaattgcactgataatgtaattaaaaatatcaccccagaagagcaaccttataagccactgttatggactttagaactcctggacaagtcaaattagagtacttgggtgtaagtagtttccaatttgtagcccaaagtcaagatggttcatttgtctgcaggtgctgcacctaaggggtccactagcttgcagtgctcaaactgccaacagttgactgcaagggtccaagtggcaccagtgcagttcaacttgtcatgttcatcaacatcaacaccaggagtcccgagagttgccatatattaaacacctactcttgccaatacccatgttagcactttgccttcatttatttcttttttcatttaatcctggagaaaatccactgaaattattatttcaagtgacttttatccagctgccactgactgcttgttgtaggacaggcactctacacccaaatgtgatctcattgactcagcacacgaacgttctgtgaggcgaggattttaattcatatcctttttccagactgtgaacctgaagaagttacaaaacatgtctaagtcaaggagctaataagtggcagaactgggagtcacattcaggtcatggccacagtcatgtctgtcctgttgtatcctgcattctcaccatttaaaaagaggttctaattgccagaaaatgaggacgagctggagaaagaagcactttgggcatgcagaggttatgttggtctctggtacataattcttccctttcttctccctgccatcctcccacacacacacacatgcaattccaagtgatagattcattaattctcacaactctttgaggcaggcactatttatcattcccattttacagctgtggagactgaggcttggggaagtgacataaccagtgaaatatataatagggtcaaagtttgccccaaggctgtctgattccaggtcccaaactctcagccagaaggttctataatagttaatctaataattagaggcatgtttctgatggtccaagagctaattctaattagggttctgcctcaagatgaggggcaaacactgaaaattatgacctgttagattttctgtaatacttaagtcgaaaaagcacaggtgggtgcaaagatgatgttgtactcttacaactataaggcttatcatagaaaaaataacctagaaataatgtctaatattaggggttaagttgtggttcacaaatacgttggaaaactgcgaaggcattaaaaatttgccaaagaagaatattatgacatggaaaatgtttatgatacattaagtgaaaaaaagcagcttacaaaagcatctatgatttgaccccacttttgtaacatgaaatgaataatgtggatgtgtggagtgagttggagggagaaagagagacacagagagagagacaggggaaggtatataataaaaggttaacagtggtctctgacatgagaagagcatggttctttttctcctattgcctatagatgttttctaattttctacaattaacattgtatccatcattttgtgatttctttttaggttttgttttgttttgttttgttttttggcctaagaacttgaatgtatgtggtataagacaaaaacactccgatgagactcagaaaagattgctggagatcagaacagactatctcagagtcttgagtttgtggatatttcctgaaaagtctttcatgataacattcacttggcaaactttctttgttgacttggactgcagcctcgtgttaaagagagtttatttaaatttgcttaacctggaggttccccaatttatatgaccacacaacattttttatgtgcagtatataattggtatcttgcagctctgaggaacccagtctgggaatcatttgcctagagaacattttttattcatatctatgatctatgtgtagtccgaatgccaacctctccctccagaaattctcattctctaacacctgtaaaactaatgaatttttcctctctgcatcccccataaatactttcagaatttaactaaatgaagcagaaatatttgtactccctctagacatgggatacctggatctgtagacataaattccagtcaaaatactttgtgaaatatgagacacttctctttttcactgcatctactgctaatattgctaagagtgttataaacaggagttacagttttttttaagagcttgccttgggagccgggtcagcagagatctgcaggtagtggagacagtgggggcgcatcggggtagtaaagatggctctgactatctccttccttgttgatatagtttggatatttgtccttgcccaaatctatgttgaattgcaatccccagtgctgacaatggggtctgctgggaggtgtttggatcatggaggtggatccctcatggcttggtgctgtcttcatgatattgacttcttgcaagatctggtcatttaaaagtgtgtggcacctctcttcttcctccccctatgcccccacttctcttgctttgttctgtttttgccatgggatatgcttgatcccacttcaccttccttcatgagtaaaatgctttctgaggtctccccagaagcacttgccagcactatgcttcctgttcagcctgcagaatcgtgagccaactcaacctctttccttataaattacccagtctcagaggtatttctttacagcaatgcaaaaatggcctaagacactcactgagtccattttccttggccatgtggtcccaagtaggggtgtggtctaaagacattcaggttcacacatatatccttgctagtccaagagtggaaatctttcggcatcaagatttggagttttattcaaaaagtgcccttagacataatttacaagctagttaagcctgctatgcccagattgtaagtatccaggatagaggaagaagagagagaccctcttgggtctctcagatctatccacaagagggactttctgtgtcaatatacctgagcttatcacccataatggaatatgtacatagctaagactcattaatccaattttctatctcaagggatattagaatcctgacaagaacaaattcctgagagggtcagaatatcttttatttagtttgttttgcttttttaatcttgtgtaatgatgtgaaaaccgccaaggactccagcagaaaccacccatttatctgacagttattctgtacacggtgggggtcttgctgagaaaacttggcagggtgaacagacaaaggtcaagcccatttggaggtgacttctccagaacagatagattctctcctgtgaaattaagctggagctaattcaaaaagtgtctttgggtaaaagcgaattctgaaacctcatttttctacttttgccaagaggtggcttaagtagctgtggagaagaatttgtagcatggttatcacagtagtcttgggaaagtaaaattggtctgctttttaaagaacagagcaggccaggcacggtggcccatgcctgtaatcccaggactttgggaggccgaggtgggcagatcacgaggtcaggagatcgagaccatcctggctaacacagtgaaaccccatctctactaaaaatacaaaaaaaaaaaaaaattagccaggcatggtagtgggcacctgtagtcccagctacttgggaggctgaggcaggagaatggcatgaacctgggaggcagagcttgcagtgagaagagattgcgccactgcactctagcctggacgacagagcaagactctgtctcagagagatagatagcaaagcagagattcagacactagtgctggtaccattcacattcacactcacattcagggcacattttcccacaaggttctccttccccaaataggagcctgaaggaatctgggaagcacagtcagagccctaaaaggtcctgctttggatgttgtcaccctttgacagttctcagcatgggagaaaatggggtctgtttgtgtgcacacatgcatatgtaatagactgtaatagactacagagggggaaatcccatcctgcccttctgcatgcaaatcctctcaaggtgacagatttgttctgagacatgtctgtggcctgcccctctggaggcatggagcagatcccaggaagtggccacagaatgggactgcttttaacatcccccaagtcaggataccattttaaaaggctctagcacctaagcacgtgacaatgagcccagtgacagatggcttttaagggaacctagccagcgtagagaagtgtggaggaaaggaggagagaaatcattccatattgtggttccaagatttggagtctgaaggatactcctactgaaatggctagagttaggcaggtcaacttcactgcagaagaaggagaaggcctaggggagataagggtgatggaatcagggtgtcaataccccactggaaaaaaggccgcttttcatcgcaaaatcagaccactaacaaacccccgcacgttcctacctctggacctttacaaacatgaacatccctcccaaactgctatgctctccttgtgagctctgagatttcactcatgtgaatactggtaaaaataatattcccacctcacacattgtcaggcagaataaatgaaggtcatgcaataccgcaagcacgagcacagcagaaagtgggtatttaacaagccggacatccatagaacactcattctctgtcttacgtacttagaactctttgcaagtgaggagctgaatagataatacgttcataagttgaaattcaaatggcatttcccaaataagaagacctagaaaataaatcctataccaaacaataaattttctgtgggaaacaggcttgtactaaaaaacccagattataagaacttggaaaaatcaaacaggtcatcttaacaccaactggtgtctaacagtgaaaacatgaagaagtcatctagttcttgcacaatttttatcacagggacggggtatatttttctagacttccggaaggaaacaaacaacccaacttagagtttgagttagggtagagaaaggctgcccaggcatcaaatgaggctgtctaggaccaaaactatttgctgtattttaagagagcaaaacaatcaaaaacagcagcctactatggcctcacgttcacaatgctgtgagatggccctgcaggtggtccaagaagtggaacctagtggggagtaaaggagaaaccaggaacaatggggctttgttttgggtacaggtgttgggccactcctatgtgctcaagcacatgtggaggctggagcgctgaggctcctccttctgactgggaagtactcgaggccctgcagcatgctgtggcccccacagttctcctcccctgttcttctagctggcctcacacgacctgctgaggcaggagctctcaaggctgcctgctgcttatgtgaagggaggacctcagctaccacagagcgaggaattaaatagtcaactcagccacaggaggcagcacatgtggcttctggatttgagtctgcctccctacaaggctttggcaactacagacagcattacatttctgtctctcttatggcagtaccttgatgtggtaggagcttcatacacagttgctattggctaccaattaagaagctgaggctggtgttcttgcttcttttctgagccaaattccaaggggaaatttaaatgacttaaaaagtcataaaagaaaacaagaataataattttggaattacattattctcaacacctagctatgtatatatgtaaacaaataatatgtaagtagggtctttgctctaataattaaaaactataatattgcaagattctttagacagaaccacaaaacaatatatgacgctgaaaaggtaataacacaatgaatgtcttaaaggacatcataatagaattatccaaccagtggcatcattatatttgttattttaaaagaaaaaagttgcaaaaagttaaaactccacctcacaaaacacatcattgtaagttttacagggattaaaggattaggctaaaaacaattaacagtaccaattattaaaagatgaataaagagggggtctgtatatatcaaagccataaaggaaaaattttaaaaaattctaaaatcgagtataaaaatgaaaggtttatgttcattaaaagactcactatagccccacaccgtggaagacagcctatgggcaaccagccacaattacatccaagcaaatcaagccagaaaattctccaaattacaattcaatctaaaagtccccaaagcttagaaggaaacatctagcattaattgccctgtgtcagcttcagcctggaacagtggttctcaaccagggctagttttgcccccgaggggacatttggtaatgtgtggagacacttttgtccttcataactggaacagtgctaccagcatcttgtgggtagaggccagggatgttgttaacatcttataatgcacagatcagcccccagcacagaaaaatcatcccacccaaaacggcaacagtgcccaggttgaaaaaccctagtgtagaagagaaaaggggtttattctgtggaagatatgactaagtggggaccagtcaggtgacctggaggaagaagtggacacaggtctaaacctcaggactctggtcaacgtggaaccatcactgggttaattcctactataatacgtataaatcattaccctgcatatattaatagttgtaatttgctgaagccttcctttcccctcaccttgtcccctccctcaggtatctcatatagtgacaatgaagtgttataaccctcaggaggtacatgataaccattgaagatactgatacgaaagtatggatatgtacatccacagaggaatgactgatgaggcaaatcaccccttccccccattagttaaaaactctagaagaatgctctgcccctctccttcttagaggcgtattttatttgctttttctctccttattatacaaatgcatattaggattttttttgagtatatattttaccttgcctgtaattattcctctctcttttttcaaaatgtatacctgaatcatttttaaaattttaaaaaaagaaataactaagttactataaatgatgttacaagacaagctggaaaacagtttggaaaaaggcagagtcaatattcttcatatataaaaagttctttcaaatcaatagcaagaccattaagaatgtaattgaaaaatcaacaaaggcaacgagcaaatgctctagagtgagaagaaatacaaatagccaataaatacacacacatacacaaaagtgtttcacttcaatagtaataaaaaagtaaatggaaataataaaatactatagtatgcttacaaaattggcagacattaaaaatataactgctacttatacactgctggggtcagatgtgaatgtaaataatccaatcttccttaaaatcattttgattatgggaaatttacaaaataaattactggtttctaattataaatgctatacttgcttgtgcagaaagtttataaaatatcaaaaagtataaaaatgaaaatcaaatcacctatcacttcaacacctgagaaataattttaacgttttgctatacttttcctagttttatctcaaggtgtttatgggtatgtgtgtatcatgttatacatacagtttagtgccttgctctttttcacttaggattgtattgtgagtgtattcctatactatcacattaccttttaaaacataatttatggttgtaaaatatgatgtcatatttgtatagctaaccactcccctattgtcaaatatgtaggtttttcactgtgcttttgtttttgtctttcataaacaatgcggtaaacatcatcgttgtgcctcaatcttttctgaattttcaatgattgctatttgccaagattttacttagaatgacaggaaaatgaagacagtgtgagacaaacaaaaaatagatattttgcaacaaacagaccctcattacaggaatttccattaaaatatactgtacttcagacagaagaaaagtgcccacagacaggacttctgaagtgcaaaaaggaatgatagacaaaggaaaaggaaaatatgtaggtaaaaccaagcaaaacataaactatataaaataataatatcttggaagttagaaaatgtaacacacaaacccatatcaataatgccatataagttagagctaaagtatcctaaacttcttccttgtattgtctgggaggaacacagagatactgattaagtttaggctctgacaagtaaagtatgcatgccaaaatctctggattacaaactaagagaatagaatagggtggttatctttaagactaatgagcataaaaaaataggaaaaagaatccaaaattagaaaaaaaggagagataaaaagcagaaaatattaataagagagtagaatttccataactctatgtaggttaaattataacagaatgaaaaaaaaaccccatctgattgctgttaccagacaaccaagacaaaaaggataaagaaatatttaatataaaaggataaaattttaaaaagatattctaggtacatactaagagagtggcagtagctatattatcagacttttaatatcagaattcttaattatcaaaattcaaaaaagactactgaaaacagaatcaaaacacaataagaggttcacatcaccagaaatgcagtctccctaaaatgtatgcacttaataatataaaagatattcagaagaaaatagaatatgtttatgacttcaaggtcgggaaggattttcaagtaaggtaggaaaggatttttaaagaaggacccaaaagactgcaaaattggatggtataaaattaacaatttctttgtattaaaagacactacaaagagtaaaaagaagcagcccacaaactgggagaggatatttggaacacacaactgaaaaaaggttagtatccagaatagaagaataattctataaataaattttttaaaagacaacccaatacaaaaatcaagaagagacatgaacaggaacttaataaatgagaaagccagaatgaccaataaatataagaaaagatgcccataaatgccaaagaaaaccacgaagatcctatttcatacacaccaggttggcaaaagttaaaaacaacctaaaaaaatagaaaagaagtgttggtgaggatgtgaaataaccagaactttcatgcactcatggtagaagcatcagtggaacaatgactgtggaatactatttgccatttcttataaagttgaaaataagcatttattattcctcaataatttcattcctaggtatatgccctgcataaaatcatttgtacacatacacccagagaagtgtaagaatgttaatatcagcattgtttatgatagggaaaactggaaaaaagaaatgcccatcaaaagtatatgttcttgtttacaatgttgaatgctacataacagcaaatgtgattgaaatttagctacatgcagcagcatagataaattttgggaatgcagcattgagtgaagaatacgatatgattccatctacaaaaatattctaaagcaagcaaaactgaacaaaatatcattaagggatgcaaatatgtgccaaactataaagaaaattaatgtagcaataaacacagaagtcaatatgatagttagcacgaaataaggaggagagaggatggggttaggaggtgacacaaggtaacttggaaattaatggcaataataaagttactggtgttctttctttgtattgttaccgtttatcccttacacacatttcatagatttaaaaaattacctattttatattaaataaaattctaacaaattaaaaatgaatatactagctgtgtttcattaaggtagttctgagcctaactgtattcacaataatctggcagccatgagagaacatctttctgcgaactagaaaactccaaaatggaatgcagttattctacaaattattctggttgttcaacatccttggaactactctaaattatgctttgcttgggaagaagatgacaatattttccattgattggtactgctcaagatgcagttgatttttttaatacccatatgtttcactgagaaaagagatgatatcaataatgagtttaaagagaaagatctatgctgacaaaaatgtttgcttgatgcagaagttttagctctaaaagaaaacaaatttttggaaaaaaactgtggcagtttatattttcaaaatatgctcttctttataatgcgaccttggcacacttgcttagagagatggcatctctctgtcccctccttttacttggacagagctttgtgaccgacctacagagtatggaaggactgatgcatgatgacttgccagcctaggtcattaaaggtgacagagcttcccctcaaccccaccttctcccttccataccacattgctagctctgcctgtctctggacacttgccctgggaatctagctgccaagttctgaggaagcccaagagaccacaagtgggtgttccagccaacagccccaattcatgtactagctgacagccagtttcaatgccaaacatggaagaatgcttttaatacgactccagtcccaggcactatctgcctgcaaccacataagagaccccaagtgcaaaccaccccagttgacctgaagaaccaccatagatactgacgatcagtaatttgttattatcttgtcaccaagatcggggcagtttgttacagggcaagaaataactgaaacaaactatgattttaagctcctttaaggcaagtagaggaaagaggatatagaatattacactcatgcaagacgcccaggatgtacaatgaagccctgctactaagtagctgcgtgcctggttaagctctgtgagcttcaatttccctaagcgaaaaaaagtgtcgatttatatcaatttacatgtctcaaggttttttaagcataggatatattgcatgaaagtcagatcatatacagtaaacaacaaagggcagctattgacattagtattactgttgttagggctggtatttgggtggccagcgttctcttccagacctcttccattcctatatgggccatagatagaattctccactgctcattggctgagaacacatcaattgtgtctgcagctcacacgagggaccagttagtttcacttttctctgagtttgctctttctttcctattccttaatcttggttctgattcccaggcagcaaagcctagcaaataagagaggcagcacagtgtagtggatacaggcataaatgctggagctgactgcctgagtttggatcctggctctgcttcttgctgtctttgttacctgggacaacttgtatgctttctttgcctcaatgtcttcatcttaagaatgggactaagaatactatctatcttacagggcttttaagaggattcaaataaatgaattaacatatatagttcttagaactttgatatatagtaaatttcttagtaagcattgagagcacttgttcactaagttggataaagtgacttattttggtaatgtgaaaaatagacctcaatagaaacagaagggctggcttcacttccaaccagctccccagtagagagtagggactgggttttgactaggggattgggtacccctacagtgacatcttgaagacacattctggtagccattgcttgacaggcactagggacagatttgaaggcagggtgtgataggctaactattgctgtacttctaaaatctgaaacacataaaacatgctccgagaaaagtgacatgaaaagtgtgacttatataccagactggggctagaagaatagatgaggaaatgagaatcaaattgtgctaccgatggacagaaggtgccatgaggaaggcatcatttcatctgcaatgcgatgcccagacatgttcgataccctaattatcacgagaggaaatgccaattctttgtcagcctaagtgattttcttcctctgtcccttcctttatgctctcacagaaatgaaggagaaccaagctgatttgtctctttcaaaagactgctcccaccaaagacattgagtatcattagcaagaactgcttctatagcacaatgcaaataaaggtagtaaaattcacataaccatagcagactacatggtgaaattggatctaattagcaagtgtcaatatagtattttttttttttttttttgctaactttaacacttgcatcctttgctatttcaggaagtctgcagaagatcttcttaggcatgcaacctagaagcttgtacttcctgttaagttactttatattaataaggtagcttctctctgaaattctagtgctaggcagttccttaaatgacacagaagaaaactttggcttttgaacagcaaacccagcagcacaggtactgctactctgataaggttagcacagaatgagagagtgcggccgagggtgacgggtgtaattaaaattatgttcggctgctgatctgccagacagataaattccataagcactaaattgcaccagtttgaaggggggggggtagttacaactgactgctcatgttttgttaaatacaacactgatgtaaagctgggatccttaaactttgctgtgattaattaacatctcaccaggttttcagaataaaaggagcaccaacctttgacctattgaaatatttaaagtaataatgcagaacatgggagaaaatgacctgcttactgctatctacccctctgtggctctaacatttgaacatctcaatcattaaaaataatttcctgctgtatagagcaattactaggaagggagccatctgacatgtaaaaaaaaaaaaaaagtagaagaaccacaaagctagaaggggaaaataaaaaaaattgaatatccactgatctcatgatatgtcagtcatctctaccatgtagttaagactggaggcatccactatatgctccagcaattccacttctgggtatttatccaaaggaacagaaatcaggatctcaaagagacaacactcccatgttcactgcagcactgttcacaagatccaagatgtggaaataacctaaatgcccatgaagagatgaatggaaaaataaaatgtggtatgtacatataatggattattattcagccttaaaaagaaggaaaactcataatgcagcaatgtggatgaatcttgaggacattatgcgaagggatgtaaaccagtcacagaaggatacatactgcatgattccacttatatgaggtatcaaaaactgtcagtcaaatggatatcatcaaagagtggaacagcagttgccagggggaagagaaaatggggcattactaatcaaagggcatgaagtttcaattaagttaagatgaataagcactggagatccattgtacaacattgtaattatagtcaacgataatgtattgaatacttaaaaagaaggtagacctcatgttaaggtagatcccttttccaggccttatctcacctgtgatgctgccagagcacaatgaaattttttcaaaaaagactggcagcatcacaggtgagataagtcctggaaatgggacattaacagcaagccagcaacagtgggaaataatcctacacttgaagcacctgctacatacattacctctgcccatatcactcccttctaataaattcatttaacatttaatagacagatatttcatgagcatccactgtattctagctattctatttacacaatggtaaataaaacataattcctgtcctcaaaaacaaagaagcagctgggtgtagtggctcatgcctgtagtcctaggtaccggggagctgaagtggttgaggtgggaggatcacttgatctagctaacacagcagaacctgtttctaaaagcaaaacaaaacaaggaaggacaaagagatcaggagaaaaatctaaaactgaatgaaaagtgatacaaagggtaccatgaaataaactagcataccattttacagatgagataggtgagattctgagaggtcagccagcaataaaaccgaggttaaaatctaaatctgagtccaaacctgtgatatttccagtccatcatgagcctccttctagctgcaggaaggagaagaaactagtcaaggcagctagggaggtattaaccccactcaggaatacattgcgaaggaaaattgggcttaaggactcatacaaacaagtgaggaggctggctttgaggaatgatgaaaactatcattaaatagaaggaaggcatacagagaaacatgcctgcaagaggcgagattctatatacctgaggtcatctagctctccatagggatggaggaggaccaggctagagaaagaaccagacaaataaaaacattggctcagtgtggtcaggaaatgggtctccttcagttgcaactcatcaccaccaagggtaggtaaaacaagaataccagagcagttaattttatgtgtcaatgtggctaggccacagtatccagatggtaagtcaaacattattctagatgtttctctgaaggtatttttgtagatgagattaacatttaagtcagtagactgagtaaagcagatgactctccataatgtcactgggcctcatccaattactcgaaggctttaaaagactgacctcccctgaaaaagagggggaattctgccagcagattgtctttgggcttgaagtgcagcatcaattcttccctgggtctccagcctgccagctcaccctgcagatgttggactttccagctgctataactgcatcagccaattccttcaatacaatttccctctccctctccctctccctttttctgtccacacacacaccctctattggttctgtttctctggagaacactaacacaaccacattaaaatacagaaccggcttcaatatccagaagaatccaaccaagcctggagcacagtcaatccaaagctgcctcccaggtgctggtctgagttgctgggccaaggacctccacaacattcacaggaaacaaaaaggaacagcaggctggatggcttggtggacttgttctagggtgagtaatttattcattcgtttgataaatatttattgaatatctattatgttccaggccctgtgtcaggtgctggtgaatctaggctctgattcacctgaatcctggcacagagtagtcattcagtaaatatcctttaaatgaatgaataaaatcttcattctaaaataattaaactcatgtatttttatgattgttttattttctgaaaaactccactgctgatgactaaatcaggaacttgggtcaaaatacctagaggacaaacatcacctaaaggaccaggtgacagtggcaagaattcctgtgagagactgagagttctgggaccctgcttcacaggcctgagactttctcaagctctttccatgttttgaacttgattttttgttagggggaaggagagatgacacacagatagtgccttcagagaaaagtaggccccaatttatacaaataatatagccatcataagctgttaggtcagttttatatgaattcaatgcttataaaaatctagtgttaatggaatcccaaagtggcttcttttgtagagccagtaatcccctgccctgtcccagagcagtgctatccaatataactttggtgatgatagaaatgccctatatcatagtgtctgatgtggcagccattaatcatgtgtgggctattgagtacttgaaatgcggctagtgtgaccaaggaattgagcttttagttttatttaattttaattcattttaatagccataaacactcaatatccatatgtagctagtagcagatacagactaactgaagggtgtggtaaaagggtgttttaacagagtaggtctctccaggcatggggaggcttcttccatcaacccccttgcagagcttatcagcagtcagtatggctgtagtccatcctcctgcccccatacacaccaccccttttgcacccctcattctctcttgcacaaaagcaggcaggaagccaaatctcagtagagaccttgtagctgcactgctgaaaagcctgctgggcaaggaactgatgagaaccacggggtgaaccataaggtgggcagcagggagagtgagtgtctatgaggctctgtggtcagaataaacttaccacccccaaactgctgtgcccttcagatttcaggaagccaacctctcccatcccccctccaaactggtataactaagagggagggcattttccaccttggggtacccacacctcttgtgctccactctttaagtcaggtgactctgacacaccaaagcatccagctgtcagagtggtgaatctcctctgtgggaggcaagctgcttccccagggacacaggtgaagggctgaaggagtagaaattacagtatgaggacacatgctctctggccacatgaaacagagtagaaaagtcacctcagccaggctcttactgggcaaaatgctgtgtcccagaggaaatgtaattcataggactaccacttgcagactctaaatgacagaatacaggatctggcagagaaggttcactggaaaaaggtattatccagcacagcaacacagggccagtggctttgagcatgtttaccaatatgttcagtggcctcttggagcagcaggagttccttgagcttgctgccagcatcccagagacactgagagagaatgtatgtgttgttggggatgttatccctgggggtgggcttcatattccagatcactgcttaaggtaggaagtttacagatgggtcctggggtagagagatcagtgaggtccaaacctcctacctacctactctaggactctctggaaatgagactgcctcagagaagtgaatgacagaaccaatgggcaagtgaacacatgtgaaatctctccccgagactcgaccccagaatgagagtgaggcttggtgggaactaagccagtttcaagacattgacacatccagacaatgtgtcaaataggaaaaaagaaaaaagtggtcattatagaaccaagaagaaaatgagagcttgagaggcaagcactggaagcaccctttgaagacctctcccaaggggctgggacctcagtccatggatggtcatgtgagcaagactaaacctaaaagcagccaaggtcatcaagctattttagccagggtggtggtggggggctgcctgcttatggtcaactgagtccccttgctctaattcccagctcacctaacaagcacgaattataatctggctctcagagagccatacccagagagtaaaactggcccaggatgtgagtattttggtctccatctatttaacaactgtccagacttgataagctatcttggttttggtttatagaacagtcttttgagaacttgcttcatgtgacctcatccctgagagactgagccactctcaatgtaaaactaaaatcaagtttcagatctgtaaaactaagatccagacagatccaggctataataaatatgtcaaagaaaaggccaccttctacaatcttttgtcataaccagctagacttccttaatgataaacttatatgacttggttaataacaataatttaaataatcatcttgactgatccttacaaaaacccttgtgcggcaatttatttatccattttaaataatagggaactgagacctagagaagttaagtaaggcacccaagactttttagtggaagagctgggattaggccctgggtcggcttggccttaaagtcctcacacgtgcaactccaacagtgattatcaaacttggtttggcaaggaagccagagatcatgctagggtcatggcaaaagccaagaggaaaccaaatttattagcttctacagaaagggtactagagggctaggtatggtggctcatgcctataatcccagccctttgtggggctgaggcagaaggatagtttaaggccaagagttcatgaccagcctgggtaacatagtgagatcccttctgtatttaacaataatatgaagaagaaagggtactagaggaggttccgttttgtttactacaaactggatttgatcatctgtttgttgctcaaatttgcctccccaaggaagcatgcaaggagaaaagagacacatgccttagaaatcatgtgggctgggaggcttctgctatttcatgaaagcatgagcactttctgtgggtcaaaaatgtcccctcttggactactgttcaaaaggatttcctttcatgagttcacacactgtattataaactcttctttagaccagcattcttgagagcaggaactaaagcctaatacacagcctggcacacttaaaaatatataccgggtagagtgatggatgaagtaatgtcctgccactcctggggataacagccattagctcttggccctacggccatccaagttactgctttatgattcatttagcatttatccaacaaacatttatttttggacaaatgagcggtttaaaggtctgatccaggaggacataacacagcttaatgaaccattagtgactacgccatggcaattcgatgcaagagcagaggtattaaacaaggcctctaagtacaaaggacgcaaatggcaatttacaaaggaaggactgcagcttgccaaacaaaaaagaaaaaatgttcaacctcacaagtaatcaaagcaatacaaattaaaataggaatcaattctggggggaggtctagcaactaagaaacacttaaaaaattctgtgtctttttaactaacaactcaggattagaaaagatgttggcaaatgaccagaccatgggagtatgagttggtagggcacttttgggcagatatgttggtagcatggatggattaaaacacctaaagttatctatacttttgatgtgtaatttcattttagccatttatcctatcaaagatgtggacaaacgcctatctgtaataatgctaacaaaatattttgaatagcaaaaaaaagtcaacttaaacctggcaactagttaaacacatcctatgacagaatgctatgcagccctttaaaatcaattcctcaaaaaactgattcgaggggagtttgtgatatatcttaaagtcagaaaagtaggttccaaggcactacctataaaatcattcctgttttgttttaaaaagccatagtttctgtatttttcttttctctacattaaaataattaatatttcccacatgttcaataatacatattttgtaatttttttaaatagcatttaagtctcacaaataaaactaacaataaccactcaaatttgcgtgggactctgtaccatttcctaactctttttattccccacattatccctgacttggaaagagaagaaacaatacatccgatgctttctacttattaaataccacctcacacccaggtccctcatttcatttcaaaggcagaattctttccattaaactaaagttaggtctgccctgaaccagtgtcaatttccaaaattcaccggctctcatgttgaatttctctgagttaacataatccagtggacttcaaaaacagcaaatgtaattatgccatttctctagatgtaaatatcccccaatgggaaaacctagcagctactatatgtttgtaattctaattcttcccaaagagttttaaaaattataatatgtacagtaaggatgagttttgtaagtgttttcccccagaattatgaaagcacattcttccttgtaaattatacgtggcataactacagcaagatgggccatgttttgggtcttgtttcaaagatattccattttaacacattccttctaacaaatacaaaacactcacagcctgcactgtgcaactaacaggaattatcagaccctgttttttaacggtagacaccatccagggaattaataccaagtcctcaaagcctaagctttatctcagaaaaactctttttatcataatcaagaattaagtgggtggcgaaaatgacagtggcaagaatgattaacaaatgtatggtgtacatacagttctagcttgtgggtgaactatcaaagaggagtttacaatatagatacatacacacacatacatacatatgtgtgtgtatattatatatatgcatgtgtgtgtatatatacacacacgcatatacataatatataataaaaagaaatatatatatattccccatatatatataatatataataaaaataaatatataatatatacatattccccagccaggaatgccatttcttttttggcattctctacatctgtccatctcctcaaactcactagaaacttctgaacagcaagctacatgtcaggagctcagtacacgtttgctgactcactgggagtaccaatgagaaagatcctccccacaaacaaacagataaacatgtctcatcccagaggaggaatcccagtaggttagcgtggcttcatgagttgacaaagaaaagaggattctcaggtttgggaacagcataggcaaaagtctaatcattttcacaggacaatgagaatgagcctggttataccaaaagggaagaatgactattccattaatcttttaaaagattaatttggggctggggaacaggggagtgggaaggagaaaagaacaggcaagaaagcttgtgagcaggcagtgcagcggggaagctgagagatgatggtgccagaaaaaggcacgaggtagcgtaagtgaatagaagtgtgggctcctgcaatgtggaaaatgacggtactcacgagaaaaccaagggtgaggaagcccagcaatcagctaaggcaaaaggagaagagtttgcggaaggaaggaggtggtcaacatccccaaaatctatggagagaaagtagctgaggatttagccatcagggttgctgtggtgggggcaggtgatgagaaaagggaggcagtcggtatgttcttcacgatgaactcagaagcatggtggtaacgaggtgttcaagacaggagagaccctaatggacttgaaggctgaggatggaacaggcagagaaggagggggcaacaggaaaaaggaaggtggttcaccaggtgtaaagggattcttctgttcctgttcctgagaagaagagatgcacaagaactcggccctcacagcctcagtgcagctaaatcaggaagaagtgggcccgctaaatggctggggatgggcagagaggcaggtctaggtctggacttggcagggctgcttcagggtcaggaagtgagctcagctcggctatgatgcagctgaatgagagcccagtgggggtcaggggagatgaactccctcgtggcggccgaaggcctgggtgagggtggagcagctggcgatctgcaagaggagactggagtcccggtgtgctgcagcctgcagtgtgggaagcatggaagcctggatgctatggagccacaatgtcagtaagggctgaactccacaggagaggacaatggtctctgaacatgctacgtgccttcgaatttgcatgcctttgcatttgctgacaagcctgcctccctaccaaacccctattccttttttcctttctattgaaatgccccacgtctgtgaagcccagcccccaaggaaatgcagggctgtttcctcactgctcttcctgcatgttcatgccatccttcccttgtccccgggactcaccttgcacgctatctgaaagccactcaaatgcatgaaggggtctccccactggtagctctgtctacccctctccctcacctcattcacacttacaaatccttccagcctcagatcaggtgtcatttcctaatggaagcccttcttccctgctcccacccaaatgaggtcaacttcaaccactcttctctttcatggtaccttgtacttgttcttcagggcttctctatgttgttattaattttcatttattttttattttttgtagagatgagggtctcactttgttgcccaggctggtcttgaactcctggcttcaagtgatcctcttgcttggcctcccaaagtgctgagattacaggcatgagccactgctccccaccagggctactcctaacacacttagcatattcctaatcacacactgtgttttataatagtatcatcacagtccatgtctcccactaaactgtaagctccatgagagcagaacccttttcttttttaccattacactctaccttgtagcacagtggctgacctcgagtaggcactcaggaagtccctgtcaaataaccagcaggtgaatgacttggactccaatagccatgtgctgcattctctcctgccctggaggacaggctgctcagggtctaccatgcagtaagtccctgccctcaaggagcccttgacctagggagagagacaaatgaaaccaagcttttcaacagagagtgaagaatgctgtgcgagtaccatgtacagtgccgaggggaaatctccacccacttattggtggggtcctaccaggtgccaaagttgctggagacacttcaccaagatgacctcatgcagctcctcataatacccctacagtgagccaagggatggcattctccgaggcagagctgtaaatccctacaggcagctgttggtggtgagaaccccttgcacccattgctgtgatgatggcagatggcatgacggtgcactcactgtattccaagccctatataaaatatttcacagacatcatctcctggctttgtcacactccatgggctcagcattatcaataagcctgttttatagcacagaaaactcgggttgtctcagagaggttaaatgatttgtccatcctgaggctaggaggtagcagaactaggaatgaaacctaggtgtgcggagttccagagtgaactatgaggctgtggttaaggaaatattcagtccaaacaggagccatgtggtgatgacagatccacagttgagaaagggcactaggatgtggcactggggccaggctggtgtggacagtggcacggattacagcagctgcattttccaactgacaaagcgtgtctaggaggaaaattggagaacacaaaagggcacatgcgggcggcccagaggggtccaggtgtaggcctgcccagccttggtgggggtgggagggggcattggctacctccagagtgggttctactgctggggttggctgtggctgagttcttccatcagatgcatgccttccctgtgagtgaggccacaagcaactcctcaggccctgagcctgacattcacaggactgccacaagttagcacctgaatttaaatcaggccaaattagtgctatttctacaggtgtctgtgctgcttcttttttctctccctctgcctgaaggaggagagggagaaagcaggcagccaaggagcacagccagccgtatcaggaccggagtggtggctgtcagcccctgcggctcccccagcggatggcagctgtcagtctgaatcacagaacccctggggaagatacagggtcttcactgctttcaggaagccatttctgggcagagactccgatttgcaaggcaaaggcacagacactgtacctctctgcaaggtggctatttttccaaaggaagggtagatggaaagaaggacggcaaagctggaagagggtgaattaggaagggagaggaggagatgcaagctataaccagggggaatgctcacctggggctgctggctgctgcccttcaaggatggcctgtctgccagaccatccctcagggtggggcttccagtctgagactccttggagaagaagcatgatcctgaggtcactgtgtgctcatgccctcccccttgtcacaagaatgaatcatagccagcctttgctgggactgtgcctaacccaagctggagctgtggtggggagcatgtgtctgctagcaagtcctcaccccacggtgcccaggagactactcaacttgccttctctcttagctaagctgaacaaaggcagtggggaaaggagagaccaatgccaagataggagcagggttgcattgtctctctgttcagactccttctatgtgtcagcccagtgctccatgctggggattaaccagggattgaggcagagatggagctgccctcatggagctccccacaaggatgagagtgaggagagggagactagcagaaaaggggaggtgtcctcagaacaactgcaggggaggcaggagagagctgggcttgcataggaaatcatatgtccctgacagcaaaaaaggactaagcaacactcaaggatggtgggttaaagggtagtgcatctgttttcttgaagaggaaagaagctaatacctgctgggtaccagctctggcaaatattaattatttttctaattaacccttatccatctagtaactctgagcagggaggttgatcacatagttctggatttctctgccttgcccatttttttttttctttaacaatcagcagctcttggagaaggtttgcaggtaaggaatagtcaatggcaagacatatgaagacttctcttccatccaggaagccctctctgatgatcccatctgctcctgtgtcctcctccctaagctctctctactttccttccttcttgttgtacaatataaaactatcaacctgtttgtttatctgccctgcaaacaggaagctgagggcagggatggcatgtccagcactgaacacagggctcagaatttgtgtcatggaataaatgagtaaatcaatgaatgaatgagtgattgccattctctcagaccctcacaagcatgccgactaatttccagttcaaagagcccaggcactgaggcagtcattttacaggacggtaaggccggaatgtgatgggagggaggcccctccacctctgaggcttttcctgctccaggcagttcctgctgccctgagcactgcccccaggctaagcccttgggaacctgcttcataaacacttacttagcaagacatttaaagtgctattgatttctctcctcagaaggaaaggtgagacagtgatagacacggtgagcagttagcaacaatgagtcccattcaccccccaaccagaagtcatttccctctcagattaccagcccggcagccctgggagagagagagagtggctgcacgctaatgtaggcagtgctagaaccagcaggtgctctcgctccgatagtggcaattagagcttaagctcctttttctatgagacaatgaaaaataaagctaatttcagatggcatattctgtatacctgaatccaaggcacccttctcccctacttaggaagaaagacaggagcccatgcctccccaagaaccagaaggagatgcctctgatccaagtcatggtatcgtcaacaatattttcaagcacttactagatgctagacagagatcttactagacgggaataggtactgggaaatggaggcacataacaatgtagccctcatcccctgtgcctagcctatgatggacagaacacatgtgtaccacacatactagatagatggattaagtgctgccctgcaattctagctccatgagagcaaaccttcctctgtagtccaccttgttaggctcccaaatttccagaacacttgtctcatagcaggtgctcaacaaacactgtttgaattcattttgtattttgttaaggtaacagcagctgctataataaatgcctaacatctaagtggtttaggataagaaagtgtataatcaccactgtcctctccaactaagatcagggaggagcaagatcagcatacatatactcccttagcctcacttgcagatttctctggggtgagctgtattccttgaactcatgggagtcgctaacctaaaaaaaagtttcctgatacataaatacgcgttgggaataacagacctagaaatgaagtttcagaaactccagttgcttacccctgatgtttgaggctgtggcacagctgagcagggagaggtgacccaggggtgctggtctcattcacgtgggtggaatgcagccagtagctgcatttacatactttaatgatcacataaatgggagttggtggcagaggccatatcagatttgtcatagaatagaaaaatccctttgggaaactaggtattagggaacaacaacagacctttctacctaactgcaagaggggttgagatgtatgcccttgcctgagggtggagctgtctctcccgtaagtctgttgtgggggaacatgaagcaaaagcctcatggattgaagaaagaaatgccactgaatgattcctctcctctgctgacatagagggcaagacagtttaagaagctatgtagatccatgcttttgtcaccaaagtctgagactcatgaaagaccttactggatgtcaaattactctgtcttaggggaaaccagacctctgagcactccctctaccccttcaccccagtgaagcttccctgcatacaggatgctggtatctggcaggtaaggagcaggtacctgacaatgcccagaaccaggcctgggaagggatgaagatcccagtagacatcttctgcccctttcctcttcctcctgtagaaatattttaagtgccaaggtttcaactgactgagtggtttgaaagtgaagaagagaggtatggaatggagggatttaagagagaaaaggaagaaggcagggaagggcaaagggaataactacttaatgccagaacaacaacaaaaaattggtgaggagctttgcagtggctttaatttactttcctgtcctctctggctctcattactttttatagaaatatattttttgtgtcacagattgacaatgacatgagccaaggaaagaacttatgggtcagggctgtttgaaatcagatggatgccattacttggttttctaagcaattaataatcacaaattgcattgcttatttttatatttattaatgaaatttaataaatttatcaagtttcacccctagaaggtataagctctatgagagcagaaactgcgtatgcatgtctgtattcatcagtatgtcctactatatgtccggcatatagtaggaaacaaaaacggttctctgacttttatttaatgcagagagctgatgacagagggtggaaagaatgttgttacacagaccttcctattgctaataacagtgtagatgatgatgatcgtggtggtggtaataatgtcacttattataagctggatcccattccaagtgctttattttgatcatttcattaaaacctcaaaacaactccacgaggaggtattgttattcttatttccattcttccaatgaaggcatgaattcaacaggtaaaggatttgttaaaagtgatttaactagtagatgctgaatctagaaagactttatcactctgcctttctgcctgccacacttttttttttttttttttttttttttttgttgttgcaacggggacattctgcctatacccggagccctaggagaacagaggtgaacttgagacgtgtagacaaaataaattatggatcttgatccttgaggacctcaatgcccatgttcatgctaatgatccattgagtacttgaatttcagttactacttttcctcagtattattccaccctgtatgctgacctttgcagaagactcaagttggaagatgcaaattcagattacaagctacctcacctgctacctgccacctctctggctctcctacaaaccagatcatccatgcaacaggtcccacgcccccatgggcagggcccacaccatcagtaggaaaggctttgctaatgatggcctagagggaggagtagccctggcatcagagccctgtgtatgatttagcctataaacccaaagctgttattagcttctactaagccaccacattgggcaggtcctgaaagagaagaacagagcagccccatcaaagggaaccttctatgcacccagagcaatgctgggtattcacaggtatacaggtgcctggctcttcacctgaacaacagcttccctccatggtagctttcctaaggttaggttatgaccaaatatccctgcaggcaacccattcattgctcctatactttgaataataacagaaccggctgctggctggagtctgccaaggttacctcccaggagagcttctctgaaggttaatgcggagctgtcatgcacagccagattttcacttaggcctttgttgttcctcctgcacttgcttccctgctctggctgtgtccagcagcttcccagtgcccactaggtggtgatgcccgcagagactgggctctgagcctggagcaaaaggaccatcagtatgaattagtttccagctgaagtgggcccacccagcaatccgaagaggtgggaaggatggtgttaacagcaagctagcacttcatgagggcttggattactgttcaatgcattctgatgagcaccatctgctgccaatccacactgggcatatgtcttttcgcccaagcactgcactgtggctacaaattcatcacaaagcatgcataggccttgcagagaagagataagtgctggagacaatctccaaacatatctgggagcaagggaagacaggtggaaaaacactgtaaatacaggcccacaaaatacataagggacaaatactgcctgagacgtttagcaatacccaatttgccatatgacagaccatagaagtgaccagagaagtttctgcaccagctgaagccttagctaaatctgttgcttaaactgcttcttttgtttctgtatggtatgtttgatgttctaattcccattcaactatgagatccagttcatcctaaaacttttttgttgttgttgttaaaaacaatcaatttcacatctctctgtattaatcatcagcactaggaatcagttttcttttgggaaccataagtgtctgtcaccccatgagagatgatgaggcataatggctcatcaagatggtcatgcccaaccatctgctgaactcactggccaaggaaattgttcctactgtccttctaagcagtcagcaagtgataaaggagggcctactgtgtacttggccagcactagattgcccagacaatgtacatgtatcaggcaaaaaggctaggaaccatacatatttctttaaaaaaatttttaattacatttttttaaaaagagcattgtaatactgaagaagagaaacaaagtatgaagtctcatattactagatttcacgacttactataaggttacaataataaaggcagcatggttgtggtggaaaaaaaataaacagattaatggaacagaagagaggaatgagatatagccaactgattttttttaaaggcacaaaagcaaggaaaggatagtcatttcaataaactgtgctggaataattagatattcaaatgcaaaagaatgaacctagtcagagaccttctaccttacagaaaaattaactcaaaatggatgataggtctaactgtaaattactaaactataaaacatctagaagaaaacatggggaaaaaaatctatgtgatcttgagtttggtgctgaaccaaaatcacaacctataaaagaaaaaatagataagttggactttattaaaattaaaaacttatactctgtgaatgacactgttaagagaaccaaaaagcaagccacaacctcaataaaaatatttgcaaaacacatagctgataaaagacttgtatccaaaatacaaacgctcttaaaattcaacaagaacataaacaacccaactttaaaagtgtacaaaacatgggaacaaacactttgccatatgtgatagaaaataaccatatgaaaagcttatgaacatcatttttcatagggaaatacaaattcaaacaataataccatatcaccatgtacctattatagtgtctaaaatccaaaacaactcacaataccaattgctggcaatcatgcaaagcaacagaaactttcatttattgctgctggaaatgcaaaatgctgcagtcactttgcaagacagtttttccatttcttataaaactaaatatcttataaacaagttagtaacagcactcctaagtatttacccaactgatttgaaaaattatggtaacacaaaaagttgaactcaaatgtttatatcacctttattcataaacaccaaaactggaagcaaccaagatgcccttcaatatgtgaatggataaacaaactatgaaacatccatacaatggactactattcagtgataaaaaaataaatgagctatcaaactacaaaaagacctagatgaatcttaaatgaatattgtcaagtgaaagaagccagcataaaaaggctatgtaatgcacagttccatttatatgacattctggaaaaggcaaaactgtagagcaggtaaacagatcagtggttcccagggttttgaggtagggaaaaaggagtagttgaaaagatgaagcacagagaatatttttagagtaataaaactatttgttatgatacaataagggcagatacatgacattaggaattagtgagaacctacagaactttacagcgtagagtgaaccttaatgtatgcaaatttttaaaaaatcatttaggaggccaggggatcctaggatgtaatgcagaatgtgacacagtaatctgaatgtattataaaggtgctgacctgtgtagttttggaaatgagtggagattataagcaaacagcctatacataagcactctactctagttgataaagttgtttcccatggaaatagaggctaataattttgatactgggattaaagaattaagtaaatggatagtggatggtgggagccaagtttcctactgttggagtggagaattacagataagcaaggggaggaagctataacgacatggtaatgagttggatacattagcataaacttgtatttagcttaatatagatacatatagaataatttataaatgtatgtacatacatttatatacacacacatgcacacacacatatggattagtatacacatatatattcccttgctgtcaaatgagagtgcagaacaacaacattcccgaagtagtgagcacaatgagtgctaggatcttggtttctaattccattctacaataaaaagaaccaggtctgtttgtggaagttgctgattctatggctgggatactaaatacacaagatgagcctggatattttatttctgccagaaattacagaagtgttcaagagtaggtaaataaaatacaccacagtgggggtatgtcaaagggacacaagaccaacagaaggagtgccaaatgaccaaagctggaacaatttgaaatgtaaaatcttagtattggattaatagttagtattggattataacctcaagcacaaaatatatatccatgagtccacattatataaatattaatacatgctttaagaaacaaataaatggggtaaaagagataaatctctcatgtaaaatatttcaaataatttatgtagacactctaccctgaagcatctacataaggagatggaacattaaatacctactctttaagtgtaggctatgcgtagtaacttcttccaaagagtatggtgtagaaatggggtaaaatgagtacctttgcagtagagaagcctgacaaacactacctcagccaggtgatcaaggtttgcatcaatggtgataagtcatatagataagcatgtaattatgacttcataggatgacaatgacacttgtgctgattcctctgtggatcttgggggttcttccccaaaactcataaccctactctaatcattagaccaacatggaacaaatcctaattgagggacattttagaaaatacctgaccagtactcagaactttcaaggtcatccaaaatgaggaaaatgttagcaaagcctaagaagacctgatgactaaatgcaatgtggtatcctggatgagatcctggaacagaaaaacgaaattaggtaaaagctaaggaaatatgaattaaaacatggactttagctgattataatgtattgatatttgttaattgtgacaaatgtaccatgccaatgtaagacaataatagagaaacatgggtgcagggtatctgggaactctctactatctttgcaatatttctataaatctaaaaattttctaaaataaagagtttatgtgaaaaaattaacattaaattaatgactttgggatatagtagagctttattggacaccagttgctgaacagaaggggaacacagtgttctaagcataaagaatgaccaagaattgatcaagccaagaaagtgaggagagttgtctctaagtgacgcatcaggagttcaccagaccaatcttagaaggatggtgtgtgcaaaggccttcacagccttgattcccatttatgccccagcaacatcggaaattaccatagcagggacttcttagcaaagtattattc

SEQ ID NO: 164 - DNA, 365134 bp, Homo sapiens
  misc_feature (90903)..(190902): n is a, c, g, or t
tgatttaaaacacaaattatttgcttatttttcacactaataacaaagaatatagacactatatatgttccaatcacattgatcatgcagaaaataaatattctttggtactggttttcctttgatcacaaatagatatgagggcaaaatgtcttatcacttatttacaaataactgatggccaaaatggataattgtcatgatagaagttattgacactggctgggtggggtggctcatgcttgtaatcctagcactttgggagaccgagaaaggtgggatcacctgaggtcaggagtttgagaccagcctggccaacatgtagaaaccctgtctctacataaaaaaaaataaaaaataaataaacactctttggttttggtggtgggcacctgtaattccagttactttgggaggctgaggcaggaaagaagttattgatacaaatatttgcaaaaataaaaagttatttgatacccacaaataattccaaagtatgtccatgtgctaatttgtaaataggaaggaagttcttattttgaaacttgcagcctggaaaatatttataaggttgttatgacattgataactggagtacttcctatatcaacttactagaattttggagactgactttaaaatataataaaaagggaaagacagggaattgaacttccttctcatgttttttacaaattttacagggagccagtctcatttatgtaatcacagatttattttacaagtttggacttgcaaaaatatgccaaaatttgaatgccttacccatttttttgggaagcagctaaaatatgtaatgcactgaccttttaatgttcactttgattggttaatggttacacctttacagctcagtcagattgtaaacaaggggacaaaactgaatatataaggtcagagaagtatagtgacaaaatttatgaacccctatacatttcctatgaataaaaaatgattaaaattcatacgtttgctttttaaatatatacataagaaacatcaaaaattaattcaaagcatatattagcaaatatattcttaattttgtcttgaataaccttctttaggtgtgcctttttctacaaagttatgtcttcattaaacatttttcaaattattagtattattatttttaactgatgcttcatattttatttcccctctgctctcccatcccacctttggtgatggttgtgcccatctgagcatttcggggcacatgaccgtaagtaaatcttgagagaggagtggaattattgtctaaacactaacagaaggggattacctgtaaggatagcataactgttgtgcaggaacagaagctgcccagatcttcttggtggagagtgcatagaaaaaagacttagaattatggaacatctgtccccccaaccaccctttcccacccatcccccaaacccccactcccaccctattccccgcccaattaatagtgttaacaaaaggttaatctaacttttttttttttttttgacggagtcttgctcagtcgcccaggctggagtgcagtggcgcgatctcagctcactgcaagctccacctcccgggttcacgccattctcctgcctcagcctcccaagtagctgagactgcaggcgcccgccacgacgcccaactaattttttgtattttttagtacagacggggtttcaccgtgttagccaggatggtctccatctcctgaccttgtgatccgcccgcctcggcctcccaaagtgctgggattacaggcgtgagccaccgcgcccggcttccagaatataaaaaatgagttccatgacgacagggccctcactgagctggcaggcccctccatggatcaccggcaccaaggcgctgtccaaatcattcatggactgcgagggaaggggctggccgctgctccctgcttgatagccagcctgatctgagtcaagtgttacacgtagtcccagtttggtcattccatcctccttcagaagcttcaggagcaaggcaaaaagccttggcaacatgctcagtcaatctactgtgatccgtaggatcactgaggcaattgtgccggtcatcgtttccttgtaatcccagcactaggatttctaggaaatcctgggaatcgttttctagaaaaaacacctctgtccatatgatgacttttccatttgctttgtattctgatccgtggaatatcttcacatttgttatagtctccatggacttcccatctataggacttagacacccttgctaacgttcttgtcatcatccacccaccggatgtgcatgcgctcctggggatcctccgcgtctgccttcccacaggtgatgctgaagtccctcgtctctagcagtgcctgcctcgaggaatccatgttctctgcagtgatctggaccataacgccatcttccacaatactggacttggcaaggtatccagaagaggatttcagagcgccaccgaacacaaaaaaactgctttgagtttgcatatagttacagtagtactgaaaaatcctcgcaatttaggtttttgttttcagttttctctgttttctagtgcataatgacttaataaatattcatttaacaaaaattgaaatctcaaaggtacatataaataaacaatataaataaccatccttattacagttaactttgtgctttaaaaaaaaaaggcatccaaagaaagacagacgtattcatgcaataaaatcttagcaatccctgcaatagtttaacagaattatcagccctcccatcttagtctggacagaatgaaaaaaaaattagttctctcgtgttattctttgagctccaactaggaaaaattactgaaaacagctggacgttacaactgttttgggcagagaagtcacactgttcaggaggaccccatggtagaaactgttttaaaaaagttctttttacttgaaattacacaagaaagcagaaaatgacattgcaaaaaggaaaaaagtataggcaggaacattgttacagaagccaggtgacaatgagaagtagagagtagaaagcaatcaacccttttgaccactgagaatgaggatagtagaaattcaatggctcatggatagcaatagtcactcacatgtcaataacagggattctgaagagtcagacttatgcatacacagagcatctctaccacatgcatgaattatgtgtgagtttggtgataatgaagagagacaaactgctgcatcaactaatatactctgggagtgaagagcaggataaaaaaaaaactgtagagaccactactctaggtcatttaagtattttaaggagaaaaaaataacataatagaagaaagtgataactatctggagtggtgggatgggtggcttctgacacagctcccatgtttctgattccacctcccgatatcttgtattatctccccttcttgagtatgagctggacctggtgccttgctggtaagagacagaattcaacaaaagtaatgcggtgttacttccttggttagctaacaaggaactatgtcttgccccttgctagccacccccaactcttgctggcattccctcttgccctctcgcttgcttgctttgataaagagagttgccatgttgtgtgatgctttgtggagagacccacgtgacaaggaaccaagggagtttacagcacaacacctggcacaaaactaaagccaacaactatgtgagtgagtctgcaaataaatcattccctgtccagccttaagatgactgcagacttttaaaagagtgagagtcagaggccacagctaatccacatgtggattcccaccaacaaaaattgaaataatgtgtgttttaaaatgctaagtttgggggtgatatgttacatataaatagataaataataaagatggtttggcatggagataatgacagaaaggaattcgactattttaatagtccaatgaagaggtatgaaagatctgaatttggatggtagcagtgtgaatgatgtaaaagataaatgtgagattctataaggtaagattttataggacctaccaataataggggtgagaggaggatagagagatgggagagagaaagggagggggaaagagagaaaaggagagggagaagtggtaaatgaacaagatttttagttcaagtcagtaggaaaaccactggcagagttgttttatttaagcattaacaattactttccgagcaactgtgatgtgtaagacattatgttatctgtactagacactgagatgaaccctcaaaatggtgatgccctcaaaatggtatagtgcaaagtagaatgttgtgaaatttttcctaatggagaaattcatccaattagcatttgaggaaaggtatatgtgagttggactttggatagtaacatacagagattagcattagaaaggaagcaaaatatttcattagacatataaagaagtcaatagtttattttcactagattgcaagcatatgaaaaagacaacaggaaaatgtgtctcaattgtcagcctaaatttaacatcttattctgtagtgaaatcacaggacaagtaaatagatgtcttgcacttaggacaaattatttaagtttgttgaagaaatgagatgattgattttatttttaagtaataagtaatgtgagaacatctgcaatcagtaagatttatgtagatccaggctcaacaaactactgccgatgggccaaatctagtctgcagctcattcatgtaaacaaagtttcactggaatatagccgtcctcattcattacgtaatgtctatggctttgacagagactgtgccacctgcaaagtcaaaaatatttactatctgtccctggacaggaaacgcttctcaatccctggtctacatcataaaatggatttgagtggagagaaagaaaaaaaactcattaaaacatatggggtgttactgccttaaacaagtagtatactaacaatagaaatggaaaggaaaagttggagtgtgcatgtgggtatgcatctgtgtgcatttgtgtgtatgtgatgaaaactgtttaaatgcagggtacaatatagaagaggaggccatcgtggtgcttagatggctctgaattgacagtctcctccgttaatatttaagtgcaattttggaggaataagtctttccactcaactcttaagtggtttaatcaactggccatatttttttcctaatggttagaaaggataagttactcagaaggaaaagtagtactgattgagaaagaattataatggaaggtggggggtgattgcatacttctaggaaagctggagggaacagctaaaaaacagtatgatactgaacacttggatgaaagcatgagtgaaagcaggtgagagcagccctaaaaggacgccagtttgcaccaaaagtaaacactggttttcatgctgcctcttgtatatatgtatcaaaagatactggtacttaatgtataaattagaatattaacttttaaaatatgaattgaacttatatggggtttaaaaaaatcaattatttaaaaacatcaccaggttccttttgttgtttaaattctctcctgatagaactaaataggggtctcttaaacagggttcaagaagcagaaacatacataatggtactcaggattcaatgcattaaagattaatattccttgaattagaagagccgaactaagtatccaaacaccagatataggtctagaatagcagatacatctaagtaggtttcaactgtctaagggcacatgcctggtgcagggacatgaacaaattgtgagtaaacagggataaaagccctatgagggatgtttaacattgaaatgtataaagtttttatttaatcacaaagttttctatattggctaaaattttataatgataatgaattattcatgtgaaaattaaaaactgttttttttgtatttttaaagaaaaaagcacaaatacacccatagaacactgtgaaatattatctttcacaatgtacaccaggccaggaaattattgggctaatttgagtcttcaacaaaattttactttgtgaagaaataagacaatgctggagggaccaaggttttcatttgcctgtgctccttctgatgccatctttactctccaggtgaaaggatgtttctgagatcaatattcctctcctttgatagttaccttcttttaaaacctactgaacactgacttactcagctccactctattcttccccgtttcctctgggtcctttgataatagatgctggtatccctgtctgtcattcactcctatatggttctcaggatttgtttgctgttcctccctctgttaacctgagccttgcgggccaaagtaaattactctcccagcaccttttatacagagtggtccatagtagttttcctgacacctatgttattacacatttctctccaagaacatctctaaagctttatgatttatacatttgagttaccttagaccaattgacctaaacacaagatatgctgtcacattttaagctgcttcctcagaatatgttggttgaaatctactgcctctcccttgtccagggtttctaaatacccgtagggtagcttctcaataatatatattactaatagctcagaatgattattatactaacaagaactttttactttcattactgtgtcagaggactcggaatatcattagcaaaacctgtttagaacagccatcttaaatccttgttgaaccaattccagcatgcttttaatttaagtaatcctggcgccgtggctcatgcctgtaatccaatcactttgggaggccgaggcaggcagatcatgaggtcaggagatccagaccttcctggccaacatggtgaaaccccatctctactaaaaatacaaaaatagttgggcatggtggcatgtgcctgtaatcccagctactcaagaggctgaggcaggtgaatctcttgaacccaggaggcagaggttgcagtgagctgagatcgcgccactgcactccagcctggtgacagagtgagaccccatctcaaaaaaaaaaaaaaaaaaaaaaaagaaatcttgagtagtacattccttcccaagatgagcatgcaaacaaagataacatgactttttattctatatgtacgtttgaaagatctctttagtcctttaaaaacttcatgagatgtataattttataaatattgagatgctttgggaaaaatattgaagaaaggccatttgattaggcataaagcacttaaagtgaatgccaagaaagttgcataggtcaaaataggtccacaaaaatgtatagattaatgaaccttccaatgtgaactgactgtttctctgagtgtcttttataattatgggtgaaggctgaggattgggcctggcccagatatggattaggggtaaaataagcagtggcacacaaaagatattttccctgaggcatattgactgaattattgtgatatatgcaagaatgaggagttattccagaagatttcaagagacagaataaaatcttcaagagtatcacagcaactgggagacaaactcattgcaaagaagagagcctgccccaaaagcatggccaactcccttgttcaacacatttctaagattttgaagctgaatagggtgaaatgctaaagggctaagcccaatacccctgaaattaaaatttaatctccaacaacattttttgagactaatgagaagtagttcctaccagctctcaatcaaaagctcaaaaggaacatacttcagaaacagagataagccaaagatgccagtcttactgaaactaaaactgaatcctgactgctccaatatctgattgtattggtaatgactttctcccaacactatctgcttaatagagaaaagtgggaatacattctaaaactactattaccagaatactttattattcttttatacacaatgtccagcatgatacaaaaaacgtctagatatgtgaagtggcaaaaattgtattaatcaaaacacatgtgcacaataagcgcagctcactgattcacagttcagaatttagcagacaaatttagaatgaccgttgctaatataataaaagtaggcaaactggatgaaatgatggagattgcagcaaagatttaaatatctataaaaagtcacacagatattctaaaacagaaacataataattgaacttatgtcactgaataggcttgctttagaataaatgtagtaaaacaagttaacctgaaaagagattcatagaaataatataaattgatctatagaaataatctcaactgaagagatttaataaagcagaacaaaaaagacataaggcactgtcacaacatctactataactaaactggacataaagacaagtgagagagaatggagaagaagcaatatcggaagagccgttggtcaaaaattttgtaaaattgataaagaatatcaacctacttgcaagaaacttaacaaaacctaaggaatataatacaaataaaactttacctatgcagattataagctgctgaaccaaaacaaaactctcaaaagtaagtaaaagagcacaaataagtattccaacaaaaacaatagaagctggagacaatgaaatggcattttaacatgctgaggggcaaatttgccagtctaaaatttaataaccagtgaaaaagcacataaaagtgaagcgcagtaaaatatattcagacaagtaattgttgagagaatgtttgcctaggagaactgaactacagaaatactaaggaaagttcttcagactaagaaaaaattatcccagagagaagcatacaattagaggaagcaatgaaattaactgaaataaaagccttaaaatattggcacaagaagttctaaagatctgagtaagttctgtatgtattatagaaactacatttatgattaacacattttacacacacacacacacacaattccaaccacatgtggattacctggtgaatccttaccaaaacttaaggaactaattgaactagtcttacacaagcattttcaggaaataatacaaaagaaagaacactttaatttttttgtgggaagccagtaatcattgatacaaaaatctgaaagatattaaagaaaagtaatttataaagaatattcaccatgaaaataaacctgagaagtaaggataaatataattaacttgtcttttacaaagtttaaatgttgaataaaatatatgacaaagagtgggagtagctaaatagtgttcaactgctctaaggtccttacattgttggagaagtggaaaaagtacgaacatacttcagaaatagtagtccacaatagttgagaataaatattatatcctctaggataactaaggtacttaaggtagtccacaatagtctagaataaatattctgtaggataactaaaagtactaaaaaggaattacaagtattttaataaaatgaaaaataaataattattctaaaaatggaaaaaaggccaggcgaagtggctcctgcctgtaatcccagcactttgggagtccgaggcgggtggatcacaaggtcaggagttccagaccagcctgaccaacatggtgaaaccccatctctactaaaaaatacaaaaattagccaggcgtggtggcgcatgcctgtaatctcagctactcaggaggctgaggcaggagaatcacttgaacccaagaggcggaggctgcagtgagctgagatggcaccactgcactccagcaggggcaacagagcgattaaaaaaaaaaaagccaaaaaaggaaataagaataaaaaaagatagtacaaatataaaaatattaaatccagaatttgaaagattaaatccagaattttaatacagaagattgtttcagaagattgtttcagaagatgtggaataactaccactcttatagactgttgtgtgaatgtgaatctgaacaaccatcttgaaaattcttttggcgagatctactgaagttaaatgtttgcataccttttgacccagcaattccactcctgggtatatatactcaagatcaatgagtacttcagtctaacaaaagatatatataagatattcaattagcattatttatagtagcccaaaattagaaacagatgaatcatccaataacacagttatatattcataaaatggaatacccctattaaaattataaagtatgaactataggtatatacaagaatctcataaattttgaaaacctaatattgaataaaatcagccatatgcaggagcatatatactgcatgatactatttttatgaagctcattaacagcctattaacattaattcattaatggaatgaatctatataaatagaggtcagtataggagttatctttttttgggttgtagttgactgagttggcaagaagaaggtttatggggtatttgtaagatttttttttttttggaggtggagtctctctctcgtcacccaggctggagtgcagtggcacaatctgggttcactgcaacctctgtctcctgggttcaagcaattcttctatctcagcctcccaagtagctgggattacaggtgcccgccaccacacccagctaatttttgcatttttagtagagacggggtttcatcaggctggccaggctggtcttgaactcctaaactcaggtgatccacccgcctcggcctcccaaagtgctggaattacaggcatgagccaccgcgcccggcctgtaagatattttttatctgagttgttccgtgtatgaagctatgtgaaaattcaatgaggtgtatacttaagatctgtacactctgttatgtgtaaattatacattaatatttaaaagaaaaataagtagattaataaagcacagtttggttttacagatacctatctatgacccaaccattctacatttaagtatatacccaacagatatgactgggaattttttacaccaaaagactttcattataatattatttttatatgcagacactcaaaacagttcaattgtccaccaacagcagaatgtaaaaatattttatggatcattgatagagtggaataaaatacagcaattaaagaactgctgctacatctgtggtgtcacaaatatgcctgcattcatagaaatttcctcaggaaaaatgaatctattgtagaggaagtcagaaaagtgttctattcggtagaagaaaattaatgaggcatgaaagaggcttctgaggtgctcttgtttatggtggtcacatgactgagtccatattgaaagattataaaaattgtacacttatgattgatgcactttttagtctataacaatgtattcatttgcaggagctactctccaaggtaccacaaaccgggtggcttaaaacaactcacatttattgtgtcacggtttgggaagctagaaggctgaaaacaagatgtagtcaaggtagtttcctccagaaggatataagggaggctgtctgtgtctcttgcatctctcccaggatctggtggtttgttggaaatcactggtgtttctgagtttacagatgtgtcagcccagtcttccatatagtgtctgcatatagtcttccctctgtgcatgttccccttgtgttcaattttcccctttttataagaacactagtaatattggattagtacccaccctaatgaccccattttaactagataacctctgtaaagactctatttctatataaggtcacattctaaagtattgggggttagggcattagcatatattttcgggaaaaacacagttcaacccatagcaacatataattccatttttaaaatcccaaaattacatctagcctaaaaaggaatgaaattgaaataaagatcgcagaggcctgcagtaagccttgatgatgtaatacctgtttataaaccaaatgttagaatggcttgaaacagaattgaacatttttgcgctataagacacataggagaaattttaagtactttttttggatgagacattagtctcaacaagactgaatgattttcttttaaggtcacacatttaaatagttaacaggagaaatagcgaccagaatcatagtcaaatacccacctaccccctttccaagacaactaaggtctcaaattgcgcccatttttctcaaattatttctagaatgtttagcaaaagaggcttttaatttggcatatctttgtctacagttttgtagtttatgtaaagaaaggtagactaagggaatttcattttaaaggtgagaatcagaatgacatttgtgaagctatgatgcctgtgccatctggcatacacgagggtgttgtactaaatgggatcagaatgagctccttttggaaggaaacctttaatagactgggaaacattaagggaatcttccctttttatttttatttaattttctttctttctttctttctttctttttttttttttttttttttgagatggagtctcgctctgtcacccaggctggagtgcagtggcgtgatctcgactcactgtaagctccgcctcctgggttcacgcctttctcctgtctcagcctcccgagtagctggggctacaggcgcccaccaccacgcccggctaattttttgtatttttagtagagatggggttttacagtgttagccaggatggtctcgatctcctgaccttgtgatccgcccgcctcagcctcccaaagtgctgggattacaagcgagagccaccatgcccggccttttatttttaatagagcattggaaaatgaattctgcatagctagctaatgaaggaaatccagagtcattgccaaaaccgagttttaaaggaatttgcaatccttcacagttcattcaaggaggcaatggaaattttgaagaagaatttttttaaaatctttcttaaaaggagcccttacattggcattgtatcacgactaaagtcttgctccctccctctctcccttctatgctttttgtttctcttttctatctttcaatgacatcagtttcatggagataaatggttaaaagataatgattacaacacatacagttgagtgacacaaatcttgttgtagtgttagaaatacatcaatacattgggatcataaagataaatggcaagaaaaaaaatctaagttaataacagaaaatgctgattcccacagtccgtgtagaaaatacacgttttttcctgtcagtggagataactgagaccagttaatattgtcaattctgttccttctgactgagccaggtgaggcaaaatttagcagatgacttgagggacaaaactatgaccttggcaacataaaaattaatactgtctacattgtttactaggaaatgcatgcaaaattaatacactcttggtagtacaggttggtttcacttctatagtgtgtagttactagaaagctgattcaacagatgatagattcaacagacgacatagaattgtctaaaatccagccgggcgcagggcctcacgcctgtactcccagcactttgggaggccgaggagggcagatcacaatgttaggagatcgagaccatcctggctaacatggtgaaaccccgtctctactaaaaatacaaaaaaattagccaggagtggtggtgggtgtctgtagccccagacactcggaaggctgaggcagaagaatggcgtgaacccgggaagcggagcttgcagtagtgagcggagatcgcgccactgcactccggcctgggcgacagtgcgagactccagctaaaaaaaaaaaaaaaaaaaagaattgcctgaaattcatcttcaattagtccatggcatgttttggaatttattcacttgtttgcctcaggaacagtagctgttcagatttgttctttgattttggaaatgaggttaccgtgctctgtagtgtcaggaagatgacgtggcataatcaggcaaacggctaggcattttctcagcagtaaattaccagtgcccttgcttgccataatacccacaaaaggcagaggcagtttcctgaggcaatccaggccacaaagaactgtacatttggggaaaacgtatcttcaaatatatatgttaaaatctaaaaaattggttagtatgtattacttttgtggatatttaaacattccctatgcataaagacctagttaaagaggtgcaggcatttggcatgttaaataactccttgatgagaaaccacactatgaataataaatatgacttaataaaaatgaaaaataatgagattagtttctattgaactattcttgcttagaatgcccctgaatttcagtcatagaaattcacttgtacctgggtaagttacaagtacttatttgtgctggtttctgtgtcattggcaattaaaattttggtaagttgaataaaagatctttctaaaaagggagttcttttttttttcttttttgagggggacggagtctcgctctgtcgcccaggctggagtgcagtggcgcgatctcggctcaccgcaaactccacctcccgggtccatgccattctcctgcctcagcctcccgagtagctgggactaccggcgcccgccaccacgcccggctaatttttttttgtatttttagtagagactgggtttcaccgtgttagccaggatggtctccatcttctgacctcgtgatccgccctcctccgccttccaacgtgctgggattacaggtgtgagccaccgcgcccggccaaaagggagttcttacactggcaatgtatcatgattaacgttttcctccctctttctctccctcccacatatgtattttcgtgtcagtatatgtatatgtgatttgtgccatttgtgtgtgtgtaggtaaatgaaagtggcatcaagaaaatctcacattaaaaaaatttgagatagtacaattcttatgcatcatatgttgcataatgtttgactattaagaaatttgcatcacacgtctacttatttcattaaacatgttacaggcaattaatttacttacaccctccatttcttttttcccactctctgggtctcctgctgcagggtcattatatgttccactcacaaaatgtccttgtttttcccttactcctgtcattgatcttctgaatctttctggtgaatttagcatggatgttttgatagaaagctctggcattaactctggagttgttttgcaaggaagattgttctctttttcaccattttttttttaggtccttgaagtgttttcacatagatatttcacaagagccatttcagaactgagaacattcggcgtgcacttttcctcttttggtcccacagtttttatgagtcctacttgaaattatgtttgctcccgtttcaattgtaatattgcacttactcattagtttttagtttgaactctcctgggaggtctaatgtagagtttggacaaagacacagattcataataaacctacccagtcaatttggtataaaggcttagaaggtggaactggccacattttgaattggaggtaagtatcaggaatggtaatggagagacatacaggattttcttatgggaacaagaaacaacctctgggcagtattagagcccagagagtgaaaagcctcttctaacttcaatattctatgtacaaatttacaagacttttttttttctttttttttgagacggagtctcactcagtatcccaggccggagtgcaatggtgcgatctcagctcactgcaagctccgcctcccgggttcacgccattctcctgcctcagcctcgcgagtagctgggactacaggcgcctgccacacccggctaatttttgtatttttagtagagactgggtttcaccgtgttagccaggatggtctccatctcctgacctcgtgagccaccgcgcccggctgagacttttaattgacagactgcattgcataagccaaaggccaacagagaggtgacctttcaaattactggcacaacaggagccgagatcagaaagctccaacttaatgcaaacatcgacaagaaatccgacagaaatgacttctgtgtctggtcaacttaacataacatgacatattgtcaagcgcattttgctttttaggtagaattgtctataacgatttaactgctttagaaaatataaatgtgaagatttgtggtattcgggtttatatataagatatttctacatttaaaagagacagagtggaaaagcttgatataagatttgtaaaatatgtttgtaataatgctaatggaagaggtgagagttgggtggggtggggtgtagatgggaacatggtttggggattggggaaagggaagtcatgctgttaataaaatagtgaggcatgttgtataaagtgtgttttatgtctcaattgaaatgttatagagagaaatttaaaatagatcatgattggttttgaatctgatttctaattttaaaatgttatgagcttttgttgctttcctatttcatacacatttctttatgggtttcacttagactgcatgaaattgcagatgccaattaccttttaataaaattaaattcacatatatgtataatttgcatgtatatattcacggaattttttattctatacgtgatatattattttaaaatggtttatcaatgacataacgtataatttttctatactttcagttttctggtttggattttttctggcaacactaattttcacctacctatactcattgatagtataaagttgtacaagtgcatatttgaccatgattacagttgaatagatgactggaggtacatctatgatgactaatactttctaaacacatatttacctctcatatatctgtgtaaatgattgtaagaggaaggggaaaatagagatgtatcattaggtatactgtcttaaagcacattcagctgctctcatgtttggagaattttgaatgtgatgaatgtttctctttcaccgctaacaggttgtgtgtgtgagccagattttattgcaagtgtttgaaagactattgcaaatatcggatattgccagacagttggtaaaaagcaaattgagtctattgagaaattaattcaccagctgaaggaagcacatttgccttacagtcatcagatattctacccaccagactcatctccgagatagcatcctaatgagcttcctaaaccaactaaacatgagcaggaagcatcagtcgtcaaaactgactcttttcagccaatcagctgactgcacaaactgtatggcattgaggaaaggaagaacattctgaaagtttttttttttcattctgccctcactttgttggtttctcagttttacagatgcagtgtcatgcgcagaaccctgtaaatgagcatagttcattcaagtatataaagtgctttcgtgtattattattcagtggaataaaatgaatgttaacaggcttaagtgattttcctaaaggcacacaattaatgtatggctggaattcaaaatcgggtcttttcctctgttctgattgttctataaataggggtgtagtgattgattttctacccaccatgacagggaataggttcaaaacttaaaaccctgttcattttataattaggtagactcaaatgacaggtcaaggcagggaggggagccagtcatttttattcccatatgggtttgctccttcaaagacaggattggggtagcagggtcagttcctacaggttataacgatcttaatgataaagttaactaaccataactgaatagtcataatgtgctagcacttttcataatgtatcccaaataatactcacaaaaccttccaaataaatgttacctttttgttatctttgttttattttgtttgagacagggtttcagtctgctgcccaggctttagtgcagtgatgcaatcatggttcactgcagcgtcaaactcctgggctcaagcaatcctcccacctcagcctcccaagaagctaagactacaggcatgcaccaccactcccagctccaaataaatattcttatcccattttactgatgcagaaaaacgtatggcccagagaagtaatgttaagtttattgggggatttaagttgtaaaaaattattttatcgaaccctaatgtaaactatggactctgggtgatagtgatgcgtcagtgtaggttcatcgattatagcaaatgcatcattctggtgcaggatgttgacagtgggggaagctgtgtgtgtaagggagtagggagtctaggggaactcttctactttccactcaattttgctgtgagtctaaaactactctaaaaaatgaagcttattaatcaaaaaaaattcttatattttatgaatatatgggacagctattcatgtatgtggtaaaaagagatttgttacaatactcggcaggagtgtgtctaatatgactgatattcatgtgtcacttataaaaactggcttcataatctgtagattcatttcatttgtgtatgttcgcttaagggcgcacacatggaaacactttggtgttattaaaggtctgttgggagggctcctctttggtggaagctatgtctatttcttaaaagtgatttaagagtaagatgtgaaatagcacttgcccccgaggatggagccaacagagcataggggagttatgtgatgctatctctgagagactggagagaggaatataaaaagcttattccttaaaaaagaataggggaggacttccttacctgatatctcagattatgaagctacagttctctccctgctttagggaaaaataataataacatactttttgcaaaaatcaattactgaacatattcctatattttagatttataatgaagcatttttgtacatattcattaaaaaagagtaattaaaatatttttctctggtttatagtaactaggatggcaacacagatatatcttggaagtatttcttgggatgattcttcaacataaaactattcttaaaaacttcttagaagtctccaggtactcaggaataaggtcattttaaattattccttattgaccataagaaaaataattaggcaagaccacaaaactaaatgtttagactgtttctcctgtttcctgattttcaggttatttttttatcccaattttattttgctgtatggtcatacatttcatctttgaaataaagtatataataatcacttttttttttttttttgagacagagtctcgctctgtcgcccaggctggagtgcagtggcacgatctccgctcactgcaagctccgcctcccgggttcatgccattctcctgcctcagcctccccagtagctgggactacaggcgcctgccaccatgtccggctaattttttgtattttttttttttttttttttagtagagacggggtttcaccgtgttagccaggatggcctcgatctcctgacctcgtgattttcaaagctgttcgagggcatttatcaggcttttaactctaggtactctttcccgcagtgtgacggccaagagaagggatcctgggctctcttccctggccccaggacgggaattcagggggaaaattcacctactcttatcccacaaaagaaaacttattcatcagttgtcaagctaaggagcttcagagtccataaagagggaaattgctaagagcttatcagtagtgtccaccccgcatccccacctggggtcacatggagaatgatggtgggggcaccgatcttgtcctgcttcaggtgaaaagcaggggtgtgggggggtttcattgtgaagggctcctttgttaaaattccttccaattccaggaaaaacatgcactccaaaagccattatctcttttactttgtactaggggacttccaggaaagagagagaggagaaagaagagggcaaaacaactgcagtgaatttagtcacctctccaattgcctttcttgttgcagaatatttcacattccaggaatttccttcttgacctctggactgttgatacacccaagatcttaatatgctttcaatcataggttaaagacatcaagcgccagatcgcttgggcctaggagttccagaccggcctggacagaatagtgaaacccagtcacattttttttttaagggggagatttgctcttgttgcccaggctggagtgcagtggcgaggtctcggcttgtgggacctctgcctcccgggtttggatggttctcctgccacagcctcccgagtggctgggattgtgtgagccaccatgcccaactaattccctaactgtgcaactgcaaggtcactaaacaaactcgtcacaaaacatatttttccttaaatagtaaaaaataatataatgtatgtttcaattaaataagtatctttgtttctcgcttctataatatgcttctccctgcacagatctcccccttcgccccacataatgcttgaaaggtaactcttggttcagtactcaatcctttaaatgttaatccgactgggctggtgcacctaaataattaataaatgtcctcctaaaccccatgagtctatctaattccttaaaaatccctctacaggactgcaggtgtgagccaccgcaccccgcccaatttattaatcagagaggaatagatgggcctggcttggtggcttgcgcttgtgatccaaggactttggatggcagagcactggggatcatttgagcctaggagatccagacaggcctgggcaacatggtgaaactcggtctctttttttttttttgaggcggagtttcgctcttgttgcccaggctggagtgcagtggtgcagtctcggctccccgccgcctccgcctcttgggtttgggtggttcttctgcctcaacctccctaatggctgagattgcaggtgtgagccaccatgcctaattttcttttttctttttttttttttttggtacacacagggtttctacctgttggtcaggctggtctcaaactcaggacctcaggttatccgcccgccttggcttccgggggtgctgggattgcaggcgtgagccagcacgcaaagcccaactaattaatcagaaaggaatagatcggcctggcgtggtggctcacgcttgtggtcccaggacgtcggacggccgagcgcgggggatcgatcacttgagcctaggagttccacaccggcctgggcaacatggtgaaacccggtctctcttctcttttttttttggtacagacagggtttctccatgttcatcaggctggtctcaaactcccgacctcaggttatccgcccgcctcctgggcctccgggggtgctgggattgcaggcgtgagccagcgcgcccagcccagtttattaatcagaaaggaatagatcggccttgcatggtggctcacgcttatgatcccaggaatttggacggctgagcgcggcggatcgcttgagcgtaggagttcgttctatacttgcctgggcaacatggtgaaacccggtcactttttgtttgttttgaggcggagattcgcttttgttgcccaggctggagtgcagtggtgaggtcttggctcaacgggcctccgcctcccgggtttgggtggttctcctgccacagcctcccgagtggctgggattgcacgcgtgagccaccatgcccagctcattttgttttttgttcgtttgtttttgttgttggagatggggtttctccatgttcataaggctggtctcaaactccaacctcaggttatccgcccgcctcgggcgtccggaggtgctgggattgcaggcttgagccagcgcccaaggcccaatttataaatcacaaaggaatagcgtgggggatcgcttgagcctaggagttccagacaggccggggcaacatggtgaaacccggtctttttttttttttgaggcagtttcactcttgttgcccggttggagtgcagtggcgcggtctcggctcccggcggcctccgcctattgggtttgggttgttctcctgcctcagcctccggagcggctgggattacaggcgtgagccaccatgcccggctaatttttttttttttttttttggtatagacggggtttctcccttcgtcagggtagtctcaaactcctgacctcaggttacccgcctgcttcggcctcccggggtgctgggattgcaggcgtgagccaccatgcccagctttttattttttttcttttttggtagagacgggtttctccatgttggtcaggctggtctcaaactcccgacctcaggtggtccgcccgcctccgcctcccagggtgctgggattgcaggagggagccaccgcgccgggcccaatttattaatcagaaaggaacagatgggcctggcgtggtggctcacccttgtgatcccgggacttcagatggccgagcgcggcggatcgcttgagcctaggagttccaggccggctggggcaacatggtgaaacccagtccctctttttttttttttttttttgatagggagtttcgctcttgttgcccaggctagagtgcagtggcagggtctcggctccccgcagcctcggcctcccaggtttgggtggttctcctgcctcagcctcccgagtggctgggattgcaggcatgagccaccgtgccctgctaattttgtattttgtatttttttttttttttttggtagagatggggttttctccatgttggtcaggctggcctcaatctgacctcaggttatccgaccgcctcggcctccctgggtgttaggatcgcaggcgttaaccaccacgcccagcccaatttttaatcagacaggaatagatcggcctggtgtcatggctcgcgcttgtgatcccaggactttggacggctgagcgcggtgaatcgcttgagcctaggagatccagacccgcctgggcaacatggtgaaacccgtttttgtttttgttttgttttcgaggcggagtttccctcttgttgcccaggctggagtgcagtggcgtggtctcggcttcccgggcctccgcctcccgggtttgggtgattctcctgcttcagcctcctgagtggctgggattgcaggcgtgagccaccatgcccggctacttttttattatttatttattttggttgagatggggtttctccatgttggtcaggctggtctccagctcctaacctcgggtgatccgccggcctcggccttccggggtgctgcgattgcaggcctgagtcactgcgcctggcccgaaacccagtcccttaattgaaaaacaaaacaaaaaccacaaagattagcggggcctggtgggcccggcgggtagtcccagctactctgaaggctgatgtaggaggattgcttgagccggagaggggtgggggtgaggtggcagtgagccatgttggcgctgctgcagtccaaactgggcgatagagcgggactgtgtctcaggaaaacaggaaaaaaaaaaaagaagaaaaagaaagtacataaaattgctaaatcaaggaacagcttgacagtatattattgagagaaatagaggcaaaggcgagcagacaccaatgttcacttagtggaactgcagttgtccccagacaggaggctgctacttttccaaaagaaatctattattgacaaaaaaaaaaaaaaagggggtttgttacaatatacaaatagctaaactttatatagccacgaccctcttgcagcactgctctaagccttttcctgctctgaaatagctactattgttacctccattgtagagaatacagatgccagaggttgttgtggaaggaccatggaaactgactaggaaattgacttgtaagtttaggacttaaaggttcttcctgttttgctccttacattgccacattttagttaacatacctcctaaaatactggtcctttctatatttggagggactcgtcttgcagtttgaagttttttcttgcactaagcatttggtcagaagatcatgtgcgttttatgtcagtttaagtttagacattgttcagtaaggaatgtaaatatgagcaaacagttacctgattaaatagaaaacctagaagaaaaatcacctatgagaaagtcaagaaaatgtgaactctggatttgtggctattttcagaatattaatttttttggtatttaatggcattgtgaatatatttatttttaaaaattccttgtcttctgcagatacatatacggtaattaaaaaatgatatgatgtatagattttacttcaaaataattcagaggaagaaggaatgcatataaatgaagtgggaatataaatgaaacaaaactggctgtggccaggtgtggtggctcacgcctgtaatcccagcactttgggagactgaggcaggtggatcacctgaggtcaggagttcaagaccagcctggccaacgtggtgaaacatcatctctactaaaaatacaacagttagccggatgtggtgccgggtgcctgtaatcccagctacttgggaggctgaggcaggagaatcgcttgaacctgagaggcagaatttgcagtgagccaagatcatgacactgcactccagcctgggcgaccacagcaaaatcccacctttaaaaacaaacaacaaaaaaccaacaaaaacaaaaaactgtccatgccatgaatgaaaaattgttgatgatgtgtatatgtagggcagttacattatttttctcaactttttttacatctgaaactttttaatgaacacatgcacacgtcccttgataactggggctgcttccccattactctctcaatagcccttctgattttcacttcatcttcattcttagagactctggattttttattttttttggcaagttcaagtatgtcttgatctatgcaaggactagccagcatgtctacctactcagccatattatcagaaacagaaaaagtgtccagattcttgtcttttcctgttaagattttttaaattccaagaacagtcaccttctaccagacactctgatgttggaagacaaagcatatttcgtaagtggcatgatttctgtgctcaagtttagaacaaagccacagatttcaacatctcaaaaataacttactggactcaccaaatttagaaagatggagattattttaaaaaaagaaaaccttaatttactatgtgacctctaagtatctcagctgaaaattgtaaagataggtaaatcaaaagatgcagataatcatgcacttaatgaagcgctaaatcaaagtatttttggcatatgtgagtttcattttatcacattttttactggtactatagctatttgcaagtacatatagaactacagtgttacatataaactaccaaaaagcaactttttaaaaaaattttattattcttatactttaagttttagggtagatgtgcacaaagtacaggttagttccatatgtatacatgtgccatgttggtgtgctgcacccattcacttgtcatttagcattaggtatacctcctaatgctatccctccccctccccccaccccacaacagtccccggtgtgtgatgttccccttcctgtgtctatgtgttctcattcttcaattcccacctatgagtgagaacatgcggtgtttgtttttttgtccttgcgatagtttgctgagaatgatggtttccagtttcatccatgtccctacaaaggacgtgaactcatcatttttttatggctgcatagcattcgttggtgtatatatgccaccttttcttaatccagtctatcattgttagacatttgggttggttccaagtctttgctattgtgaataatgccgcaataaacatatgtgtgcatgtgtctttatagcagcatgatttatagtcctttgggtatatacccagtaatgggatggctgggtcaaatggtatttctagttctagatccctgaggatctagacacactgacttccacagtggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttcttcatgtgctttttggctgcataaatgtcttcttttgagaagtgtctgttcatatcctttgcccactttttgatggggttgcttgtatttttcttgtaaatttgttggagttcattgtagattctggatattagtcctttgtgagatgagtaggttgcgaaaattttctcccattttgtcaaaaaacagctttttaagaaatgagactaatctagcaactttattgagaggacgtgaagtgtttggttaggaatggtgcaattggtggtggttgtggacatgtgagatgtaagatgcctcaacttccaatgttgttcagaagcaatccagctttctgaattattcttatgaattctggatttgaaacagtaacttcccaaatggcaggggctttcagcagagaggaacctggagggaccctgtccctgacaccttctgggttgttagctccagatcaaaagaactcctgatttggaaaaagcttcttgaaaagaagaggggaggtgaccttggtgaagcctctggggacatgagctatttttagggcttttggcaggaaaagagcttttgaaaacggagataaggcatggtattaaaaaggcttacattggagaaagaaatcataaaactccatacagttagggcaatagttttgttttttactaggacagcatcagtttattggagtatttatataacataagcaaggtctcttgatattttaacaattaacaactggattttattttctactataggtgcagtttatcattctgaatccaaagccaaggaatataaacatgtatgcaaacgagcttgtcagagagtatcaacgcaatgtgtatcatctatgcttttcagttttgaacataaagcagtggctctgagcgcgactcggagggcgacgccgcggccgcagccatgggtgctgggcctgcaggggcgcgggggggagggcgacgctaggacctgcggggccgggcgggagagagggctgccgggaccggccctagacactgagccgcggtgggatccccgccggctctgcgaggccctgcgagcgccagggaggcgcctcgagggagccgggcagccgccggccacttcaggggggcccgccacttcagggcggtcgaaagagccttgggggcacatctcggggtgcggtgacccgcccggcgcatttcgggggtcggggcgcatttgccaggggacatctggagcccggccctgcttctgtcgggctccagggtacccctggatggctgcgctgtgccctcgccggcggcccgggcgccacagcggctgagttcgccgggatcgccgggccgccgccgcccttgccaccggctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgttcgaggacatggaccaggcgctcgtggacctcggcgtgctctccgaccccggctcgggcctttacgatgctgactcggagctcgacgtctttgatgggtacttggagtagggtctcgactgccgttcccctcttccctccacgatccgcaacccacgccctggaccagccgcccagatcatggcgccgcagcagctggttgggggcaccatctggacggggatggttccccaggaggagaccctcccctgcctccgaggcctgcctgctaccctcaaaagcttcgtgccaacagagaggttcctgtttggacccaggagagtggaagagagattgggactgagtgctgagattgggaaggcacctgctcccacagaagggggaacgcaaggggcgtcccaagacctcatctgcctgcagcgtcacaccgatggcctggcctcggcttctcattatttgcaactgccatggatgtttacaggaacccagccagagtttgcctccctgcacttcatcccagagcgcacctgcttcctccacttcaccttcggagaggacacttcaaactgcggacacacgcaaaagcaactcccagctctgtttgatgtgagttgagccttcaggccagctgggtttagcccgaggctggtcttagatgcagcgactgtttcagggagtgactcagaataaaaagaagctgaggaagctgttggggggctgaggatgagattctcgcttcttcatttcaggttactcgttcctcagcaagttggcaaaacagatatcatgctggtgagtgccacgttactcccctggctgcaaatgcttttctgaaagtatgagtgtcgtgcctacttaattctgataaacctgtttaagcaatacttaggaggctgacttctttggattaaaaaaatgtatgcaactccaaaaaaaaaaaaaaaaaaaagaaattcaacatttaaaagtttcatttctagggcagtcttccggtttggactacaaaattattttgcttgtttttgtaggggatcgttttgtgttgttttgtgtctttctccacatgatgcttagctctttccccacgtcccagattaaagtctgtatttttgtaattgtgggcacacaatcatatctcttttaatctttgcaacgatgttgaacttctgtagacagaaggatagagaaaacagcttgaaggcagtcagtgtgtttttccatgaagggaaaaaaataaataaaaaaattaaaatgggtgcttttttaagagagattgtcctatactttttcattctgtttttcatcacgtagtttgtatcatagcaagttcattgtcattccagagttcagctttgcccttgtactcagttgtgcttttttcccattggtttttgaggttttgctaaactgttgaatatttaatgtggggacaggaatggactcagaagaaatgttttttattttgattcttactagtcttgtaggcaaaccttccattactttttatgcaaataggatctagttgaatattgtatatcgagtaaatatgcgtctctctctgctcttttcgttgatatttacataacattaaaaagattatactttatcagagattcaagctttttcttatgaatgaagccctataaataagaatattttgttacagggattttgttcttttgaaatttataacaataaagctaaaagttctctaagctgttttatattttttcttatttttcaaagtgtgaaatttttctatcatctgaaaataaattttatgtaactatagtcttagaaatttaatacatttgaattgtatatttagcctctttaatatttccaatgaatacacttcttaaaagtttaattaggaatacagttcttagtttttgagctttctctttgttgactaaattgaaatgttaataaatcatttataaatgacttttccttctctctcttttcctctcctaatttatgctcaaggccaggtgattttatagacctttattctgtgtagtttatattacaaaataatatgttacatcttgatttagaatttacattatagtatccaaaatgtttttgtcaaatgtgtgcttttatcctcagattccggcgcccctgtgactcagagtcacttctttttaggtatggagagtattaacggggaggagaaatgattcgtttgagatttagttatctatataaaatacgaattgtcaggatatttgaaccaaactgggtcatacaatttctgtggctattttgaatagccttacaatgaattaagcttactaaattccttgtacttttcatttaatagctagatgttattgttttaatttgaataatattaagtgagccatattaccaattaacctgaatataaacacttgcttgtttttaatctgagtagtttatgtcttaaagtatggaatggaactagtggtcaatttttattaatctaagtgtctcccatacttctttaagcttttggaaagtttgggaagttgtgattttgcaatgaataatctctccccttggtttcataggcaattgaaaagctgcaggcgggtgctcttgcaactgacgcagtcactgcagcactggtggaacttgaggtatttcttttctctgttttattgaaaatacttgtgagtttatctttattgttcttaaatgacatgaaactgttgagttagtcaaccataaattatatgaccagtgttgcccaccaatattagcacagttatgaagaagcctatgatattgttgttttcattggtgacttttctgagtaatatgaaagttggttaaattccttccttttcttgatttttttttttttgtgagattcatgaatacaaaagttagtgactggatactgaagtttctcattttcagtaggaaaatccttgaagttaacccccaaaaagtgatgtatgttctgttgtttaaaaataaattccaactgtctagaagtgcctaaagtagaaggggaagattcttcacgaacctaacagttagatatataccctgaaattgtgtgctgtgaagtgtgccttgtcccagtgttatggttaggtttgtccccagtttactgtggacatcgaataattgagtggggaggctctcacgtttgccataattttttatactctagagtgaggtcctctcagttctcttgatttggacccttgatgaatttgtgcaggggatattgaggtcttcagaagattgacttgctgctcgaacttggagaagatagatttgtatctatcagttgagaggattatcgtgaaaaatatttttctggttgagaatactccttagggaatcaagtaagacatgatgacgaaacaatgatgagtttgagggaggagatgatagttaaaggcgacatttccaggttgactgggttgtggcccttgtattcaggcgctcataccagggcacgcaccctttcatgcctttccttgtgaaaattgcccaggtgtttaccaaaagtcctagccgtgttttctgtatattctcatgcttaattgtggacctgagcttttgatcatgctttgtagattttaatttctcttggtaatgtcagattggtcctaatgtagtcaaggaaggtgaaagaatatggtgagcacctagttctattgaatcttacatggggatgtgtgatgccctcctaatatgactgatacatttcatgccagctctaccagtcattagccatgtgtccatgggtgtggcacagtctgtccttgactcagtttccctatttatgaggataataattcccacttcacagagttgtgaagattaactgagttcatatatgactaatacaggacagtctcttagaacagtgtgtggtacgtagtaagcacccataactgttagcaattattacagttatgaggtgctttggaagtggtatgtatgagatgaatatttatggtaactattaatgacaagttttacagcatcaaagaaagtttaattatatgttgaggatcagaggagaaaaatgacataagaaagaagatagatgtatttaccaccaaatgttacctttactcaaaacagacacacaaagagggcttcatctaacttaactaattcaattgttagttggaaattacttgcatggaatcagcataggtttgggaaagaaggttattgagtagctggagaatatactagaatggcaaccatgaatgcaaaactgaataaaattaagtttctctttttatcttagaataactttaattttcctaagtcatacttatatatcatgtttaatatttcattctattttcccctagtgttgaatctgacttttaagggatttacttatttatacttaaaaatgataagaatacattttgaaataatgagtttctcctgagtaagtggacttatagttttggataacttgtgtttttttaagagtgtggatatgaatttaaaggaaaaaaatttcttgttctattatttttgattggaataagtcataaggataatggtagcatagaattcttccccaagtgactttagagcatcccacacctcaacttttagttattttattttatatatatatatatttttgagatggattctcactctgtagcccaagctggagtgcagtggtgcgatcttggctcactgcaacctctgcctcccaggctgaagtgattcttgtgcctcagcttcccatgtagctgggactacaggcatgcaccaccacacccagctaatttttgtatttttttttttttttagtagagatggggtttcaccatgttgaccagggtggtcttgaactcctgagctcaggtgatccacctacctcggcctcccaaagtgctgcgattacaggtgagagccactgtgcctggcctcaacttttgattattaaatttgtggaagaatttcaattatctttaacaattaacttttctatggactctttgattgaaatacatgttaatagtttaaggttaagcttacactaacaggaagaattttcctaaatcttaagaattatgttggaaatcatgcttatactgccccctgcagtttctctcaccttgaataattgtgattcattaccttaaaacaggataggttttcagatggacttcagttggggaagtattgtaatagcttgggtcaatggaaagacgtaagaagattggattctaatatttttgtacttagaaaaatataagtagcagtattgagtcctttcagaatactgaaaagtgctgagaaaaattctggagagccttattaataatgcattatgtttaatttgagaataaatacttatcttagttttggtcagtctattcagttaagtcatgtctggattattgaacagatgcaaacagtcattgttctcttctctttagactttgggatatactttttgatttaaaaaatgatgttcttgccactgagcttaaggaaacaatacataaacatatttttaaaacttgcccgttatattattacttaggcagatattaaaattgatatgaattccttaaatactaattgtggattgaaatgactgaaatgttttaatggtctttattgcctagaaagagtatctggctgtatattttaaaaatgtgataatttgtattttcccaaatagtgaaaagtatactgatcttaactccatgcagtgaaggaggaagagacaaggcaaaagaaatatgtgtgtgtgtgtgtgtgtgtgtgtgtagtagtgtgttccacacacactaaagggaattatgcagacatatcattttttagcttttcttagagactgataattttgtgtcgttttatttttctttaccaccgctacagacaagtgatgtcatcttaagactgtcacttctggacaacagaatgaggtgttttcttcatttaagtaaaggaggagcaggtgcaaaagttcctatctattaaattgaccaccttctccctttagagttttgggagggaaggtggctgcttctgtatgagaggttttctgcagtgtggaaatgcaaatgatattactccaaagtatattttgtttatcttcaaaatgtagggaaggaaatggaaaggtcagtttatagatcatattttaatgatttattggtaagttgattcattcctgttgtttcgtatagcttttttgagattatcttaataactgatgagaaagtgaattctgttcactggatggtacaactctggtttcactcacagcagagaagattaatattgtgaaagaatttggtcttcatatttgggactatacatttggatgccagttgcttttttggctgcttttgaaatagttttggatcaagtagtgacagtggatttaagattccagaccataattttgcatatttcaaatggtaaaacttctaatgtgaatttcttttttgagaaaagtggatatagaactgggtgagtcatgatgctaccattttcttaggattgtttctaaaatagaaagtgtttcatggattctgatagaaaatgaactatctataaaatactgcctgaagctccttttgcacaatggtgtttttcttaaaaagtacaaagacctggtttaaaaaagtctaatgagtaataataggtgcaatatgaatgacagacttttggaaggtaatttataatcttttgtgagaaaactgatgaatttcgcagaggttttgaagatcttgttgtaacctttgagaaattttggttaattcattctgaaaactgattattttggtaggtagaataccgtgtattaagaatagtgataggggctgggcacagtggctcacgcctgtaatcccagcactttgggaggccgaagcggacgcatcacgaggtcaggagatcaagaccagcctggccaatatggtgaaaccccatctctaataaaaatacaaaaattagctgggcatggtggcgcgttcctgtaatcccagctagttgagaggctgaggcagaagaattgcttgaactgggacccaggaggcagaggttgcagtgagctgagactgcactgagactgcaccactgcactccagcttgggctacggactgagactccgtctaaaagaaaaaaaaaaaaaagaatagtgataggaatagcttttacgttttatgtagtaaaaggcaaattatacaggttcctttgttaaaaatcttttgttgaacttctgttattaaaaatggactgtgaagttttttattcacttaattcatgctttaaagctccctatggtcaggggagatgctaattcatggttaaaactcgtttcttgtccaaatgctttagcgtttatagggcagattatattgggccaagtttttagtcattctgttaaaaacagttcgtcgtctttggatctctgtgtaatacaaatattgcttgcttgtaaactctagggaagtcctttaagaataacttgttcagatgactgatattttggtatgtaagagaaagaaagtaggtattttcattatatatttatattatatataatactgttatacatttgtctgtatctttgttgttgttgagacagattcttgctctgtcgcccaggctggagtgcagtggtatgatctcggctcactgcaatctctacctcccaggttcaaacgattttcatgcctcagcctcctgagtagttgggactacaggtgtgcgccaccacacctggctaattttttttgtgtttttagtagagacggggttttgccacgttgcccaggctggcctcaagctcctggcctcaagtgatccatctgccttggcctcccaaagtgctggggtgacaggtgtgagccaccgtgcccagccaggtctgcatttctttaaggcagggatctccagaatgggaatgttggtcacacttgagtagttcattgtgagtggaccccagcgcaggcctcttgcgcagctgcaggaataggccatattctctcccctgggctttatacttccggctggaattgtctgtgtgcctcagggggatagaagaaacttctacggcctgccagtccttgaaatgcctagtggtcatggagatggtgtggcttcctgatggcatatgggcatacctaggatggaaggggacattgggaagagctgatacatttcccttttccctcaccaaacttataacaagttttcttgtgagcagatgcttaaccacaccctgctccctaccctacttcagtcatttggtttttattgcaaaaaaggaggggcatctactttaaggtcatttctgtgatttgggaagtttaaaattatttaaataaacgagcatctcatttcctgtacgtttttatttttgtagaaattatattttcataagcagagtggtcccttgctctttccccagcaccccctgccccccagtagagctgaccacactggaacgacagcttgatgcatttagctcacatttacgtaagtgctcattaactataatgtggctggtgagtctaattttagacctaccacccttgaaaatctcatttttcttttccattgataatatcttttattctctgtaaggggagtgggatgtgtttctatgtatgtgaagtagaatatttaccttttttcttttgtagtacttacaatgttttcattgcatgaaattggagttttgaccttaggtgctcttttttcctttttttttttcttaacttggtattattgatgatttcaaagatcctattttgcctgtctgtttagcagtattcccagtggtgcttcagtatttctgtgtattccagctgtttatggagtctttatgtttctctgcattttttattttttgaggtgtacacacacagttacgcttcatggagttgcatccagccaagtatccatgttcttcttgtgaagaggcagagaaaatcacctctcccaagaatttccaccttctgaacaagggaaatgtatccttaagagctgtatgcagatgggaggcaacttgtttgcttgttctgctgctagagcattggtttaattagaagacaggctgtgggtggccatgtgcagacaaagaagcaccagacagagcccgtttagcctgggtcagtaagagtaagttacactctttttaaaacacttttttgagtactgatgctgattcttgccttcagtactaaggggcaacttgtaacttactgtttgtgtttacacatagatacatctgttctttttctgagaccctagaaatgacacatgctctctagcacaaagtacctgcgcaatggaaaagcagtgatttcttccccaaccaccctttttttttttaagaataaaaagaaaatggaatcaatgattacattctagattaattttacactgtagcaaacccggtgttagcgtttgaccaagtcaaaacacttaagtatagagcttgtcatgcttttactttgtagtaatgggaacatgagaaacgattttagccttttccagccatttcttgataaggtatgtgggtctcatcagatacattcatccaggccgaacctagtagaagagagggtccaagatcagacctagcagttcctgaggagcatggaactctatatgtgtgcccttgtttttctctgggagttgttactctcaaaaatatacttcattttggaattcagttttgagctacctaaagccacatatggtagtgtggtggagttagtggaaatcctgtgtttttgactatgtgaaagcaatttagacttttggatttttgagtgtacaatgtcttctagtcctatattaatagggatattacacaaaagggatttaattagattcattggtcctaggatttatagtgttgtgatttttgaatctgtgtgtgtgtgtgtgtgtatttgtgtttgtttggatctgtatcatttgtggcatcaggtttataccttagcatctactgttttggtttgttttgctcttggtaatgaaggaagtaggctaaaaagatttttctatgtttggaaaatcacaggctggtatgatggtgtttaatttcaaagactaccttttgattttaagtttttttccatctctcaaacccacccctttattcagaatctggaaaagaatgaggaagaaacttaagttacataatttttaagattctcggcctggcacggtggctcacacctgtaatcccagcactttgggaggctgagacgggcagatcatgaggtcaggagatcgagaccatcctggctaacacggtgaaaccccgtctctactaaaaatacaaaaaattagccaggtgtggtggtgggtgcctgtagtcccagctacttgggaggctgaggcaggagaatggcatgaacccaggaagtggagcttgcagtgagccgagatcgcgccactgcattccagcctgggcgacagagcaagactccgtctcaaaacaaaacaaacaaaaaaccagattctcatcaagattctaaatcttgctcttctctctttctttctctttcatgtgttcattacctaagtgttagaataatgaaggattgtacctcactatagaaatcagcttaaagttgaatcttagacataccaattgacaaaagttctttggccattcccattgccaggcagtttttactggcagtcattctcactcagggtccagcctcctgcatggtgtacacatttcctgacagctcatgacacgcatgtactgtaacacaggacatcaacactataacacattcatagtggggaatttatttatgtttagtttttctggagtatgtgcaaatgtaagcatattttctagtgggttggaagtctttttattaaaaaaaccttagtagaggacttaaaagttactagtatccctctttcctctccagttctgaccatgtcatttgataaaaggatggtttaaattattataattccatggtctgttaggttcttcttgagtgatatttccatattattgtcaatatggttaaaaggtataattatttaggttgaagggaagtataagtagatgtatacagcagatggtagcctctagctgagatcccaaggagaatatcctgttactgggaaagggtgattatgtgtttatttagcaaacacaaagtgtttaccatgtgccaggtactctttaagcactttacaaatattggctcattagttttcacaagtgccctgagatgggtactgttgttagccctgtttgatgaggatactgatgcacagagtggttaagtaatttcctcaaggtcacatagctaggaagtgttggagccagaaatggaatcctgctgccgtgacccactcagtcaattttttttttttttttgagaccgagtcttgctctattgcccaggctgcagtgcagtggtgcaatctcggctcactgcaacctccgcctcctgggttcagacgattcttctgtctcagcctccccagtagctgggactacaggctcctaccattacactggctaatttttgtatttttagtagagatggggtttctccaagttggccagactggtcttgaactcatgacctcaggtgaggcacctgcctcagcctcccaaagtgctgggattacaggccttagccactgctcccggcccctcattcagtttaatcaacaaatgaacagcgtcactaaagatccctcaaactcagtgatgaacacatctgaaaaagttaaagaaaattaagttcaaagaagaaacttttcattgtcaccattgtcggtgaatgtagtgatctaaaaattctctttatcattgtgctttaaatagtgatttagttttgatctttaaatgtcaatagactattgatattttgatctttaaatatcaaatatgtatggactatgtgaatattgaaaagaaaatatgaacagtcacttttacagttcgggtttttgtcttaaaattttgttgtaatttctcttcctaatcttagatctgtttgaggagatggtgcctgtgtcagtgtggcagtctttggctgcctgtgatcagaggaaagccgatttgttaacagatcaattgctcagatgagagaagccaccactttggcaaatgggtaggtagagcttaattttagagcctaaagttttccgtttggttgttctttagtttgtgaacattttagtttctgagcttagagctaaatgtcaagagtatataaaatagaaaatgtagacacacacaactatttttggtggacactgtatttgtgaagctctagcaaatatagttggaagaaattatagaaacaaggtgaggatgtttgactaaaaatttgtattttaagagatatttatttgggggaaatgagaagtagaaatgaactcagatacatggtacgtttagtgttctgaaccaatttttgtttctgatggattggatactaagaaaataattcattggtttaaaaaatttttaggtatattttgcacacacaaaatacacctattctaagtacacagttcaattattattatatgtatatatatgtttatgtgtgtgtatatatatatttttttgtttgttttgttttgttttttgggacagggtcttattgtcaccaggctggagtgcagtggtgtaaacattaaacatggctcactgcaatctcaaccttctgggctcaggtgatcctcctgcctcagcctcctgtgtagctgaggccacaggtgcaagccaccgcacctggctaattttttcatttttttatagagacgagatctcgctttgttgcccaggctggtcttgaactcctgggctcctggtcttgaactcctgggctcaagtgatcctcttgccttgacctcccaaagtgctgggattacaggcatgagccaccatgcctggctatttagttagttttgataaatgtatgtacccatgtaaccggcactatgattaagatagagaacattactgttaccctaaaaaaattctctcatgcccctttcccagtccttcttctcctggcccctggccactattgatctgctccctgtcttaagtttagttttactttttatacaatttaaaatacatgtaatcattctagcatatacatatacagtacttacagtatgtacagtatatacttagaatgtgttttgctttttttcacttagttactgtttttgagattcatctatattatgtgtatcagtttgagtcttttctgtggctgagcagtattccattttatggttatggagtagtattccattttatggttatagagcagtttgttaactctttcacctgttaatggacatttcagtttctatgaacattcgtgtataaagcttcatgtggacatattttagttctcttgggtaaatacttaggagtggaattgttaggttgtgtggttagcatatttaattttacatgaaattgccaggttgttttccaaagtggttgttccattttatatcctatctgcactgtttgagaaatacagttgttctgcatcctcaccaatacttggtaccgtcagtctttttagttttagctgctttcgtgtgtgtgtagcagaatctcactgtgatttaatttgcattctcctaattactaatgatactgaacagcttttcatgtgcttactagccattcatatcttttctgtaaagtgtctattgaaatctttttctcagtttttaaaactgagttttcttaatatttaaagagttctttacctattttggaggcaagtcctttgtcagatacatacgattgagaatatagttgaccctgaacaacataggggttatgggtgctgacccccctgcacagccaaatctgcatataacttctgagtccccaaaacttaactactaatagcctgctgttgaccagaagccttactgataacataaacagtcaattaacacatattttgtatatgtattgtatagtatattcttataataaataagctagagaaaaaatgctattaagaaaatcataaggaagagaaaatatatttactatgattaaatggaagtggatcatcataaaggtcttcgtccttgtctatttcatgtttgagtaggctgaagaagaggaggaaggagggttggtcttgctgtcttagaggtggcaaaggtgaaagaggtgaaagtccacatatacatggactcacgtagttcaaatctgtgttgttcaggggccagctgtatttctctcgtggttggcttgccttttcatgtttttagttttgattaatgcatggattttaccatcatttttcttgaacaagaaaggaatgtaagtttactctagcatatgataaacaggcagtctgagattttacagagcttcttttctgaggagttcattgtattccatcatttcatttgccttttttctttacatagtaggtagggatatgtacctcccttccccatcatgtaaatgaaataactgaggaatcgttagtgtgctacaaaaccgagagcagatgaagattctgtaatgaagacttagatcatctatcttctgttgacattttgcctagatgatgtgaaattataattattgattctgttgaaagagagcaaaaaagaaaaaaatacctattttgtgtattgtttctgactcgttagagatgctgtaacaatcaaaagtataaaagactgcttttttaggatagaatttttgacttttaattacttagactgaaacaagtttgaactgtaagccaacgatacctaatatattttaatgcggtcataatttttcggcttttttttttttgtttttccagactgagtcttactctgtcgcccaggctggagtgcagtggtgagatctcagctcactgcaaccttcgtctcctggcttcaggtgattcttgtgcctcagcctcccaagtagctgggattataggtgctcaccactacgcctgactaatttttgtatttttagtagagatggggtttcaccgtgttggccaggctggccttgaattcctgacctcaggtgatccgcctgccttggcctcccaagtgctgggattacaggtgtgagccactgcaccagcctattttttggcttttaattctgaattgtgaacttaattttttaatgattttggtttaattgtatcaatcactgatttttttgtttttctgttaatctttgctttgtttttcattgatagggcttatccagtttttctgggtgctaactccattgctgttgatttggttatagaagattaaattaaataaagtaaatattgatgagttaaattgttttagacttcaatataacatagtatctcattttttcagagtgctagcttcccttaatcttccagcagcaattgaagatgtgtctggagacactgtacctcagtctatattgactaaatcaagatctgtgattgaacagggaggcatccagactgttgatcagttgactaaagaactgcctgaattactgcaatgaaatagagaaatcctagatgaggtatgttttataagatttgcttttcaagtataaacactgtgatcccttgatgtccagcagggattgggactggagacttcctcatgctagtgctcacagtgtagttagtattcatcactttggtgaatttactgtggcccagagccgcctctttagcataagagtaattctggttgagtgagaatgggtttcattcttatcttaagggtaagtaagtacacattaatgaaactcaaatgaccactgtgtaaaactagtatactatgagaaatcaactatcatatgaaccgttcagtctttgtaattattgatttattttatacatagcgtgtagcaagatttttctttttaatttaatttgtcttaacctggaaggttaaaccctttaatttatccctaatttcttgaaatatattaagtatatttattttatattatttatcttataattccaatgtctgtggtttctgtgggtttgattctatgatttgtaatttttgctgattcttgcttatggtggcttgttttctcttgtgttcagtttttttgttactgttttttaaaactttaaaaaatagtttcagatttacagagactttgcaaatttagtgtggaaagttcctgtatatttttcacctagcttccctgaaagttaaaatcttacgcggtcgtggcacattgttaaaactaggaaattgacattggtacagtattattactcagattttaccagttattccaccaacgttcctccttctgttccaagatccagtacagaatactgaattgcatttagtgttcagtgagttttgattgtgcattcatatttcctgtaatttatttgtgggaattcattgagatctgggtttaaggtgaattctagaaagaatttgtgtttgcttctgccataaaaaggcattatatacctggcacctcctcaaacttaagaggctttttcctttcttttataatcttttaattatagtagtaatttatcttaggactttgtgtcacacaaatagtgtggtttctagtcccaaattcaggcttttgatcaggaatctcagataatacttctttttttttttcttttttctttagagccaaggtccagacaggcatgttttcttctgtagggccgttttctgttttaaaaattcatccactgagaatcatctatttggaagtataccagtttgagtgtggagagtgcttttgatctgacctctcaccttttattgtccctacctatgtttcttgttgacttttcatgttctaaattcacaatgcaagtcaatggtgaactacacagctggtgaactatggatggtgggctagtgctggcttgtggcctacttttgtgtggttcactagttaaggataatttttatcttttttagagcattgtcaaaaaagaagaattctatgtgccatagactgtggcccacaaagcctaaaatatttactctgtggtgtttgacagaagtttgctattctttgtcctaagctatcagggattgtcatgtattgttggtgctagcactgtgtctactggtagattagtattttcttgtgtttctggccccctactatcctgtcatcttatctacacattaaaaggcatttaaaaatatattaaacataattttctgttcgttgtattggaatgaaattctaaatcttttattttttaatgtaattgatcagtttttcccctttgtttatggcttctatttatctattttaatcttaaaactttctttaaattgatacatggatgtaaatagtctcatgtattcttcctttttttttttactgagaaaggtgatagctaattcagccttaaatttataagactttttgttaaatgcattataacttagatgtctgcaagaaaaaagtcgatttatattctaacctagtattcccatctcaccaaattctcccttatattgtgtatgaacatttaataattgcattaaattttttaatccagaaatgacatttcagggttctttttgcttccttttaaagtcattaaggtttttggatgaagaagaagcaaccgataatgatttatgagcaaaatttaaggaacgctggcaaaggacatcatccaatgaactgtataagcctttaaaagcaggtaaaaatgtgtataaatgaccttcatttgaataaattcccaatttggacccacatttttacttgattaaattaggctcagttgtaaattcgtttttaccgaaattgtttttcctcagttttagtataaagattaaaaaagttcacaaaagtaatctgccaattgtcagaagtacagattcttaagaacagtataaagggaaaagttaaaatggtcctccaactttcattttctgttccaagctctgtgcatattttattttatttattttttttttgagacaaggtctcgctctgtcacttaggctggagtgcagtggcaggatcacagctcgctgcagccccaacctccagggctcagtcaatgcttctacctcagcctcctgagtagctgacaccgtagacatgtgctaccacgcctggctaatttttgtattttttgcagagacgaggttttaccgtgttgccctggctcgtcttgaactcctgggctcaagtgatccacctgcctccacttcccaaagtgatgagattacaggcttgaatcaccatgcctggcccctgcgcatattttaaaaacataaatgagagcatattatatttatggctttgtaatttttttttcatttagtagtgaatcctgggtggtaaaacgaaaatgagctttaagttattttgaggccaaatttatgcttcttaagactttgattatgaagattttgtgcttgctgagataaatgctgtcttcatggtggctggagattagttttatttatctttgtaaaaagtttgtatattattgagatttttctaaaaatctttttttttttaagtcacattgctcttttgagagaggaatacttttaaaataaatggaccaatttttggagagaatgatttcttcctacattcatgagttgtaggaaaagattaatattaattagcttttatttggcagatagtaaccaccaaatgtattttaaggtatagctatgcttttgattttataagtgattttgtcatctttccaaaaacgagaacgcaaagactgttaggagctgtttttatgattaagtgaattggggtctagagaaggggaagataagtaaagttggagactagaactcaacatataaccaggccatacacgttgctgttagaatcacttctgtgctctgcaaacctattttctcccagagggaaccagcttcagaacagttttagataaagctgtgcaagcagatggacacgtgaaagaatgttacccgtctcatcgtgaccccatcgtgcttttgtgtaagccagagcctgagctgaatgctgccatcccttctgctaatccagcaaagaccatgcagggcagtgaggtgagaagggcactttgatgtgggttgtcatctgcttaagaaaaccacattcaagccattttatataatgcactgccaattccttattgtcatctttaaaaaaatgcagaaataaattggggttgttatatttaaagtagtatatagactgtgtaataggaaattatactaatattaactatcctgtaatagtcacttccatttattgaatgcccttttttgaactaaattttagatacttcataggtcaacagtatttaatttgggttttataaaagagagaagcttggaagtatagaaatttcctgaaatgaaaggactgggtatggccagatacacaaattctttatttcttccattgttctctactcccttccaccttgtttccccgggactacctttgaaaggaagattggcaaggtgtgcgtgttaataaatggatagctccgtcatggtgtttctactgatgacaggaaagagaaaattgaatagtagggcatctgatttggaaagtcctaagagaaagtgcaactataatttaatggcctatcatggggaggtagggtaagttagtaggaaaagatagaggtcccaaatctctgcacaggaaaacaagccaaagggcaagaaatactgctgaaaacttcttgaaaaaagtgaatttcctgggatagtaagttctgaaaagtatgagttttgtttcttatttgtctttccacagatgcattttatatgtttcatatatgtattccaagacctactggatatctgctctgtgtaaggcactatggtaggtacattggaaaattaacatacaaattatacacaggctttaccctcaatttatgatccattgtggaatattagtcatgtacaaggatgactgtaatatagggaagaagtttaaaaatgtcacagggaaagtatagaagtatgttatgaggatttagatgaagtacttaaatttcagtaatttggagtagttctcttcagaggcttcttaagagattggcacattatgaggacagagtggataggcagaaaaagtaaacgtgtaggatcggagaagggctgagtagtggctgtgtctagagagttatccgaggcacagaggatctgcaaacacagcttttactcctgatttctcatgacagaaggtttacagacatgttgagaatggctggaatctgcttgtttatttatttattcaccaagtgtttgaaggcctgctattccagagcagtgctgagcaccttggtccctaacataaagagacaaaaaactgctctgggttacctttagtgtagggtaaatgcacaggtaccgggcacctctcaaagggaagagaaggctacgtagttgaatgtgcattgaacctgaatctaacgggggaacccagtggaacagggaatgtgagttgttgctttgaggacatagcggagaaaagggaggtggtcagaagattaacttgtgagcaacaaagaacccgaagaagaaactgtagacccttggaagagcaatacattctggtaccttttttattttagaaaaagatctctgtttagtactctctttgtattctttttggtgtcttgtacgtgactcagaattatgtggcttttgccctttgattcttctgctttcagtagaaaagtaaaaatggtttgtgctaagcaaaatctgcattagtatgcactgatttgttgatattttattcagttgtatcagttttattaatccttacttgtgttacacaggagaaaggaacttttatagtcaatatgaagtaattttttggaagctagagttcttgatggggtaaccacaaaatttcagtactctctatatattcgtttgtcgtgtgccttaatcaaataaggcaagcatcaggtttatcagagctatttcagatggttgtcataatagttgatgacgcattttagccagaatttttatgataaaaactcagttttttgattgctgattagagtgatgcaatgtatatgttttattaaaaagtccaagtttgatggtagggctgttttttcttttattgtgaagtagcctactttctagttacttattttcagtctctttgggcatctggttttagatattgagatactctgaaaaattttgcagactagtggtcatttgtatttcaagatttttgtattaaatacctaggatcactgcttgtgattggttgcctatgatctactgtggcctgaagtctggtctgtggttggctggccaagccttggccctaatgtatatggggctgagtctagccaggggaaggaacatctatttttttgcacaaggatgatgttcaattttactcaaagtgttacatctgctggaagtaacggagggggtacctttaaaaaaaaaaaaaaaccctttatctccttagaggtagagcataaagagaactgtttaaaactgtgtgccctcccagaggagtgccttttttggattcacagactagtggaggatctgcaaacacagcttttactcctgatttctcatgacagaaagtttatagacatgttgagaatggctggaatctgtttatttatttactcaccaagtgttttttgaaggcctgctattccagaactgtgctgagtaccttggtccctaacatagagagacaaaaaactcctctaggttacctttagtgtagggtaaatgtatcaagtttctgctttcgttggtgtagacatagttgcttatttgccttttctgaaaataaaatgacaaggttataaaagtaaaatagaagatttcattgagggcatttctttctttctttttttttttggccgtggggggacggagtcttgctctgtcacccaggctggagtgcagtggtgcaatcttggctcactgcaacctctgcctcctgggttcaagcaattctcctgcctcagcctcccgagtagctgggactgtaggcatgcgctactatgcccagctaattttcgtatatttagtagagacagggtttcaccatgttggccagggtggtctcgatctcttgacctcgtgatccacttgccttggcctcccaaagtgctgggattacaggcatgagccaccgcgcccggcccattgagggcatttcttacggcttatattgtacttggtgctgttaaatgccacagagggttttaaatctaaaactcgggtcaggaacctgtggcttgtgggccgaatcctctgcctcttctctttgtatggcctgggagctaaaaatgagttttacattttttaaatataaaactctactttctacttcattttttaaatggctaaaaaaaagtcaaacgaatgttttaatatgtgggcattatataaaattcagatttcagtgttaatacatttttgttgaaacatagctgcgctcattcatttacacattgtctttcatactacaaagcagagttaaagagttggaacagagactgtggcctactgaggcaaaaatattttctgtttggtcctttaccaaaaaagtttgtaagttcctgatctgaaagacaaagtattgacagcctaggtgatgccgttcctgccattctgtttgacctcatctcctgttctgccttttgtttactatgcttcagccagagtggcctttttttctttcctttgatcctgccaagcttgtgcctgccacaggactgttatatttgcgtttccttctgtgcagggctttcttcccatttccatggctattacctctttttcattagtctcagatgtcacctcttctccatctttgtcattgtctacccacattattctatttttgtgtatttgtttaatcctcccctttccatatttatttaatcctctctggtccccaaatgaaggaaaagactgtttttgttagtagtcgtgtccatggcatctagaatggtcccaaaacaaaaagcatttgtttgaatggtcatcgctggcagccttaacttaataaagggatacatttaattgcagttgaaaggtagctggagctgtgtataagaaataaatatgctaggattctaattatttatatactttgataacatgttaaacctcaaatttgaatttagaagaaaatttaggcagtggttttcttattatcgtggtcattcatttgtggaagcagtttaattcattttctacttcatttactctgttaaaatgaggcgagtgtcatataatctgaaatatgttaaactagtgcactgcatatgaatttttttaaaagatgttcgtaatataagggatctctatctttgtgtggtagtccacaagtttgttcataaattcgttgtttgaaatggcatttttttccccagaaagttagaattattgcatttttgaatatcacaggatttgttaactatttggccctctgtatcagtctggttagaaagcttctgtatcagtctggttggataccatggaagttgcggtaagcttttcttcctaatctaggtaatatgactgaatacttaccctttgttagaagttatgttgagcactttatatagattatctcagtcttcacaacagtcctgaaataggtactattatgcccattttgcagctgcgaaaattgagttttctaagtagtaacctgtccttgattgcacagtcactaagcccattatggtctctaagggagtatagtcagagttgaagtgtttttaattttctatgtaattacgttttttttgtgtaattacgtttcactttgatagaccattagttcatttgtttccatattcaagttttgacttaatcttgttttctgagtgtgtaaaaaatgttcatgattcaaaaggtacatgcagagtaagcctcattccttttccttctacttctttcctgtatacttcctgtaagtaatcatatccgttagtttctggtttgtccttactgattttctttttggaagaacaacaacaaacaaaaaacccaacctcccccaaaattatgcatacatatgtatacatatgtacatattatgtatgtgtatatttattttctgattttccttctgtcttactcaaaatgcagcacactatatatgcttttgtaccctttttttctcatttaataatatgtcctggaagtcacttggaaggaaacttttattcacatcgtctgatatcaagttctactaggtctttaaacagactttgtcatatccacccacgtatgattctttctcctcctccttccttttagagtttctgtggtttgatgctttctagactctaggaatcatatttctttccctttccacagccttctcccctgtaccctcttctttctctccctccctctctccttcccttcccccttccttcctctcttgtccccctcccccttctcttcctttcctttccttccattttaaaattaggatgtttagaagatatagatgtaaatgaggccaaaaaggaaattcgcctacatttagcagaaacctcgagtctctggtcttcacaaagggatgttactttggacgttcctatcaaggagttaactaagactgtggaagaaagagtagggtaggaatttttagaaacaggcagttggtagggggatcatgggaactggacttgctgctggtaatgagaaagacaggggtggagacagggctcatgatgtcctcttcttccctttgtctttccccctgttttctttctatgagcatcattggggcaagcagaatagggagattgggttgatgttcttggtggtcctagcaaagtatgaagagatgagtgaaaggggcagcttgaaagtgctcattagaaggcacttgaacactatgaatataaaggggtatttatgaatcaggtgggtataagtcagagagtgtcttgactgaatacaagagataaatctctgttttgtttttgtattttgttttgagacagggtttctctctgtcacccaggctggagtgcagtggcatgatcatggctcactgcagccttgaccccctgggctgaagcaatcctcctgcctcagcctctggagtagctgtgactgcaggtacacaccattgcacccaactaatttttttttaatgtagaaatgggggtctcactttgttgcctaggctggtctcgaactcctaggctcaggtgatcctcctaaagtgctgggattgcaggtatgaacctctacatctggcctaaaactcttaatgctatgaagagaggcacaagaaccctctttccttttcctctcccggtgtataaaataaatgtggtatatacctttatatctgtgtctttctctatttctttctccatctaccatgcttgcttcataactatctctatttctatcttcacctctatttctctatatctctgtctgtcagtctctctaggcaaaataggatatctacttacgtagcaaaatcataccttcccctgcttcacagccatgattgggagggagtagagtgtagagtggctaagagattggttttggaactagtcagacttaggtctcaaatttcacctctgccccttagtaactgtataaccatgtcacttaatttttttgagactcgttatccctatctttggaagagaggtcataaatatatataccccatggggtattgtaaggaatacataaaattatatttctgaagtgtttagcatggtgcctaacacataggagttcagtaaattgtagctgttggctactgttattaatgctgcttttgttttaatatgagtcaactgaaggtacagtgtctatctacataaacctgatgttcaatttatatttggctctctgagaactcatctctctctcagcccaaatgaacctttatatattatttccttcttgaaattggctttttttttcagttaaactaaagtgtcttttttattgtttaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggcatgataaatgaagaagctctttctgttactgaactagatcgagtctatggaggtcttacaactaaagtccaagaatctctaaagaaacaggagggacttcttaaaaatattcaggtgaaatttatgtatttaataacatctatgttttaaaaattacagaaaagatatgtctggactaaacctatattcaattagaaaaatgacattggagaatatctgtagttgagagtagaacttaatacatatatattttgtaaaattaaacttggcatatcagttttatttgtgtctatgaaaccaagtcactccttgtttttttttttttttttttttttttgagatggagtctcgttctgtcgcccaggctggagtgcagtggtgcgatcttggctcactgcaagctccgcctcccgggttcacaccattctcccgcctcagccgcccgagtagctgggactacaggcgcccgccaccacgccctgctaattttttgtatttttagtagagacgggatttcaccgtgttagccaggatggtctccatctcctgacctcctgatcctccctccttggcctcccaaagtgctgggattacagacgtgagccaccacgcccggcagaaacaaagtcatttctatggctaaaatgttgcatattacttaggagtgcttgatacttctgatatttttcatggtttcaagtttttaatagctttgttttttttttccatacgggaggaaaatcgaaattagttggaattactgatacctttaattatacggctaacatacatacagacttcagtcattttttaaaaaaataatgcaaactaaatatgttgagaagtttgaagttagttttcgtgtttacagataggtagtttggactaacaaagacttgaaagtttgcccttttcatagttaatgtgcaaaattaaacatatatttctactcctaaacattgtatctatatatgatataaaatattccaaaaggtaaaataattttcatgttatattttttgcaagtgttatatactaatagaaatctgtgatcattattggttgttttgacttctattggatttttgaaatttttacttaagaaagatttaaagcataatgaggcttcaaaagagtatactaggtatttctagtaattttgcatatgtatttaattacatatgattttcataattggaaaagatcaataaaaatgttatgagccatattttataagtaaatgtaaatacataaatctttcttttaacaaggtctcacatcaggaattttcgaaaatgaagcaatctaataatgaagctaacttaagagaagaagttttgaagaatttagctactgcatgtgacaactttgttgaacttgtagctaattcgaaggaaggcacaaaggtatgaagtacatgcaaaaggaaccatagctagcaagtacagatgtgaacgtataggttggaagttaaatggtatttccagttgaaccaaattactctttgcctggaatgttagctttaatgccattgcctctgcgaagtttgttacaggagggagaaagcttaatgaaggtggcaacatttcatgggaaccttgaagaatgaattgcatatttcaactggcagaaaaggggtacaaatattccaggtagcaggaattagcagagatgtcaatgacacctttttaagggataggaagttgattaatttgatgaattttgaggggacaggagtagtcaaagctgatttgtgatggaaaagctgggcgggcatgacttttatattctgtgtggtggtttgctgaggacagacttgtggcctgcccaagtgtcagaaggcttgctgaatatgtaagtactttcttgccttgtcctttaaaaagtttagggaattcacttatatttgtttttaccaatttgtttttgagggaacagtgatttttaagttttctcagatgcataattccttttggtacttaacttcataataatcactgaataaagttaccttgatataaatacagtagctaaaatgtaaaaccctctgaagagagggtgaaaatactgcaaagccttccaaatagagaggatggtaaaatgccattttaacttggtttaaaatgctttgtttaaataggtaagctgagaaaaccctccagagagcctttagaaattcttttaagggtttctgaagtatgcttgcatttctttttttttttttttttatactttaagttttagggtacatgtgcacaacgtgcaggtttgttacatatgtatacatgtgccatgttggtgtgctgcacccattaactcgtcatttagcattaggtatatctcctaatgctatccctcccccctccccccatcccacaacagtccccggtgtgtgatgttccctttcctgtgtccatgtattctcattgttcaattcccacctatgagtgagaacgtgcagtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatatgagtgcatgtgtctttatagcagcatgatttataatcctttgggtatatacccagtaatgggatggctgggtcaaatggtatttctagttctagatccctgaggaatcaccacaccgacttccacaatggttgaactagtttacagtcccaccaacagtgtaaaagtgttcctatttctccacatcctctccagcacttgttgtttcctgactttttaatgatcgccgttctaactggtgtgagatggtatctcactgtggttttgatttgcatttctttgatggccagtgatgatgagcattttttcatgtgtttttggctgcataaatgtcttcttttgagaagtgtctgttcatatcctttgcccactttttgatggggagtatgcttgcatttctgtagtgaatttgaaaacctaatccttccacttaaataggtttcatgttattaaacaattgacttttctctaggaattaggaagattttcatgatcatgaaacttttaacttgttacatttttgatgataatgttctataaaaatgattttattatttttattttctttaggagtcttagatcatatttaatattaagttgttgggcctagtaaattgtatggatgtatctcatgcagatctcagttcttcggctttaactgtcattgacaaattagctttagatcacattactctctggattaaaaaattgttcttgttcattacttgtatttgttctttgcttatagttttacaatgagttgactgaaatcctggtcaggttccagaacaaatgcagcgatatagttttggcatggaagacagaaagagatgaactcttaaagtaagtctgttttgtgtatcaaattgtacttaagaattttcttttaaaaaatcatgtggagacttttggtgtgaacttggtagtatgagagcagtttccctccttttctcatggaagaaggaactagatagagtattttacaaagcaacaagtaaacagctgcacagtctgggaatgaaaggatgaaaagaagcagaaactctagatgcaggaagtacagtgaggtcacagaaatgataaaacagttcaggtggcagatctcaggaagtgccagtaaatacaagcaatttattttgaagtggcaaataggttccttacataaaactagagctatagaacatggaggagacgccgtgaatagctcagagaataccagcaaaatcactttcagaggaggctgctgagaaagcagggccagttaacatacgactcatttcctgctgagtaatcaacacggagtagcacagcgctgataaaaggtgaaaaacattaacaaaatttaataaaacttcatagatgaagaatatttaccaaaataatattgtcacagaataggtgaaaattatgagcaaacgtctgaccatgaactaaacaaaaagaacaacaacaacaaatgtaagaaggcagtcattctaaggccggggtccccagtcctggggccatggactggtactggttcgtggcctgttaggaactgggctgcacagcaggaggtgggtggcagacaggccggcggctgggcgagtattactgcctgagccccacctcctgtcaggtcagcctcagcattagattctcataggagcgcaaaccctattgtgaactgcccgtgtaagggatctaggttgtgcgttgcttaggagactctgactaatgcctgatgatctgaggtggaacagtttcatcctgaaatcatcttccgctcccctgtggaaaaattgtcttgcatgagaccggtccctgatgccataaaggtttggggactgctcctctaaggaacacttggagcagaaattccagaactgcaggaatatggtaagaaaacaggaagtggtaagatgtgaggtgtcagaattcaggaaagaagtagaagggaagaatcaaaccacgacatgggaaagagcacaaagggcgagtaaacactgaagaacacacaggaacacagagtagaaatgaggaaattaaaatgaaaccaaagtcaagaaagaatgagaaaggattagagagaagatgggcacagaagatctaatatgggcaaaactgaatttctctcaaagaagaaaaaccagacagaacagttatttaactttctgtaaacagagcacttatttcatgatactcaagaacattttcttaaaacaagtgaaggttgttgaaagaggatatcacatggtaggggaaattgatcaagaactgtcagcatcaaggcatataaattattggccttaaaaggtaatggcagaatcctttaggcagtcaggcaaaacaatcaaaccagtatataaaaaggtgaaaaaaattaggctggcagctctgtatgccagaagagagtggagtgattgctgtaatctcaaggatagtaaatatgagctaaagattttatatcatatagtaaatacatgctaaagattttatatccaaactgtccttcgggtgcataaaaagccatatattcattagtaataaatataaagagctgaaagagtcttataccgatgaccctttcagccaactagatctttattcatctctctgttcatgttcatgttcattcacctctctgctcatgttcatgagagaagttattttcttctacctctaagaaagagcaggtgagttgtttttagaatatttctactaaacctataaaaagcaaataattagaatgttttaaaaatggttctaaatgttttaaaaaaggtgacttttttttagatagagttttgctctgtcgcccaggctggagtgcaatgatgcaatcttcgctcactgcaacctccgcctcccgggttcaagcaattcttctgcctcagcttcccaagtagctggcattacaggtgtgcaccaccacgcctggctaatttttgtatttttagtagagacagggttttgccatgttggccaggctggtctcgaactcctgacctcaggtgattggaattacaggtgtgagccacccccccagcctaaaaaaagatgagtattctccatattagtcttaaagataaaaaaaacctaacaaagattaatacaaaacagtctacagaccagtttcagttatgaatatggatgcaaaagtcctaaataaagtatttgccagtaatagtcaccaggacgttaaaaaataattattgaccaaggggaggggggcatttattccagtattcagtattcagtgttttcatgtcaaaggaaagattacaggcttgtcttaatagatgaggcagaagcatttaagaaaatgagtgttctgatactcagtaaaataagaatagatagaagatagatgcttccgtaacatgaaaaaatatatatgtatgtgtgtgtatatatttctgcccaaaactcagtacagtgattaatggagaagcactataaacagttccctctgaagtcaagaacagacaacaaatgtcactgtcagcactatttttaaatactatactgcagtaccagccaagacaatcacgtgagagagaaatttaaaaattggaaaggaagaagtaaaactagcactatttacagacattatgattgtacaactacttgaaaacccaagagaaccccaaaactctgcaaataataaaataattattactgaagttgttgatcataaaaataatttgtagaaatcagtggctttcatgtaaataaacctatagaggataagatgaagagacccacttacggtagcaacaaaaaggataaaatataaaatataagtttgtcatatatgagacctgtgtgaagaaaaaactatttcaaggacacaaaagaaggcttgagcaagttaaaaagcatgttcttggataggatgactcaacttcatcaagatgtcaactctcagttaacttatgtatcaactgggcgtgatggcatgcacttctagtcccatctacttgggagattgaagtgggaggatggtttgagccctggaattctaggttgtagtgcgctatgattgtacctataaatagccacggtactccagtctgggcagcagtgagaccctatctctaataacaaacataaataaagaaataaacatatacggccgggcgcagtggctcacgcctgtaatcccagcactttgggaggccgaggcaggcggatcacgaggtcaggagatcgagaccatcctggctaacacggtgaaaccccgtctctactaaaaataaaaaaaattagccgggcgtggtggtgggcgcctgtagttccagctactcgggaggctgagacaggagaatggtgtgaacccgggaggcagagcttgcagtgagccgagatcgtgccactgtactccggcctgggcgacacagtgagactccgtctcaaaaaaaataaataaataaaaagaaataaacatatgcattcaacatgcttttgattaaaaaaaaatcagcttttcatttggaattagacaagttgatcctaaagttcaagtagaaaaagaaacaaggtcagccaggaaaacaataaaaagagtagtgaagggatactagttctaccagataataaggtatataataccatctttaattaaaacacagtggtactggtacatgattagacaaagacagaatagaaaatagaaatagattcaaatacatgtgtgaatttagtgtaaaagatcttcaaccaaccagaagaggttgtagtcaactgcccagccatttagaaaataaaagttatctttataccagagtaagttctgagtggaccaaacttgaaatttgtaaatgaaatataaagtataaaatagaatggaggagaattccttaataaagctgggatgggcaggatctaataactcctacttaaaatccagaagccattaaaaaaaagaaaagaataagtttctcatagaaatatgataaacagagtcaggatatgacaaattggggatccaatatttgaaacttattcacaggcaaaaggctaatttactttatttagaaaagaactcctagaaatgaacaagaagaaaacccaatagacaactgaggaaaagacgcaaatagaattttgcagacaaggaaatacaaatagctcttaaataaatgaaaaaaaatgaataccctcattcattataaaatacaaatcaaaattagtctgaagtaatatttttcagattggcaagaatctgaaagtttgtttaaagcctgttctgggtcttccacattcattattctctacggtcaatcacattccaaggattgttgcctccaatgcatgcctttttctcaattttattttctcccatcagagtcatgcacagattagctcccaagtgagctattataatggcctcctagcatctaaactctccttttttccaattgatagttctgccagagttgtcttcttaaagcagaggttagaccgcatttctcttaagtaaattccaatgacaccaaaacagtgattcttaataagaattacaagtagggaaatacagatgggagagtttgcttagtaaataagttcataaaatctaggttaaacaaagttaaatggggtttgctttttgctgttgctttgttaatgtgcatttgaaatttctaaagtggcattacatatccataatttcccttatctatttgacaaaggaatctggtttgtttagaagcattttttcagaactgtgataggtcaacctttcagaaattcctcattatcaacagtcaaatccagatgtattttctttggctctcacaacaggcttagaggaatttctagtctgttctcctgatgtttcattatgtgcatcttttgcttaggcctgttaaacctactcaatgtgtgtatcttctactccatgtctttattcctactgttgtcttaacaggaaatccttgcaacccaattcatagtttttgttctttggaaaaatccaaatcatgtatcatgaatacatattttttctctattgggatttgcctgtttttatgtatcacagccagaagtaatcactgcatagtgtatttctgtagaaagatagaagagttctattttaacacaatatttcctatatacccagcaaaggtctaggtatttatacatactattgtatttattcatctcatcaatgcaatgaagaaatattaataaatccattatatatgctaaaaggtagcgacacatatatgctacatgtgcaggttttctcaggtattattagctagggaagctgtgttgtaacaatcttcaaaaacttctttctattgtttacatgctattccacatcattttgttttcatttcttttgtagtatctaatgtattctactaaaaaaaaaagtagagtagttggaaaacttgtgaaaaaaacatatgtattacatatataccattcttcatgattctcaaaattttcatcattattaatgttttgtgtatatatatatatatattgtgtgtgtatgtatgcatgttagatatataatttaaaagaaaacaataagttggtggcttatggcaaattgttccttaagtcctgcatttgaaacatagacactgagtgaatcagcacatttgatcatcttttaactacaatagatgattatacattaaaaatacattaaccatccaaatacatcttttttcttatttatgtatgtatgtatgtatgtatgtatgtatgtatttttatttttttgagatggagtctctttctgtcgcccaggctgaagtgcagtggcgcaatctcagctcactgcaagctccacctcccaggttcccgccattctcctgcctcagcctcccgaatagctgggactacaagcgcccgccaccacgcctagctaatttttttgtacttttagtagagatgggttttcaccacgttagccaggatggtctcgatctcctgacctcgtgatccgcctgccttggccttccaaagtgctgggattacaggcctgagcctcggcgcccggcccaaatgcatctttaggaaaattatatttaagctcttcatggagacattaaaaaaccaagctgcattaataataaataattatatcattcattagtaaggagtaaatagctgttttctatttgagaagtattaattggattgtccatctgtatgcaggaacatctgttttctgacatgctttaatcaccatttgttttgtacttgtaccataattacacttgtttgtaatattgaaccgagacaatgattaaaatcaacttatgaatacgattcttttatgcttttgtatttcattagaaaatgtgtaattctggtatgacatttataagtatatataaaagaaagtatttgattaacaaaatgcctcaacagattatgtcagtaaaatgagtgttatatcatgcagtctatgttactattttggcatttttaaggaaagtttattgcttcacggaagcttttttttaactgaccatctatgaattttctgtattctttatttcattgtgatcacatggtcatagaagagacatttttagatcatcagaagttgacagttttcagtgtagtgtatgtgcttagtataagatggaattaagtttgttgtatgggtgattgatgaatttttactgaatcatggataactgctgttctattaatgacatttcatcaattaactcttttggatatggtttatcacaaaatgttgctgatttaatgtttgtggattaactgaggtgaaagtgatacctggtagaagtttcattaatacaaattttcctctcttaggagtaggatggattatattatttgtcgaaatgcctttgcatgtaagttcttaactgtcagctttcttgtcctgtgaatcatatcttttctgtatttgctgaaatagagacttaacattgttaaatgatttttccatgtcatggaaaatgtatgcctctaaatctgcgttccttcctacaaattacaagttcaaaatgactttttttaagaaacaaaaaaaaaagatggatttctcgtattttgtggcaggataagctccctgtagcctatcttaaatgttgattacgactaaaactatgaaaagtacaataagcaactaactgaggaatctgaaaagtaaataaaagtagaattatgagtgataggcaaaatctggagaagcaccctgcagtagtgtgagcttccattgttgtatttctttcaatcaaaaccaaaacaaacaaacaaaacaaataaaaaccagaaaagaaccaccaccaacaagaaaacactcaaggaaaatagatattgtgatagaaacagcagaaatgtcgagaaacaaaaccagaaggttagaattattagagaaaataatataaaaagtaattttaaatatctaaacaaaattttaaaaaggaatttaaaaaaataagcaaggagaagacaataaaaataggttgataattcatttgttagcatttgtctgtttggtatttgttgaccattttatttttaaaaaatttggctatatttgcttttggtgtatttcttgtatatgtattgtaaaatttagtatttattattattaaatattttatattgttaaatgataatttatttttattgataagaaagatgtagttttctggttgttatttttgtaattttacctgcatttatatttttctccatttatttagataatacctaatggttccccacaatgagtggcaattaaattagactctgtgctattttcactttctcaacttctcctgaactatttgatttttgtggcaggatatttcttaatatttgcctttgtgccacttaatgttttcatactattatgggcaaattttgagatttaaaatgaacccattactctcagctattatagacgaggcaatcagggagctaattcctactttcccctttcttttactctctcctcctggttgttacagttgaatcatttgtacattatcagaatcatcagtaaaatatctttttacatcttctacaccatgtatcccttaaatctatatatgacgcattgaatgcttacctcttgccttactggtagtattttacctactcagaactaggttgattgaactttgtcctgtggtaactctcttaataagaactttctgtaaagtgttccctgaattatgggtgcttataactgtacactttatagctgatagatatcttgcaaggataaggataaccatttgcttctcccttctcttctttctcaatatttccccccattttctggtgttaacttttgctgtggaaaactctgatgccaaaatgattttctttttctctaagttgacaatttttgcttaagccctcacataatgctttcttaatctttaaagtcctagtcccatacacagatatatcttggtgttgaacattctaataacatacataagcatatactacacagtaatgtaaatatatgtgcttatgatgatctatcttgtcttaatataggcaataacttttttctaattctatcctatgttttacagtttttggatttttggacggggagaggacttactacatattcttctctcacaccctttacgacccttacattatttggggttcagtctcccttgttctctttacaatttagtttttttttttttttctacaatgattttgtttttaaatcctatttctttcatggattctgccagttgctattgcactttctggctatctcttccccattctcttgcatttcacttcatggtctctttatgttttattacacccttaaaatttatgttggaatgtataaatgttcattccttttttcatctgttttgtagcaacatgtttctagttattacaagagttgatatattccttttttatctttattcttaagagtatttttatgtgaatgctgagaaaattcctttagtatttctcatatgtgaaagttgaatttcctacaggacaaaggaaaggggttgtagaatgtgccccagcctgctagctcaagggccctctcatcatttgctacagtgacagactgttgcctcattttggggacattatggagtcaccgctcgttctccataagagcataaatgattaccaggtagttgttactgtcttctctccttgatactcatacataactcatagcacatatggaagcaaccttctaaatacccatgttttatctttaaaatgttctttgtgtgtagctgcccatttgttttgtgctaactgactgaccctattaccttcagttgtaacaacccatttaaggtagaaacgaaggacactcatctccatgtgttttcagaatttaaatgaaaaaataaaaagaggctgatgtcacttcccagtttaacgcaggggttttatttatttatgtacactcaatcaaactatgactattacaaatggttttaccgctacaataaagatagttaattcataactcaataaaaatgaagagtgaaagattaaaaaaggaaagcaacaattctaaactataaaatctacttcagaaagctacatacagcaaagctcaataaataaattatgaaaaaaagaataatatgggataagttttatggtttaggagataccttcctataagccaaaaacctaaaaaaaaatgctaaaggtatagcttgctatagtacgtggtaggagaaattaacatgtataaaatcaataacactcacattatgtgatagtctacagccaaagaataatagaaagcaagtgaaatgcttagcatagctatttagtctactaaattaggtttgtgaaaatgggaatgccaaatgccttaaggcttatggcaggtgcaaaagcaaaacatcagaggtcaacctaaggatatttttaatataaaattaatgtacctgcattgtaagcattattttttttgtatggtagaaaggaaaaaattcttgtattattctactataaatgtgtattctttgctctactaaatttgcatgtcatcgtcagcctttcactttgtcttcagctaacaagaacctcttgggttcatcctttggagaacctgatatggaaaatggactgaactaggagaagagcctttgtttagaccacatgctgaggtctagtggcttcaattaaaaatatataaatgtggccgggcacagtggctcacgcctgtaactccagcactttgggattctgaggcgggcagatcacgaggtcaggagttcaagaccagcctgaccaacgtgatgaaatcccgtctctactaaaaatacaaaaattagctaggcatggtggcacgtgcctgtaatcccagctactcaggaggctgacgcaggagaatcgcttgaatcctggaggcggaagctgtagtgagccaagatcatgccattgcactctagcctgggacgacagagcgagactccgtctcaaaaaaaaaaaaaaattatgtatatatatatatgcttaatctctaagctttggaaggaacagcctatctacagaaaaatttaaaacttggtcatgacaggtacagagttgggccccattaattttgttgacattgaggtcagcagattctgtaaattttcactatacctctcatatgatctgccgccacaccattcatactcttaactttatttctcctcacaccagtaaattactaaaactgccaagtttttttttcacaaattaatatctttagcattctcctccttcagcctgcaatgaaattatctactcccctccctcctccttcctccttgactcccgctaatgcacatttgtgtttggtttccacaccaaatgagctaccttcaataagcatcccacaactccacagggaacttttgtttctctaccttctgtgctgtcaaagcgcttggctcagaatgagagatctgtctgcatttcagatctacaaattactcattgtgtgaccttggacatatccctaatatttttgagcctcagtttctcaaaaattagaataaagataccaaactcctggggttttgtgagagtaaaatgagacgatgtgtgtaagagactcagtgcagtgtcagtatctaccatgtgctatgcactctgcgttttctttttcttttttttttttttgagacggagtctcgctctgtcacccaggctggagtgcagtggcgtgatctcggctcattgcaacctctgcctcttgggttcaagagattctcctgtctcagcctgcgagtagctgggactacaggcccatgccaccacgcctggctaatttttgtatttttagtaaagacagcgtttcaccatactggtcaggctggtcttgaactcctgacctcaggtgatgcacccacctcggcatccgaaagtgctgggattacaggtgtgagccaccatgcccgggccaacccatagccttttggtcttctctcagccaaggcatccagtgaaaatgcaatttatttttcagattcctctggagaattaaaaagtctcttttgcggctggacacagcaactcacacctgtaatcccagcactttgggaggctgaggcaggcagatcacaaggtcaagagatcgagaccatcctggccatggccaacatggtgaaaccctgtctctactaaaaatacaaaaattagctgggtgtggtggcacaggcctattgtcccagctacatgggaggctgaggcaggagaattgcttgaacccaggaggcggaggttgcagtgggccaagattgagccactgcacttgctctggtgaaagagcaagactccgtctcaaaaaaaaaaaaaaaaaaaaaaaaaaagtctcttttgcatcaaattgccatactctctgctcttggtcctcttttccatgtactcattcttcaagcatttattttctcattgcctgatccagatcattgcaatgaccaaaaaattttcgaatgctatgatttttgtgatattcttttagcaagttaatcacgatgttgcattcttgagtgtgcaagtgtggaggtaagtcaggatgcatctttaagacaaaaagatgggtcacggcagtgccacaccactcacggccacaccaggagagctgaaggggcagtcaccaacgaagatgcctgacccagaagctggctgccagggagccaagagccaggtcactccacaggtggccaatgcccgggggtggccctccaccgccgaagctgctgctgctgctgctgctgctgcttattattattttgagacggagtctggctctgcctcccaggctggagtgcggtagcacgatctcggctcactgcaacctccgcctctggggttcaagcgattctcctgcctcagcctcccgagtagctgggaccacaggcacgtgccacctcacctggctaattttattttttgaatagacagggtcttgttatgttgcccaggctggtcttgaactcccgggctcaagcgatcctcccacttcagcctcccaaagtgccaagactacaggtgtgagccaccacacctggccaagttctacttttctaatatttaaaatatgaaataggccgggcacggtggctcacacctgtaatcccagaactttgggaggctgaggcgggcagatcaccagaggtcaggagttcgtgaccagcctggccaacatgatgaaaccccgtcactactgaaagtacaaaaattagccgggtgtggtgacagatgcctgtaatcccagctactcggaaggctgaggcacctaaacccgggaggtggaggttgtagtgagccgataccatgccactgcactccagtctcggcgacgcaatgagactctgtctcaaaaaaaaaaatagatgatgtcagtgatttctattacatgagatctggaagcactctgtacctgattgctccacgtttagtggtgctaagttcaaataattcaggtggtgagaaactgacttccgtaggagtgcgggtgtgcgtgcgtgccgcggaaatcccgccttctggcgcctgcggttgccccctggcctcagccggtaggctcccaagtaggaagataaaccgcattgcacgaagcgggagagtccagaggagcggcgaagcgctcctcttccccattggctgcgcccacggagccgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgtcggaggaggtgcgggcgcggggttggcgggcggccgaacgggggcctgcgcggaccgcccgcggctcagcctccggtctctctccgtctctaagtggtggtggctgtgggtttttctgcaggtgatccttttgagtaatttgtttcacgcaggcgccctgctgtagggtaaagcggcagattcatgctgctgtcatttgtcgttcaaactgtgggcttcttggccaggcgcggtggctcaagcctgtaatcccagcactttgggaggccgaggcgggcggatcacgaggccaggagatcgagatcatcctggctaacacggcgaaacgctgtctctactaaaaatacaaaaaattagttgggcgtggtggtgggcgcctgcagtcccagctactcgggaggctgaggcaggacaatggtgtgaacccgggaggtggtgcttgcagtgagctgagattccgccactgcactcaagcctgggtgacagagggagactccatctcaaaacaaaacaaaaaacgatgggctttctgtcgtgtgtgtgtaccttttggatttgagggcagggggatgacattgtgatctggcctcctgagaaaccaggcacaccctgcctaccttggaaggcggctttcccttccccacctccctctccctccatctgttccctctttccctctctccacttcactcccgtcccccagctcttctctcccatctttttgttctctgtctcttttttttttcctgcattaaacctttcgggagtgtctttgtaaaatattaagaagcgttaggtcttcaacatgtgtgtttacttgcaggcctgagacctgggaggaagctggagaaaagatgccctctgaatctttgtgtttggctgcccaggctcgccttgacaccgaatggttgaaaacagatatacaggtggggtttgacatgtctctttcttggtgtatttctgcttccatgtttaaatttctcgtgtaaggcttttttttagggtatgtaaggggaagtcagttgtatcttgctatattagaggagcaggtttgtttcctgtaacttaaaatgtaacagtctttatggctgtttttgtagatcgtgcgcggctgccttttaattagtttcttgcaagtgcaggaaatgagatttattaatagggaaaatttttttcttaattattattactggttgagaaatctgctacactcctaaccatatcatggtgactgttgtttgttactgatagtttttgagctgttgagttaactgtcgaggggaaaattggagaagtaagttgcagtaattatggctgctagaaactcactccttttatgaggtcttgtgtttgtgtttctggagagaaaagagttagttcagttgagctgtttgttttgtatttgtaaccaatacaaggactaaggacaattgtgttgaaactgaggtcataatgttgggatcttaagggccgaaggttccaaacaaatggtatgtatagagttctctctgacttgaaattttccctttctggacctccggatgctgaggctgggagtgtccatatgacagtgccttccatgacaggagtcagcaacctttttttttttttttttttaacacgtatcagtaattcattctgtatattttgaaaagttttaacctcttcttcctagccctccagtatttgttaataaattaaaacgtttcccaaagtgttttttgtgaaacaataattctaaaagatgctctaagaaaagctaagtacatggaaaaatccaaagtgtatattttatttattacatttcatgaatttttgtttctgttttttcctcttgagagggagtcttgctctgtctctcaggctggagtgcagtggcatgatcttggctcactgcaacctccgcctcctgggttcaagcagttctctgccttagcctccagagtagttaggattacaggtgccctccaccacggccagctaatttttgtatttttagtagagacagagtttcaccatagtggccagactggtcttgaactcctgacctcatgatccaccctcggcctcccaaagtgctgggattacaggtgtgagccactgtgcctggaccacatttgatgactttttttgtcctttgttcttttaaaaatcatggttagaaagcagagcataattgttctttatgtagaatccaactgattggggtttttagggagatgttttgacattcagtaaatgtttttgttttccattattaagactatgaattttttattttactttctgagacagggtcttgctctgttgcccaggctggagtgcagtggcgtgatcttggctcactgcaacctctgcctcctgggttcaagcagttctcctgcctcagcctcctgagtagctagcattagaggtgcccgccaccactaccctccgcctttcaggttcaagcgatcctctgcctcagcctcctgagtagctgggattacaggtgcacgccagcatgcccggcaaatttttgaatttttagtagagacgaggtttcaccatgttggtcaggctggtctcgaattcctgaccttgtgatccacccgcctcggtctcccaaagtgctgggattacaggtgtgagccacatttttagtagagatggggtatcactatgttggccaggctgctgtggaactcctgacctcaagtgatcccctcaccttggcttcccaaagtgctaggattacagatgtgagctaccacgcctagccgtattttgtatttttagtagagatggggttttgctgtgttggccaggctggtcttgatctcctgggtgcaagtgatcctcccacattggcctctcaaagtgctgggattacaggcatgagccaccacacctggccaatgggaggtctcgcttcccttctctgcagcattccataagcaatgtgtttgggtagtatgtgttcgattttctctatgtatactttgaaccctacagtagtgaaaggaagagtagacaactttgaagttgatgtggtgtggtctttgagctggtggtgctaattactcttggttgttttcgtggcctccagtgacttcatcctgcttttgctgttgtaaagtgttgtaatttatgctcctgagaataactcttgaggtgtacttagggttcttgtctgcttcctggtgactgtcgaagcttttcatcttgaagaagggagatgagcagtgttccagtgtactgagattaaaattaagaatgttgcatttttttaatatgtaaaatttatagccagctgtagggtaggggtggcctactttctctaaagggccagatagtaaatattttaaggtctcactggaccctatggtctctgtcatagccatgagaccttgcagatttagtgccaaagtagccacagacaataccacgtcagcgggcaggggacgttcattctgtaaagtgtatttatggacaccaaaagatgaagtccacagaatgtttgcaagtcacaaaatactgtttttcttttgattgtttttcagttattaaaaaatataaaatacagtggccgggcgtggtggctcacatctgtaatcccagcacttttagaggctgaggcaggcggatcacctgaggtcaggagttcgagaccagcctggccaacatggtgaaaccccatctctactaaaaacaaaaaattagccgggcatggtgatgcacgcctgtaatcccagctcctcggaggctgaggcaggagaatcacttgaacctgggagaatcgtttgagcctgggaggcagaggttgtgatgagccaagactctgtctcaaaagaacaacaaaaataaaatactttctctgcgttcagaccatacacaaagaggctgtgggctgggtttggcccctgggctgtggttagtgaccccaaacacacacacacatacacacacgtagggcagagtctggcatttagagccagcacctgtgttctcacctgagctgtgttcctggctgggttctgctgtgtattctgtgacccaagatgtctatctaccttggtaaactggagacaacaaagcctgcctccttcaaggttgtttgtaaagatttaaaagggtaatgtattgttgttaggccagatgctttgcatagtacatgttaggttattttcactttttttttttttttttgagacagagtcctactctgttgtacaggctggagtccagtggcgagattccagctcactgcaacctctgcctcccaggttcaagcaattctcctgcctcagcctctcgggctgctgggattacaggtggctgccaccatgccgggccaattttgatatttttagtagagatcgggtttcaccatgttggccaggccagtctcaaactcctgacctcaagtgatccgcccacctcggcctcccaacgtggtgggattacaggagtgagccaccacatctggcccattttcactttccattagctgcttttttcccccattcatttcctacctttctgtgtatgatttctgaattaaatgtatttcatgtcttaaccttctgaattgtttgtcctctcattttccatgctgttaaggaaaataagaggctaagtgagacgtattaaatttgcatgtagtttctcagatcaggataaatgctcacctgttgcagaacgggactctgctcttgcttcacccaggatgcctttcctagttccttcctagagtggggccgcaccctgctccagccctccagacccagctccctgctctgacatgattccaccagactgtattccagctgtcctccctggacctagatattttccttcttcttctttttttttttttttttttcctgagatgaagtctcactcggtggtccaggctggagtgcaatggtgtgatctcggctcactgcaacctccgccttccaggttcaagccattctcctgcctcagcctcccaagtagctgggattacaggcacgtgccaccaagcctgggtaatttttgtatttttagtagagacagggtttcaccatgttggccaggctggtgtcgaactcctgaccttgtgatccacccgcctcggcctcccaaagtgctgggattacaggtgtgagccaccgcacccccccagccaacatatttttattaaaaaacttatatgaaatttattttattgtggtatgtagttcagtaaattttgacctctatagattcatgtaacccccatcatcatcaggatggagaattttcttcaccccaaaagctcccttgtgctgctcctttttatcacgtgttccctggtctcataccctggcaaccacggatctgttctccatcagtatggggtattctttttgagaatgtcatgtgagtggaaccatattttaagtaacattttgaaaccatcttcatttactcccagttatatgtttgagatttatgtgctgttctgtgtattaatagttctttttattgctgaatggtatttcatcatttggatgtaccacatggtgtttatccattctgccattgtaggaccttgtggttgtttccatttttctttcccaattgtaatcctgctgtgagcattactatacagattttatgtgaatatagtttccatttccctaggataaagacctagtagtgtgaaagttgggtcatgtgctgaactgttttccgaagtggctgttttagtttgcattcccactggcaatctgtcacgtttctgttgctctgtgtctttgttagcacttggtgttatcagtgttttttagttgagccattctaacaagtctagtgggatctcattgtggttttaatttgcacttccgtaatggctaagaatgctgaatatcgtgttcttctttgccactcttgtatcctctgtgaagtttctgttcagatcttttgcacggaaaaagctgtatcatggaaccagtaaaataaccaaggagaggttgattaaagttctgtttataaccctagaagattcctgccctagggatatgggatggctgaacgtaggacaccgacactggacagatgaaatagcagtttattagtcacgcatgctcacagccctggggtgggggacaccgcatgccattcagttaatcatgtgtgttgtaacttttcggggagggacatttgcagagactaatggtatgacattctgaaaagcggtgacagattaagaaattttttaattctgcagatggtagtgtcgaaccaagtggaacaaagaaagaagatctgaatgacaaagagaaaaaaaatgaagacgaaactcctgcacctgtatatagggccaagtcaattctggagacctgggtgtgggtcaagcaaccaggtaatctgagttttggcactttggaaagcttgatctgacgctccttttctaaataacttggatggattattcgtattttttggtaacaattttaaaaaatgtaattaaaaaaatttaaatatcgtggtaaaatatacataccgtaaaacttgccattttaatcatttttatgtgtacagttcattggcattaagtatattcacattattgcccagccatcaccaccatccatctctacaacttttgccctttctccaactgaaactccgtatccatgaaacactaactccttctgtccccaggcaaccaccattctacttttgtctcagaatttgactactcaaggtgtctcctataaggggaatcatacagtatttgtccttttgtgactgggttattgaacttcttaggtgtttggggttcatccgcatgtgtcagaattttcttttaaaggctcaatgctattccattatatatgtaagccacatgttatcccttcatcagtgggcaatcaggttgctttcatctcttgactgttgtgagtaatgctgctatgaacattggtttacgagtgtcttgagtgtctgcttttaattctttgtgtctatacctaggagtggaattggtcaataatgtggaatgcttacatatttattttttttgagatggcatctcgctgtcacccaggctggagtgccgtggcgccgtctcagctcacagcaagctccgcctctcgggttcacgcaattctcctgcctcagcttcctgagtagctgggactacaggcgcccgccaccatgcctggctaatttttttgtatttttagtagagactgggtttcaccgtgttagccatgatggtctccatctcctaacctcgtgatccacccgcctcagcctcccaaattgctgggattacaggtgtgagccactgcacctggccaataatgtggtagttagatttatgtttaacttattattgttgtttttgagattgggtctcactctgtcgctcaggctggaatgcgttgatgtaatcatagctcactgcagccttgaactcctgggctccagtgaccttcttgcctcagcctctcaagtagctaggactagaggcgcagggaatttctcatcttctctctactgcctctgagttggagatgtcagagggagccatggcccactgtaaagtaacacaatgtcctcacccacagggttagaacccctcttctggtggcagctctgaggggagcagtcacatgtggagagtgcagggctctgtgtccagctgggggaaggaggttaccaaggggattgacccccctctggccaggtggctgccttctgacacaccagtctctctctctagcacggtggcccctacacacccagcctgtcaaacctacagccctcgggaaggctttggccaaatccatgagcggctccctctgttaagaaggaagcacagctgaagcatgaggagggcagtagagtgtgtatgctccgccgcgtctccccacagtctgaccagaaggaaggggcctttcagccaggctcgcccaggctggggttggagtgtcagtatcaagccaatgtcttcttgcttaatgagtgagcccaggtgctcccgtgcagctgccaccgtagtgagggtgaaccggcaggaggctccacggcactttcaggctcaggctgcctggtgagatctactctgtgggctctgtaggctggtagaggcttccaggaggaggaggggatgcagccaccagtccccactcctgggagtcgtatttctgaaagcttgggtatacagtaaatattaggctgtgggctggtttatctatggatttgatgtgggagggttataggtacaagcagtttaaagatggaaattttgagagaacccttagtgctgggtaaggcaagcaggcttgtcaaagcagctcttttggggaggccagaatcctgtaccaatgtcctcagcatgttcatcagctgctgggggagtgccggacaggatgaaagcacaggagaactttgtggatgataaaatgttccatatcttcaaaggaggtgggttacatgggtaatgcatttgttaaaagtcatcaaaatgtaaaccagatctgtgcatttcacggaatataaattatacctcaaattagaaacatttttaaaaagacagatgggctggatgcagtggcacacgcctgtaatcccagcacttggggaggccgaggcgggtagatcacatgagtcaggagctcgagaccagcctggacaacatggtgaaatcccgtctctactaaaaatataaaaattagccaggggtggtggcatatgcgtgtaatcccagctacttgggaggctgaggcaggagaattgcttgaacccaggaggtggaggttacagtgagcagagattgcaccactgcactagagcctgggcaacagagtgagactccatctcaaaaaaaaaaaaaaaaaaaggttttcaacattcattaaaggcagagtagcttgttatagactagcctccccacaggaacagttagaaaaactggacaaaaatgtgtccccccttccccccaccatcaaaaacaattgttggaaggtaattggggacctcagccaggacttgagtgaccaggcctaggaggtgatcctgacagtccttagtgcttttcccacatttggtgatcggtcaacagtagagggctaagaggctaagaaactgagtatgaagtgatagttaagaggctggagagcctagctgaatgtttggcactctcacagggctgaaatgacataatgagaatttgggtcccagtaaggagatgagaccttggtggggatcctggaagggccacccctaagagtccaaaagaataaaaaatagaccagctgtcacaaaaactaaaacctgctttgagccagcttagtcccaaactagatgaaggcgatctgcttgaacgccaattgtgtgccataaagtcaaagtcagtactctctggaggcagataaaactttactaggcatgccataagacaagacaacgcaagacaaaaggagaaaacaaacaaaaaaaacaatagaaacatacatagatattagagtcctcaggtagaatttttttttttttttttgaaatgggagtttcactctgtcacccagcctggagtgcagtggtgtgatctcagctcactgcaacctcaacctcccacgtagctgggattggtgatccacccgcctaggcctcccaaagtggtgtgattacaggtgcaggccaccgtgcccggccagtattttgccacaatttaaaataaattttctttttttcaagtttgttctcagactgtattcacaaggtcacatggcggcttacacttctgtaggccttgttgaccgttctttttagatactgatgatcttgatctttttcttgtctcctccgtagaagaatgggatgcaggaggtgctgcctaagcctgggcgctcctgggcgttcttcattccagggggcagctgcatgatctgtgcagtgcggttgtcatgggaataacccttcccggcctctcgtgcaggctccaggctgccagggtggctcatatcagaaggatatttggagggagggaggcagggctctgagcaccgctcctcctgcgtcttctcctgctctcccatcctctccttcttctcccgcctcttctccacctgcctccggatcttctcctcctcctcctgcatcttctcatactcatcccacagcctctcctccttgaattgcagcctctccacctgcttccgcatctgctcctcctgctcccccatctgctcctcctgctcccccatctgctcctcctgcttcctcatctgctcctcctgctcccccatctgctcctcctgcttccgcatctgctcctcctgctcccccatctgctcctcctgcttccgcatctgctcctcctgctcccccatctgctcctcctgcttccggatctgctcctcctgctcccccatctgctcctcctgcttcctcatctgctcccccatctgctcctcctgcttccacatctgctcctcctgctttcgcatctgctcctcctgctcccctatctgctcctcctgcttccacatctgctcctcctgcttccgcatctgctcctcctgctcccctatctgctcctcctgcttccacatctgctcctcctgcttccgcatctgctccttctgcttcagcatctgcttctcctgcttccgcatctgctcctcctgctcccccatctgctcctcctgcttccccatctgctcctcctgcttccgcatctgctcctcctgcttccgcatctgctcctcctgcttccgcatctgctcctcctgcttccgcatctgctcctcctgcttccgcatctgctcctcctgcttccgcatctgctcctcctgctcctgcatctgctgctcctgctcccgcagctccttctcctggtcccgcagcctctgctcctgtctccacatcttctcctcgtgcttccgtagcttctcctgatcccgtagctcctcctgatcccgtagctcctcctcctgcctccacatcttctcctgcaaagtgttggtttgaacctcaaaaggaaatagagtcataagctaggtatataaatgtaatctataaaataacggttttcgtctatgattctttaaaaagaaattttaagccgtaaccctgaggttctgatttcccaggcatggtcccaatttgtagatttttagcacactctagaggattctgtggtgggaccagaacaaggacccaaattttccagctcttggctggagcctccccacaccctgcatgatccctagaccatgtcccagccggatgcggctcccacacccccggggctgccgccgctcacctgtggcagcgggattttgtccgtctccagtttcctttttagctccttgatgtggagctggatctcagacttttcagtttctaccagtcgaagtttttcttgtagttcggcatttttctccttcagctccttattggttatgctatggccggaggcagtagagaaaggaatgaacgaagaacagaaaggaccgctttggtgatcgaccctctaccctcgccccacaaccacagaaccgtggcactggaagggaccccaggaattaaaagtcccaggtggcaggccagagagaagacatgagttgcctgaggctaccccatgagtcagtggcacagccggcactggagcttccctgcacacacatgtaaacctgtatgaccccctaccatgctcacctgtaccccccacctcccagcacaccacccacgctaagggctctcagacctcccatccccccctcccctatcctacatgttcctgaacagctccagactcatggcttccctctcctttgttaactccttgatgtactgcaaacagagaaaggtcaagtcaggatacagcaggcagaggagcagctggacgaccagtaacgacagctacactgatactccacagtaacacttgctcctctccgtcacacccgacatgttctcaaggcgtttccaaacccgtggtgtcatttgtttttcttttctttttttttttttttttgagatggagtttcgctcttgttgcccaggctggagtgcaatggcgcgatctcaccccaccgcaacctccgcctcccggcttcaagcgattcttctgcctcagcctcctaagtagctgggattacaggcatgtgccactgcacctggctctcacttgtttttcggagaactcagtaagggtggaaggcacagagaaagagactgaattgatagctggctaacaggggcccagagcgatcagataatattgttattgctattactgttattattaccactgttggaacctttcttgagtgcttcaccaggcactatgctaacaatcccatttaatcctcacagccaccacaggagacagttatcattatcacctctattgtgtagatgaaaaacatggggtattaaaggttaagtgcttgcctaagatcacttagagctgggatttcaacacccaggtatatctgattctctaagcccattcttttggttgggggtaggggcacagataaggaggaggaaattaatcctttgttgatttttgaaagaatgatacattggcatagtccaaacctcagaaggtacagaagggaaatatcttcccccaacactgttcctctctcctgagttttttatgaatccttacaaacatgttttatgtatattaccataatacgtacgtacacacacacacacacacacacacacacacacacacacacgtacatgtgttccctctctctacacaaatggtaacatactaaagatactcttctgtaccttcatggtacaagtaccctcaactccgcctaggatttgaccaaggccacagccaagtatgggtggggtgggcacttggcctccgagctctgtgtccagtgctcgctccccacagcgccccgcaactcacccacagcagctgactcagccccaacctgcctctaacaaccacgcacaaaagcagcaagaaatggcccatgctgtcttctgggcaggacactgcatcctgcagaagggacctttaggctcattcctccatctgcgaagctgggctcccaggggaccgggtaggtggttggactcaccttgtccgccctctcgtgctctgcggacatagcagagagagcccgctgtaactctcctgcaaagtgccaggaatgatgcaggcgggctgccagatccttggaatcttctggaatgagagaggttgagctgcagcccaaaggcctgtgaaagtgccaggttgaaggatgacggggtgcccagattcccaccttcaaatttcctggcagcatcctggctgtcatggagcgctgtctccagttcagttttctgacacataaggattcgtatggtatgatcctgggcctttgggagacaagaaaagcaagtgctgaaagagaagcaaagaaaccttctccagaggacaggagggaacttcacaccctccactcacctctagctgcctccttagggcttgctgatgttggtggcttgccttattttcctatagaaaagaagaggaagacagagctcttactagagggaggcagagatggcacagcaagagacatgcccccagaatggccccactgtcccaggacaggcccacccatgggaccaggttatcagggaccctgtggggatggggtggaagctgggaggtgagccttcctccccaagctgggagtaggcgagacgagactggggcctctacatctgagtgccccccaaacccagcggtcatgtcgtgagcaaagaaagaaaccatgttacctctttcagctgagctcggttctgttgtttctgtggggagagtcaaaggaaggtgactgagggtggtccctcgactctattccccaggccaggaagcggtaggcaggggtcaggaatggattttaagggcaaagttctcagacccaatgggaacacaaactggtcaactttccttaacgcccaaagaaaaaggatttgggtctttgttggcttttgcccacagccacagaactgaaagtctgaaactagattctctggaaaagacagtaacataaaccttccgacataagagtgtgagaaaagcccacccttctgccagcttgtgatggagaaagatgtgttcattcaacaagcattgagcaagcacataggggccggggacggttcttcactgctgggatataggacggaaaaggcagacaggagcccttggccccaaggtttccattctagtgaatctttaaatctcagactctcagagcaaacagaacctctgatactctaactctacctcctcaggaaacggaagcccaaagaggaggggagcttacagcaggccctggactagggattaacacaaaaacaacagcaacaaatctgatttaagcttcacacatgtaagtaaaacattaccatccccattttacagatgtgaaaagagaggcccaaagagctcgagcaattttccctaaaccgtgtccctcgcagttggagagagaagtaggactcaaacccagaattcttagccagtacccagcagttcttccttccacaatcttaacagttaccctcgacctcccccttgtgccccttgtcctcaggagaccggccagccaagactcacatcctcaggcgagtggcagccccccgaagtggttgtctcagggttagcgccatgatttattttcttctttttggtgtcggttgctccggtaccaacaccagcactgttccactgatgatagtctgtaaactgtggaaaagaggagcagtgatactcatgagaactacaagctcctacagtcactttacagtttatacaaaatactctcatagacgatctgacttaatgccaccaacgactgtacgaggtgttgtcgcaatcacttagtgactgagagggattgataccatggctaaaagaaaggcaataatggaactgaaactcagtcttctgactctgagctctggggtgttgccacaaatcagcagctgccagagaccaaaaccagaggcagaggtagaaaagtaaaaagtaggcaggaaggtgtacactgtgtggtttacagtcgtacatcctcttagagtcatgtatcctcagggcagaaggcagcctttctgttaaatgtgggaattaaacagaaagaggacaacccaagctgcatttcagagagaagtcttgtatactctttgaaatctatgtgactatcatccctaagaacattaatgttttgtgtctcccacgagaatcaaggaaaactgatgcttcagaaagatgccccatatgtatcctgtggcactcaaagtaccccaggttgagatgagatgaggaagattcaagttgtcaagtccagtttcccaagatctcttgcacagaagatgagcaaatctcacttcaaagatcactgactgatgggcactctggtcccagaaccatggagaattcaaatatgaagtggagaacttagaaaaaactgttaaagtctctctggagagtagaagcctgggagaaaaccaaaccaaacccattatcccatcagtgctgtgcccaagttgcctctttgagattggcatggggtcacagggttgggacccaggtacttggagacgtgagcccaaagagcccagggaagtcaggcttggggcagcggtaggtgagggccgagtatggagtggggagccccaggagtcacctgcccaaagtcaccctggggtgactggtgagggcaggtgctggggcatccggttccttgggaacgtgagcccgaagggcccagggagatccatttttggacaataggaggtgagggcagagtacaaagcagggagccccacgagtcaccggctgaaagtcaccctggggtgaccggtgagggcaggggcaggactgctgaggggttggggctgacacaagattttggttgggggagcccagaggcactggggggggcccggccctgcgtgcctctggagtgacacggattctggcagctgttctgccatcagaggggacctggggctgggttggggttggggtgctgcaatccgatgcgttttacctttttcttggtcccagccaattttctttgttgggttttttcggacatcatggggtggggagggtggtggggttggggtcacattggcgtgatccaggcgaggacagtgatatgcctccagtcacgtaccacacagctatgtgactgagccacaggaggcgtcaccggggctgcactagaatgcggaaaaggggcgtggccttaatgctccaagcccattggtcaatgagaaagatgaaagggaaaggaggcggggccaggcagctgcgggtcatgaaggtcctgtgatgtcacaaggaaagcctcccatggaactgctgtccccgcccactctgggagaggggcggggctggctttcacttacttttttttttttttacatatataactttttattataatttaaggtatagtcgataatataatgtttttttttgttttgttttgttttgttttttttaattgatcattgggtgtttctcgcagagggggatttggcagggtcataggacaatagtggagggaaggtcagcagataaacaagtgaacaaaggtctctggttttcctaggcagaggaccctacggccttctgcagtgtttgtgtcccggggtacttgagattagagagtggtgatgacttttaacgagcatgctgccttcaaacatctgtttaacaaagcacatcttgcaccgcccttaatccatttaaccctgagtggacacagcacatgtttcagagagcacagggttgggggtaaggtcacagatcaacaggatcccaaggcagaataatttttcttagtacagaacaaaatgagaagtctcccatgtctacctccctctacacagacacggcaaccatccaacctctcaatcttttccccacctttcccccctttctattctacaaaaccgccattgtcatcatggcccattctcaatgagctgctgggcacacctcccagacggggtggcggccaggcagaggggctcctcacttcccagtaggggcagccgggcagaggcgcccctcacctcccggacggggcgactggctgggcggggggctgacccccccacctccctcccggacggggtggctggccgggcagaggggctcctcacttcccagtaggggcggccgggcagaggcgcccctcacctcccggacggggcggctggccaggcggggggctgacccccccacctccctcccggacggggcggctggccgggcgggggttgacccccacctccctcccggacggggtggctgccgggcggagacgctcctcacttcccagacggggtggctgccgggcggaggggctcctcacttctctgacggggcggctgccgggtggaggggctcctcacttctcagatggggcggttgccaggcggagggtctcctcacttctcagacggggcggccgggcagagacgctcctcaccttccaggcggggtcgcggccgggtagaggcgctcctcacatcccagacggggtggcggggcagaggcgctccccacatctcagacgatgggcggccgggcagaggcgctcctcacttcctagatgggatggcggccgggaagaggcgctcctcattttccagactgggcagccaggcagaggggctcctcacatcccagacgatgggcagccaggcagagacgctcctcacttcccagacgatgggcggccaggcagagacgctcctcacttcccagacggggtggcagccgggcagaggctgcaatctcggcactttggggggccaaggcaggcggctgggaggtggaggttgtagcgagccgagatcacgccactgcactccagcctgggcaccattgagcgctgagtgaaccagactccgtctgcaatcccggcacctcgggaggccgaggctggcagatcactcgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcggcacagcatcagagggagaccgtggaaagagagggagagggagaccgtggggagagggagagggagagggagaccgtggggagagggagagggagaccgtggggagagggagagggagagggagagggagagggactcactttctaaactttaaaactttatcaccttagttgaggtacaaatcctgttgtaatggaaaatttacagcgtgcttaatgattagtaaagcagattatattatccaacattccaataagataaaataatcacagtgatttctcttttttggaaaaagtttctcttattctcctacattattgttaagttttttttttttttaaactagagatatgtctaatatattttaaaacacaaagcttttgaggtgggtgtggtggctcatgcctgtcatcccagcacattggtaggctgagatgggcatatcacctgagatcaggagtcaagaccaaaattttagtattttagtgtgtattttagtatttattttagtatttaatacatcatttagggctacatgtagccacagaaagaataaatctgattcagtgacttaaagaaatatagatttcatttttgtcacttaaaacgtgcagaggaaggcagtccagggttcttttcagtttcctgatacttccttagcctggtttctattcttgtggtcacaatgtggctgctgtttttccaggccttggattgccttccaaggagggaaagatgaaaggtcaaaaggctgagtttgtctctttttagctgaaaaacacagatttctcaaaagttgtaaaattatactgcaattcaattttcatccttttttttttttttttttttgaaacgcagtcttgctctgttgccaggctggagtgcagtggcacaatctcggctcactgtcataatgtccgcctccatggttcaagtgattctcctacctcagcctccctaatagctaggaatacaggcgcatgacaccacgcccgactcatttctatttgtatttttagtagagacgagatttcaccatgttggccaggctggttttgaactccagaccttgtgatccgcccacctctgcctcccaaagtgctggaattagaggcatgagccactgcgcctggcctgcaattttcatcttttggctgcaaataagttatgtcactattctcagctgggggagtgtttaactcacatgttgcttcctctctgttacacaggttttaagatttatgaataggtactgaattgtatcaattgcttttttctttcttgattgagcagtgttttttcttatctttttatgttgataaggtaacttaacagtgattggcttttgaatgttgaacattgcattttggaattaaatcaactttgttgtgataaatgattaataccatattatatatggttgagatgggtttgctcctagttcatttggtagttttgtacttacgttcacaagagaaagtggagtctaagtttttctgtgtgttttttttttttttttttttttttttgccacggagtctcgccctgttgtccaggctggaatgcagtggcatgatctcggctcattgcaagctccgccttccgggttcacgccattctcctgcttcagcctcccgagtagttgggactataggcgcccaccaccacccctggctaatttattgtatttttttagtagagacggggtttcaccgtgttagccaggatggtctcgatctcctgacctcgtgatccacccgcctcagcctcccaaagtgctgggattacaggcgtgagccactgcacccagacttgtgaggttttaatatgaagtattaaagctatgctggttagacaatttgagaaatgtttcttctcctatttctgacagagtttatgtaagatgtgtgctatttcttccttaagcatttggaaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctcatgaacactcctcaatttggagagagagggactgtgatgaggggggttgagatggtacccagagcctgatggccctcaccagcttcaggagaaacctgctcccctccagggctccttcctagggtccggcttgcactgcattctgggagaatcctgtagccccatcttccctttacccattggccgtttaatggtatcccattctcacatttagccttttgaatgaatcaaccaccatattaaaaaattaatagatttaatttttttttcagcagttttaggtttatggagaaattgagcagaaagtttagggagttctcctgtacaccctcaccccatttcccctgtttcctcattattaacatcttacattggtgtggtacattcgttaccattgatggggcagtattattattaactggagcccatagttaaaacatattggggttcactcttcatgttgtatattttatgagttttgacaaatggggaatgactcagctaccatgtctttgttttagtagatcgttagttgctttttgtcttattagctgactcttgttttgaggagaactttttgtcacatccttttgcaccccggcttactgtggcgtggggcaggggtactgggggccagctggtctctggggagcagcactcactgcatcctgcccccgccccattctgctcctttctggtctcagcagcctcccttgctcctttcacctgcctaccccagctcagctgcctgctgcttagatgccactgtggggcaaggaagctgcccccagtcggtccccgaggattctgcccagatagggataagaatcaccgcgagtgtttgctgagcacttgggaggcataggctcggcgggaagggaaggcctgcaggctgaggtggtctgctttgagttttgcagcgttgcctgcggtctccgtgggtgagggaaaaggcacagggaggtgcagaagcgttcctggcgccacggagccggtcagtgacagagccgggtctcaacccaggccactgccctcggcagccaagccccttctttattttggaatggccacctggccaactggcacacagggagaactcatgaaaggaggcgtggctcactcctgaagggagagggacacaggagcagccttgatgcgcaacgccccctccaggccccgagtccctgtccttggaggaagcaggactcccaggtgggagaggtgaagcagatggcttcccccactgcaaggaggaatcccggtgctcttctccaccagccttccctttggtcgccccctggcgtccgcgtcattgtgggaacactcgggcgggatgtattttaaaggagtgcctgatgcgtgtgggtgtggtggggttgggggtgggggtggggctgggggtggttgcagcggggcctatgcaggatcccggttggagggggctgcagaggctactgctgggcctggtgtcgccatggcagctggagagcgggcgaccggtcgcttggcgtcctgcttggggttgttgcccacatcaccgagcgaacgttcctgtcccgcccactcactgcgaggctgggcagggccgcttgccagttaattgtggggattattatttttttttttttgtagacggagtcgcgctctgtctcccaggctggagtgcagtggcgctatcttggctcactgcaagctccgcctccagggttcacgccattctcctgcctcagcctccggagtagctgggactacaggcgcccgccaccacgcccggctaattttttgcgttttttagtagaaacgaggtttcaccatgttagcaaagatggtctcaatctcctgacctcgtgatccgcccacctaggcctcccaaaatgttgggattacaggcgtgagccactgcgcccggccggttgtggggattatctgagagttgctggagtgttctgcacttccttgcgaaccttttacctgggtgggcagggggagaggccgagtcaagggaaggaggcaggatgccacacacgccctgcagggagagtcatctgctgggcactgcgacacacagaaagccaggagcctgagccccgcccgcggttgttgaacggagggagaatgaacaaccgctgacttcctggttcctgggtgccgcatcactgcccctctgctccgggtcaaaccggctgtatgcttagcttcaggaacatgtggcaggtggcagcccccggccccgtggcaggtaacggtggttttgcagtgtggcgtgctgtgggggccggcaggggcacagctgggcaggccaggctttctctggctcagtatgcagggctggttcttcccagaggaggcagaggtcagggaggagctctttccctgtgtctcctgaacagcttcatcagcacaccctgcagcggggactcagtgagcatcctgcagctgtcttgtcccagaagggctgtgtacttttggccctgagggcaacctctgcatttcctttctgggggctcccagatgagccccgctcccccaggtcatcctgatccatattgatgtgataaccccctcctcagtccgaaacatctggaggccccgtttgtccgtgggataagaatgggcttgagcatggctgtgggtgctccgtgtggcgacagtggcatgttctgtggcagcttgcttcctctgtagcccgatgtctttgactcccagcccgatgctccctcctcacccagcagaggcccctcctcggcctttgcatttgctttcatttatcttccttctttaaggctgcttttgagggtttactggccagcagcatcatgtgcagtctataaactgtgtgccctctcggggccaggtaggagcctgagagggaatgggagaagtggtcacgaatgattgtgaggactgcagaaagaagacagggctgagaagagtgtgatttcccctagaattcagagatgcctgcaccagctgggttttgaagaatgaataggagtttgccaggaagattctagaggaacaacagcaacaaaaagatttaaacatgggcacagaagaggtgaggcacagatggcacagggatttggggtgtgatggggcaaggaagccatgggcagggtctaggcccaggacctcaggtgctttgcatgccatgacttggaggcaatggccttgtcatgcagaactgtgcctccctgggccccattagagtccctggctcttggtgtgcctttcatgcccacaccacggtaggagcaggcaggtggggtttggcctgggtttccccaaaatggacactactccttcttgtgcttcagtatcagagtgggcccgtggagtgggaataaatgtttgggtttaggaggcctccagctgggtggcctgctcccaggcaggaaacacagattagaggaagtatcaagttggaaggcagcagccgtggatgttaaagctggaggaacctcttaaggaatggctgtcagctccctcgtttggtgtggtaggaagatgagggtgagaggggttgggagcaggtgctggagctggagcctgaacccccatatctcagtgctgccatcatccttcataataaggaaactgaggcacaggcaggttacatagtcttctcaggatgtcagtggcagagctaggacgtctatctctgcagctcagttctgtgcgaagtccaggcagatggtgctgatcagtaaggggtgctggctgagcgctgatggccacctgcatctcaaggagaaacagtgtcactggctaatctgatggcttctctgggcaccagcacgtgggcaccatcaccctttctctgcagggggtttgtttagtgtatttggtagaacatcccccagcctactaggtgtggcatgctctatgccacaagctctgtatctcaggcagcattttgtactttgaaaaaacaagttgggaacagaaccctgatgaatgtgtttcatttcctgtcagagcaaatgaaacctgaaatattaatggcacgagatttcccttatcttcctacaaaatcttcctacattgaaaaatgtactccccacaagcttagcatgcagctctgctacctgtggcccgaaatcattagttgtccatactcactgacctttggaaataaacacgaaggttcacttgaagacttgggggagaatcacggtcaacttgtgacgcttggtttttcagatattcagctgctctggagagccttggagttccagctgctctagaggttctggggagggagctgttagcctcccatatgagcgtgtggcccatcgttgccatccacacctgcccctctgtgggtgaataagtggtttcctttctcagctggttgacgcttcatttgtttgtgttctttttctttacagtctcctgaatatttacgcgttgctgaatctcctgtggacaaaccaccaataggccaggactgtcctgtggacagacggggtgagcctcttcttgtgtctggagattctgagtgagtagaacccgttatgatccccactgcacttaatgtggcattcatgaatgagtctgggctgatgtgctaattgggggccgtaagaagagttatagccacgatggccctcacctttctctaataaaagcttaaacacagctacggtaaatatttttgctttctgctttcacaaacttcacatacgcttacatttattttgaggcgaaaggggaagaacagacatttacaggggaccagttgctaggagaagactgtgcattccctgtaaccctgtcagtctcacctcggagatcctgtccctggagtgccccaggtcccttttcccagctgcactgagtgcctctgtcctcctggtggagctgtgctgctttcttgggcagcctcccttccccatggggtgcacataggctgggggcatcccggtggtcagttcttcccagggacccaggaggaggggctggcagaaagtgggcaggttctttccgctcgacctggcaataacaattcctaaattgctcagcaccccaggctgcttgccttgacccaggtagccagtcccaggcaccaccagtgtgggcagggccctccccaggggcagcagcagggcagcccaagacactggtggccaccacagttagtccccacaaggcgattgtgcaggacatgttctcgagctgcctgcagggtctggttgtgggagcagctcagcccctcctgcagaggtgggagcatcttctacagccagccattgtcccgcaggagctctgtgcccagtggaatatctcagtgcagtgcacaatggggccacagctgtgtcacagccatgctctgtcctttagtgggccgtctgagccacattccacctgcctgttctgacacactgctctccctcgatgaccctgctcccactggcctccccatggtttcgatctgtaacccagaccctgttcccaggagctggctcagcaccatcctgctccacaccctctctcaggagacatcctaacctgcccagcctgtcctgttcctgcctctcaacccagaacactgcaggtccttcaggtattcggtgagaccttagaagcaggcacagcaggatttatcccacatgcaccatgcaccgtgctgaggaagccacggtcactcccctaatggtcactagaggtgagagaactgaggttgttgcccatgtggtagaactggaattcagggcctcagccacacctcagtcaccacaccacgccctgtgcaggacgctggggaaaccaggcagctaggactggcctgtgccttggaatgcttactcagaccacccatccttgtcccctttgcacctcaaaggcttggtctacttttcagacacagtttttatattgtcagcctgatacatatgcatattttaagatgtcaaagagttttataagttttatgaaaaaaatagcagacccctggcctcccagaccatctccccaccgcccctgccctgcccactccccatagattaccacttccagctcttattgcttcttcctctggatttatctccacatttgtaaagaatatgggcacgctgctatttcttagtcttctgttgtggtcaagatggttgaactcgtagatttccctcctgagagctgctccatctaaccctaaccctaactctgatatatagagttatgtcatcatttaggtgaacccttatgcagtgtgtatcagtcaggataggctgcctcatgatgcaggaacaagcatccccagacctgagagagttccgtttctctagcctcctgccctgggggtgggtgctgagtctgggggaggtgtggggtggggggaggggcctcagcgctcagcagacaggtgctcactggtgtcaccatgttccctgccctcttctcatatggaacacgtggtgcccttttgccagggcatccctgctcaggggtcaggatagtcctcctctgagtggctgggagtctgactgctccctgtttagactattgagtagccccctgctttctgcctcactccctttttgtgctggtgtctcagtgcttgggccttttggggttttagaggtgggccgtgaggctgggcatgaaaaggcttctctgcctccaccgcccccccggggctcctcatccctgtgctgcctcagcacttcgtctggcaagatttgcaggtgcagttttcatttctcattctttgttggttttgagtgatttcaagagaagatgcagaaaggctgtgaccccacctctaaaagccagcggtcaacctggccacccttaagcctgttctagtgggccccctgccccgttgccctgctgtgacagtgtcccacgaggacagactcaacacaggacttcagtccttgccttcccgagtgctggcagccctggtgctgttgctttccctctcccctccttgttctcaacctcaggaggaaaatgcccagtttctcatgatgagatatgatgtcatctgtaggttttttttttaaaaaagtgggtaaaattcatataacattagccattaaccagttgaaagtgtgtaattcagtaacatgtagtgcatttgcagtgttgggcacccactatctgtgtctagttccaacaagttttcttcatcccagagaggaactctccattaagcagtcactccccagcctccctaccccagtctctggcaaccccaatctgctttctgtctccatggacttacatattctgaatgtttcccataaattagacatcatataatttgtgaccttttctttctggcttctttggcttagcatgaagtttatgtggatgacccatgttgcaacatgtgtcagaacttcagtcctttctaaggctgaacaatattgcattctgcagatacaccacatttgtttgtgccttcatttgatgggcgtttgggtagtttccaccttttgactgtcaggaataatgcagctgtgagtgtgtgtggatagtgttagattcggtatctgttttcaactcttttgtgtatgtatttaggagtggaattgttgcgttctgtggtgactctgtttcacttttccaggaactgccaaactgttttccaccacagctgcaccgttttacattcccgccagcactgaatgaggattctcattttcccccatcctagccaacacttgttagtttctgttttttgtttctttgtttcatgatggccagtctatgggtgggaagtggggtctgactgtttattggcatttcctgaataggttttttggtagatgttctttatcaagctgaagatggtctctgcctcatttagtgagtggtttttaatcagaaatggttgttggatttttgtcagatgctttttctgcatcaattgatctgatcatatgattttgtctctttagtctgttgatgtggtagattatatccattgatttttctaatgttgaaccaacattgcagccttggaaaaaataccacttggttgtagtgtataattctttttaaacgttgttagatttgatttgctaataatttgttgtggatttttaagttgtttgctcctgagaggcagtggtatgtcattttcttataatttctttggttttgatgttaggataattccagcttcataaagtgaggaagtgtttcttcttttccaatttctggaataggttgtaaagaattggtgtaatttctcccttaaatgtttggtagaattcaccagtgaaatctatcttccttttactgatttttagtttaattctattgtagtctgagaacatatttttatgatttctatttttaaaatacttgttaaggtgtacttcatagctcagaatgtggtctatctttgtgaatgttctgtgcaagcttgagaagaatgtgtattttgctgtagttggatggaatattctataaatgtcaattctgttgagttgatttatgatgctattcaagtgaactgtccttgttgattttctgtctgcttgttctatcaattactgacaggtcttgaagtctccacttataatagtggatttaccaatttctcatttagaattaaaattctctcagattttgccccatatatttcaattatctgttgttaggtgcatagcctttaaggattgtaacatcctcttaaaaattgatttttctctcattatgtaatgtcgcctctttatccctgataattttccttggttggtagtctgctttgtctgaaattaataatggtactccaacttactttgattagagttagcatggtatacctttctctatccctttacttttaacctaccagtgtctctgcatttaaagtagatatcttgtagatagcatagagttgagacttgtgttttttatccactctgaaaatctctgtttcaatgggtgtgttttgatcattcacatttaaatgattattgaggtacttagattaatatcaaactttttagtaactgtcttctgtacttgccagagacttctttttctctctcctctggtttcaatggaccattttatgtgatgccattttatctcctttcatagtgtatcactcatacttctttttaaaagttttacaatatatgtttacaatatgtatttcaaaataatctaagcccaccttcaaataacactatacctcctcccatttagtacaactaccttataacagaatactcccaaatcctccttcctgtcccttgtgacattgctgttaattatttcaattatccatatgtcataatcatacagtatatcgttaccattattgcagtaaataaatttatttttatatcaaataagagtaaggaaaatagaaaattttatttcactgtcatttattcctttttgaatacctcttttttatgtagatccaagttttcaacctatataatttttcttctgtatgaagaaaaatcttttaacgtttatttcagggtatatattgccagtaatgaattcccttggttttgtttgcctgataaactatttctccttcatttttgaaggatactttttctgaacatagaatgctaggttggtggtttcttctttcaaaattttaaggatttcactccactctctctctctctctttttttttttttttttgagacagagtctcgctctgttgcccaggctggagtgcagtggtgctatctcggctcactgcaagctctgcctcccgggttcatgccattctcctgcctcagcctcctgagtagctgagattacaggcgccagccaccatgcctggctaatttttgtatttttagcagagatggggttttaccatgttgtccgtggctggtctcgaactcctgacctcaaatcatctgcctgcctcagcctccccaagtgctgggattacagacgtgagccaccgcacctggcctatccaccctcttcttcctttactggtttctgatgagaagtgggctgtaattcttatctttacccctctatagataaggtgtttccctaccccgctggtcatttgccttagtcattttctctgtctttggttttctgtagttcaaatatggtgtgcctaggtgtagggtattttgctttttgttttttttttgttttgttttgttcttagtatttactctatttggtgttctttgagcctccatggtctgtggcttggatctgtcattaattttgaaaatattttggccatcattacctcaaatgattttcttctccattgtctcttttgttcccttttggtattccagttacacgtgtaacatctttgatgttgttccacagttcttggatactttgttctgttcccctccccaacccattattattatttttttatttttatttttttgtagaggtgggactttgccatgttgcccaggctgatcttcaacttgtgagctcaggtgatccccccgcctcagcctcccaaagtgctgggattacaggcatgagccgctgtgcccggtcttcccaccattctttgtgtgcatgtgtgtttcattttgagaagttcttgttgacctgtcttcaggctgattattttcagccatgttgatgagcccgtcaaaggcattcttcatttctgttaataggttccttttgggctgggcgcggtggctcacacctgtaatcccagcactttgggaggccgaggcgggcggatcacctgaggtcgggtgtttgagaccaatctgaccaacatggagaaacccctgtctctattaaaaatacaaaattagccaggcgtgatggcgggcacctgtagtcccagctactcgagaggctggggcaggagaatgacgtgaacctgggaggcggaacttgcagtgagccgagatcactccactgtactccagcctgggcaacagagcgagactccatctaaaaaaaaaaaaaaaaagaaacatgttgtcctttttgtcttctagcatgccttgtaagttatttgaagctagatatgatgtatagggtgatgggaactgaggtaaacaggcctttaacgtgaggttttctgttaatctggctatgggctacgtgtaatgtttgttgtagctgtgagtgccggcgtattccgatccttgcagtgcccttgtttttgtcctctggctctgggcttccctaaattcccttcctcagacagagtgagtgtcgtgcagctctcccagctttcacctgctgttgtacactggagtcctgttggtgtagttgtagggtgtggggagggccagcggtctatagtcttctgattacatctcagtctttctgtggtcccatttccctgggctgtgactgtcacagatgtttcttcttatatagcttttccagaccccaaacaggaggccagagggggctggactcaggaatgcccttcctccgtggctttgcaacaaggttctggtaaagtctttccctgcggggagcaggcctttgtcctagagaaggctctggatgcatttcaccaggatgacgtttgtcctccctctgccagagtcaccaggagatgtctcttgggttttcatggtgagaacctagtagggatcctggaggaaaagcccatgaaagttttgggcccccctaagactgtggcttctaggagtttctcagtcatgggagtccacccttggcctgcagcaatttgtcagaattacccaaactactgtggtatggccctggaggctctgttccaggtcagtggatctttggatttggctgtgtctctagatttcaggggggcgggttgcaaactcaattcactgatgagtccaaagaaggtcattgattttcagtttgtgcaccattttctagtcatgaggatgggagtgatgacttccaagttctttacgtgttggagcggaaactccaatccttcccctgctttgattttcctgttaccctaaccgggaatcatgtttgttatttgatggtttactcagttgtcatctgtcttcctaattaggacataagctccagggaactggagtgtcagtgttcccttgcgtccttgcacccacaagacagcctggcacattctgaatgaatacaccgaaagggataaataacgaggccaagccacctggctatgggtggctgctaatccgtaggatttctcgtgccttgtggtttcagtgaatttgcgacacacatgagtgatgctgccaatgggaggctcccagatgtcctcaacaaatagaggagtgaccactcagatccaagggtgtagcacttcccgcctatcactgggagctgatgggctgtctttagcatggcactttgtatggtgctggcgcccaggcttccctggggcaacagcgttggcccaggcgacacacaagaagaagggggtttttctgtggtcacttccgcgttgctagttgttttgccctcttactgtggctaaaccttctgtccatacctgtcccccattctcagtatttggcttttcggattgcagtagtgggacttgggtgcacattgcaataaaccaatttgcccccattatccatgtcttgttgatggtcccactgccagcatcagttcttatgaacagatttctaaaccatcaccatctgttctgctcttaatttcaagtgtaaaaagtattactttcctaattccgtcaaggggagggagaatatgtattcctaaagaccacagttcttgtatgaggaagtgtagatctgccacccacctactaaaggaaaggttgcttctgcccatcctcaaagctgttgagcagttatttacctagagggtaaaactggcccattcgcatctctataaaaacaggtaggaaaaggtggaaggagctgagttggggaggtggaaggggggcaaaagctatgtctcccgtccctccctgacagtgcagccccccaaccctccagcccccgccagtataggtgggaatgggctggcagggctgcattgtggtggtccctgctgctgctagggctgtttccagaagaaggcccagtttcaggcttgacttcccctcagaagtcataaggaccataaggtccatctgggtgggcgctgagctctccacgatgggagcaggatagacatgagcatcttcaccctcgtggtccctctgagcctgccctgggggtgagctctttttctgctcaaatgaacattccaggcaggccctggagctttctgtcgttctaaggcaatagaaggttctttggttactttcagtcccaggaacattgttggtcagtcatgaaaaggagtaattatagactctttggagcttctcccacccggctggagcctgacctgtcttggagccggctggggagggagggctgtgtgtctccttctttctttctttgcctctgtttttgctggccagggagtgttccgagggatggagtgtctggggagagggcattctctccacaagtgggctgggtggcacttctggggtccagcagatgtttcacttggacttcctgtctccagtgaccctcgggtaggtttcttagagatgaccctgctgggaacttgcagctcttccctgcgacctgtgggaggccttgctgggctgatgcccttgactgctctccctatcctccaccatgcccctcgggagtgctcctgggctgttccttcaaggcggccccaggctggccccacactggtgggagcagcaggcagctcctccttgggcagctcctcctcttcccctgtgaggcagctctggtcatggcctcctgcctctggattctcaggaaactcgggtgccgcgtccgcagacattggggactcggtacagctatcctaggggtctgctagaagccctgtttgggaatcatggtgaagccacctccccagccccctccatgaggcacagcccttcacggaaagtccctgctcctcttctggtaccccgtaggccagaaaccatgctggggtggggagctgggagcatctgttgatgtgggatgcaggcgtgcttgtcacctctcctggccctcagggcagcaggacagcttacatgaacatctcatcccgctgctggtggcctctggtgagagactactccagtcggtccccctgtagctcctggatcttagcgggggcctgggaatgggaggccacaaggaggttccagagctaactaaagccgctgagactcagagggagtctcacgccactgcctcctgtgcccccatcccctagcaaagtgggactgatgagggatgaccttgcgtccttctcccctgttcactgggacctggtgctgttgccaccgtgggcccaaacatccactgcccttttagcaaggcagcgctgctccatagggtccagccggggaagcatctggctttgcacaggtggaagatcatgactatttccagagtctgttgccaggctccatgtagttcaggagttgtttctccctctgagagtccaaagtggttgttttccggagtttggcagtacctaagggttaattgggatgttattgtctgcatttggcttagagataggaaagttttatgtttattcaaattatcagtaatttaaaattacaattttagtcttaattgtacgtatttggagatcccatttaagtctttggaaataattgcagagtaatattttgggaagttatattacaatgcacagacgttcaagtggagaaaggtccctgcgtgtgagccttggcctggcagaggggcatccaggacaggatctacagcacacagccctcccaactgggtctgggcatggctgcagctgagtctagccctcctttctgtgctgctgcatcccaggggatacggccacacaggccacagttgcctagaccgacctggtgtcaggatcactgtctctgctttggtaagatgtccttgggaggggaagggagccagccaatgagatgaggggtaggagggtgacagggtggagcagaccctcatgctggcagaagagaggttcacattcaccagggagcaggtttttctgaaccctggagagctgaggggggcacctggagcacccctgcagtccacagcatggggtgctggcttctgtactgtagtgcagtgccatgaggtacccatcccttgcagtggggtagggtttaaaacccagaaggcagccctccctggagcacagccccatggtgtttagagaccctctcctctgagcacatgcaggatgtgacaatgcaggtgggcctagtgctgcagtctcagagacacccatgggcttctgccatgctttttatccaccagggcagtaaaagcaacgtccacagtggcttagcctcctgcaaagcctgtggcaggacagccagggttccctgacagtggagatggtggacggccccatagggggttggtcccatctcgccagcagaagtgacctgtgtggccttagtggtcagtgctgcctattgtgatagtggattgtttaaagccaggtcccatcgtggctcctgagggaatgaaaatgaggggttctttgctgtgatctgatgcttgtgttccaccaaatccatattttggaattcttatccccaaagtgatgggacctttgggagggagacattggaattcacattcccaaggagatggggccttatggaggtgtcttaatctgtattctgctgctgaaacagaataccacagattgggtaatttataatgaacagaacattatttggctcagagttctaggggctgggaagtccaaggttgagggttgcatctgctgagggccttcttgctgcgtcctaacatggtggaaggcatcatatagtgagcgagagagggaagggggccaaactcattgttttattaggaacctgctcctcagtcactaacccactctcgcgataatggcattaatacattcatgagggtagagctttcaggacctaatcacctcttaaaggtctcacttctcaacattgttgcatcggggattaggtttccaacacatgaactttgggggggcacattccaactatagcagtgggtgatcaggtcctgatggtgaagccctcataatgggatcaatgccgttttaaaagaggctgcagagagagcctcccgccctccaccatgtgaggacagagtgagaagctgccgtctctgagccatcacgcaggtactcaccaggcacggaatctgctggctctctggtcttggacttcccagcctcctgaactgagacaagccactttctgtcatgtataatctacccagtttatggtattttgtgagagtaccctgaatggaataagactcccttcaaacaaatgtcctgctctttgaaagagagtgtggggctcacagtctgctagtaaagacagttgtaggagcaatggcaagcccacactggctcggattttcagaccttatcattgagttaggagcgaagtcctcgacctgaggttttattggtccaaagtcagggcctgctggagcccgacaggttgcgtgcttggcctgtggagcagttttctccagagcacctctatcccctctgccttgtgccaggcccagcagggactgagggtagaataatgacaggcacagctcctcccctcaaagagtccactatctggggtttgatgctggagcgcaaggaggggctgcccacatgggcggagcagagggcctggggaagttccaggaagaagtgactgtgtgccgaggctgcaggagtagaggcagcccaggagaaaggggggcatgggctggaggtgggggtggttccaggcagagagagcagcttgcacacgggaaaacaaggcatggagtgggcagctccttccgcctggtctctaaacctgtgaagagggggctggggagaagagacgggggtggaggagagcaggactcacaggccagccagccctccacagccttgggaacagagtgaagagcttggactgtgtcctatgtcctggggccggtgccactgcaggctttggagccaggagggactcagtggagcttgctgtgtatgattgtgagtgtggggaatggtttggggtgggaggcaggacaagcagctgtggactcctgtctgcaggtgagtgccagggctcagtgtgggttctgattgggctaagtaggtgcccatctgcctggagtccagctgtccttgtgtggtctgtagaccttgttgtcaaggtctggcagctcaacgctggtctttctgagataatgaaaagggaaaactttagaggcaggacgaagaccttgtagtgaccagtgacatccccacagggtctaggtgtgcgaggtctattggcgcctgtgtgggaaggcgggaaaccaggggcttggggccagctacaaatgccacactgggctctgccttggctctaggtgctttggttgctggatttggtggtggctcagggcagtcacttgtcattctcagtattttatcccctggggcctcctcagagccataggagatggttcacctctgaaggactgccccatgctgtgcttggtaagctcggtcacccagggctgtcacagagatgggctatggcccacatgggctgagcggatttctgccctgccacctacaccttgctgtgattactttggcagtgtttccccgtcaggagagcaggtgggaagggaggcaggtccctgaactgggatagagcccggagacctgggtgtcctctgctctgttgtactgacacgctgcgtgcttatgaaatgagggcaggggttctcagtgctcccatggcatggtgactataatccatgaatgatgcccacacagttcctggcatgctcagtgtagccttgttgttgtaagagaaaaaagcagggattctccacttccccacagagtgaactggaacgaggagagactggtatttctccaacactaggtttctttggatttttatgctggttgatactccctaaatcacaggtcgccttaaagagagcaagagccctgcacggtggcccggacccttggggccccttccatccgatgcacctcgtggcccagtctttacctgctcaccatgcacagcacttcgcatgggtttggaaacgtgtcatctgcatggcaaggatgggaatggggagtgggaacctgcagtttagggtccaggcgggtggattttaatttgcccctgggggattctagggccagcagagctcactgccgctgctgtctgggcctccaggcagtgagctgctgggggagcccctctggaaatggacagtggctgtcagggcgtaggacgctagggggcgaacagaggaagtagaggtatctggggctgaagttcaaggttgcagcatgaagttcagggttgcagcgcccagcctagcagggcagggttcaatctgcaggactggcatgaggaggcagaggagtcagccaagccctcccctcagcctctctccagacactacagatccaaggccaggtctgcatgaggacagccacctggtctcggctgaggttacaggaagggagtcggggcaagggccagtgagtttgttcctaatttgggtcccctaattgtccaagagaagaagaaaaggcctaatttctgtttcgctaagttttagactactttagttcatgttctttaacaataggttattcatgcagagctcatctctattaatcaaaatgtatgattaggcagaaagccctattcccacaccagagtggtgaaatgcagtgcatgtgtgttcagatcaatttttgaagtcttgattttgttttgttacatgtttatttgattgcttgcagaagaatgaagttttttggccctctggaaaatttttctttctcctgagaggttttccaatctagtagaaaatagacgcagagtttggcttgcactgattgcggcattagaagcggccctgtacattttaatgtggaagacgtgatggttttgcgtttgctcctccagttgtgccccatagctgtctttctgccagctctcttgcacatttagttcttgagtgagatgttctaaatagaagccatggtccattcagtccccagcctgctgtccttctgtgacccgccagccagctttgcttagggagctatgagcccctcctactaggctacaaagtcatgggcaggaaaagcatttgtgcacagccaggagcagagcacccaggcccaggtctgtcccggagccatgtggacctggcgaatggctgttcaggtcagaagggggtttggatacaccggttctgtgtttcggaggccagcgtagtccccagtgtatttcgcagaagtgatagcagctttattcccaaggcactagtgcctgcgcgttaggcacgtgctgggtgcctgcttgagtgtctcctttgttcctctctatcactggctgtcccctgcagaggcaagcgaggcagagagttggctggtaacagccagtgtccgcagagccccagggctccctgactgggctgtgccacctggggacaggcagatagaccccaagtaaagttaaagggaagcacagtggggcctgcacaggatgtgagttggaggctctggtgaaactgagacttggtgggggatgggaggcaggggccctgctgggacagacaggagaccaggggccagtggcagaaatggtcctcgatctaccctcatgcagatggtggcctctaccgggagccctgtgtgtctctgagccttagtctccctccctccagtctgcgaaatgggcataatagaaatgatgcctctcactaataaatctgtgcagaaagagaaagcagtttgcaactgcaaagcattattcaggtcttcctggctctacctccaggatcgtatgcctccgctctctcacgagacacaggcctcccatgtgcccggtggtggtctcgaggtcatctgagccatcatccacccctctataccggggacagtgtgctgccaggaggggcaccagaagaggtgtcatacagtggcatgctgagctaggatttgaggcacttcctgcctcttctagttccttgtgggccgggggtgctttgctcagatggtgctggggaggaagggcaatatctaaggatgtattgagagggtcacattcaggtgtgccatcttctgagggacagaaccctgtcacgacagttttgccgtgactgaattcccacattgcagagtgcgcttggggtgtggctctgaacatcgctggcaggtcaggtggagcctcgctgctctggggagctgtgcccaggttccctcggttcctgaagctcagaggttgcaggagaaagggcctcctggtggctgcttactctgccccactgtgaagtgcctggtcactagagttaggcctctctcccactccgggcttcagggattccactgaggatggagggtgttggatttagtttcttttttttttcttttttttcttttgagatggagtctcactctgtcgcccaggctggagtgcagtggcaccatctctgcttactgcaagctccgcctcctgggttcacgccattctcctgcctcagcctcccgagtagctgggactacaggcgcccgccaccacgcccggctaattgttttgtatttttggtagagacggggtttgaccgtgttagccaggatggtctcgatctcctgacctcgtgatccgcccacctcggcctcccaaagtgctgggattacaggcatgagccaccgcgcctggcccccttctggagtatttcgttcattagaagtaagtcagggacttagtgtctttagctccagccagtcctgtggcctctctgccactgtgtgaatgtccccaaccccccacctgataagcaggtgtcctgaggtcatcagggatttggacttagttattaaaaagcaaccagcacccttaggagcctccagagcagagattgccaaactttctcagaccacggtgccctggatctcagcaatttcatggtgtttctagaccaaaacacatagctaacaactctactctttaagtagctaggtccaaaccacatggtatttatgtcccaacaacttggaagccacatgagaaataatactcataaattgaaacaaatgtatttcatcctaaaccacaattacaaacggaagtgtgtctgctgaatgagattggcaccattctcatttcctgtttgatgctgacttttgtgtgggacttgctgtttaaaagtttatttttatttttaatttttatacacatatcatagttatacatattatgggggtacgtgtgatattttttcttgagacagcgtgacagagttttgctctgtagcccaggctggagtgcaggggtgcaatcttggctcactgcaccctccacctccctgttcaagcgattttcatgtctctgcctcttaagtagctgggactacaagaggtacgccacctcgcctggctaatttttgtatttttagtagagatggggtttcaccacattgtccaggctggtctcaaactcctggcctcaagtgatctgcctgcctaggcctcccaaagtgctggaatcacaggcatgagccaccgcacctggcctacatgtggtattttaatataagcatatacattattaattgtggcaaagtacacataacataaaataccatcttaatcattttaagtgtatagttcggtggaattaagtacatcaacattgttttgcagtcatcaccatcagctatctccaaaacgttttcatcttcccaaaacttaaattgtgcgcatgaaacagtacctctcctttcccccttcctccagcccctcccagccaccactctactttccctctgtctgaattcacctctctaggtacctcatgtaagtggaatcgtgcagtatttgttcttttgtgactgtcttatttcacttcgcatggtgtccgtaggggtcctgcacgttgtggcatgcgtcagaattgcttccttttttagtgctgaataacactccattgcgggaatatgccacattttgttgatctgttcttctgctgctggacacgtgggttggttccgccatttggattgtggataatgctgctgtgaacaggggtgtacagatgtctccctgagtcccttctttcagttcttttgggatatacccagaagtggaattactggaccatatggtagctctttttaaaattttttgaagtgccatactattttccacagcagctgcacccatttacatttctattatgccaacagtgtacaagggctccaatttctccacatcctcaccagcacttgtgttttcattttttttgtttttcttttctttcttcttccttttttaaatggtactatcccaacaagcgtgatagcaggaatttgcttttaattacagctacttctggcctcacgagacgtctttcagaggaatgtagtgtgatctcaccttggaaacgagagctgcctcaaggcagtggtgcatgcggtgctgacaggtgccaagggtcactgccttccccatggacatctgggctgtgctgcagtgcccctgtgggtgcagcagggcccctagggtgcctccgtgcagcttgggagccatggaactagacagtgtgcttcagacgagtagataagcacagaaacagagccgtaaggactggggggaacgtccagtccatagttctgtgtggaaccacgatccacggaggcagctgaggggcaagtgtagtgtacgtggctgtgcgctccatctccgtgcttacagccctacaaagtgggaagagaatggaagaaacaggagagaaaaagtcccgtgtggtttcccggaatcctgtgggtagtgagagtctcagcattgttattcctagcatgttttgtgtgtaacgtgagatgaagcaaatgattactgatgtgatcttttaactctgaggaccttgaccaggattttcagtggcgaggagaaaggagatacggaggaaaggtgctgcgggttaagaaagcctcgggaggctgggcgtggtggctcacgcctgtaatcccagcactttgggaggccgaggcaggtggatcatgaggtcaggagatcgagaccatcctggctaacacagtgaaaccccgtctctactaaaaatacaaaaaaaaaaaaaaaaaaaaaaaaaaaaaaatagcggggcgtggtggcaggcacctgtagtcccagctactccgaaggctgagacaggagaatggagaatggcgtgaacccgggtgaacccgggaggtggagcttgcagtgagccgagatcacgccactgcactccagcctgggtgacagagcgagactctgtatcaaaaaaaaagaaaaaaaaaaaagaaaagaaaaagaaaaacaaagcctctggaatccggaactacaaatccataagtagccctagagcgttccctggagaggcctggaatcagtggccaaaccaatcacacggagcacccccagtcccgggtcatgtcttgaaattcagttttctgctgaaagaagctgagactacttggacaaatggttgataccgggttgggggcgggaaatgtacaagttgaacctaaatgctttgtcatagcagataataaaggagccaccctggactgtgaggatgtgattctgctgagagagagcattaaaagaggaaaaaaactattaaagtcaaagtccacgaggatagtgttaaaaggactcgtgagctcacctgatgaggccagagatggacaatttgaacatcagtaagagtaaaaatcacagtaggttgaaatgtatgcagtatgtttaagtccatgagtttttttaacaatactcaggaaataaacctaatccgtcacctttggagaatgctagggaaccaattatatatttttggtaaataagggaaagctctgaaatatatatcctgcttttcttatgcaggccgcactactgggtgagcaggtggcaggttgggaggttccatgtatagaggatggaacctctgtgtctgaagcgtctcagcacatctgaattcacaagctgggcgctggtggccctggggcctgctgacatctcaggaagggaggaagagccacactgcccgggagctggtctgcccctattctaacagggatctcattcgacttccagatccaaccactgatttgcaggaacggaaaggacagaggacgatgtttggctgtgcttcaggcacctggccatcaaaagccaaaccatgggaaatgctgtgtgaccaacgactcttcagttaataacttgggaggcaaaaaaaaaaaaaaaaaaaaaaagaggtggaagcacaaccaacggttaaaggggacataaaaggcacacatagtgtgtgtgtagggacatgtgctacatggagcagggtggggctatgattaccctacaaccaggatgtggtcaggggcacacagggaggctgggtcccgagggctggagtggccggtagggcccctcttcttccctgcctgaggattgtaaaggttgtttcatagccgttttgtttgtttatttatttatttatttatttagagatggagtctcgctctttcgcccaggctggagcgcagtggcgcgatctcagctcaccgcaagctccgcctcccgggttcacaccattctcctgcctcagcctcccgagtagctgggactacaggtgcccgccaccacgcctggctaattttgttttgtatttttagtagagacacggtttgaccgtgttagccaggatggtctcgatctcctgatctcgtgatccgcccgcctcagcctcctaaagtgctgggattacaggcgtgagccactgcgcctggcctcatagccatttattaagctaaatatttacactatgttttctaaaaaagtaaaattattttaacaacataaaagtcaaaggaagaagttcctggaagtggtcttgaaggtgcaagtgggcaattgtgaacagtctgctggtgcaggatgtggcgcttcgtcgtgggagtgctgtctccctccactgtgggccgcgctccttcctgcagcactcgcagctcactgctgccatttcccgtgtaatcctgtcttctgtcttgactcagacccactcgtatctttgttgtctggggtctgcgctttactaggggaccttggagttctgttgttggctgtgacttcattccatgttctttcccataaggaactgtgttgggaatagtttgatgattccatggtcatgccttttggccttttctgtgaggggcgaatggggagcacatggaacttattgctgctgtcttcagtatttcttgggggaggaactcggtgtggttttttccagcctgagcccaccctgaggtcggttgttggacccacctgcctgatgcagactgccagggtcttcctgccagcgcgggatcccccactttccatttcctcttgcaaccatcagacccagggacacatgtgtggctccttctccagtaagcgacctgggaggtatccttaccccaggacccgagtgagcgtctgttggagactcccaggtgtgcaggccagaaggacatgcccagttgtgtggctgcctcttccctgcagggagagagagaaggctggcgtggggcttctccccgggctgggcctgcgttgtccccgaggcccgtggccgctggagcagcccctgagcgactctgctccttcctgggcctcggtttcctcgttctcagggggggcttctgccagactgtctgggagatgttttcagccctctaatttgtgcatgctgtgactcacccaaaattacagagcaaagctaatggaatcaggaatttataaatcccccttccttcctcacgcggttccttgagtttttgaaaactaccattcagaatgagacagtggccttctacctgaggccacagggttgtctgtggcctaactgatttctggccagtcaggctgggtgagcctcaacagcgtgaacatactaaaggcttcttccttgccctgggacaccggttctggccaggctacagggctcacagctcagacctgcctctgcctgggagtgacacggtcccctctgctcacgtgccatggatcagagctgccatgtggcccagcttagggagaccaagaagcatgggagactccccggctatttgacgagcaggacctgtccatgccatctcccatctgtgccctgcatctgcgacttccaaagagcattggcctgcactgtcctatgaaatgctaccacaagccctttctggcaagtgcagttaatcctgttcggtgggttaggaaaccaaggctctgagggaggctttcagtgccacagctgggaggtgagagttgtgagttgcagatgtctcagccatcccgagcgtgaccattctgagtggcgggaagcttttcactcagcactgagtacatgatgcctacagtgttctgggcctcctccatcaggaatcatgggcccttctccccaggacgctcatcgatggccccggctcctccagccctggctcctccagccctggctcctccagccctggcccctccttgggctgtggctgcaccctgggctccacccattccagacccaaaggcccatgggccaaccagacaccgcccctacatggtgtgcccacaggctcttatggatcccagagggccccctttgtcctgcttggggaggctggggtggccgctacacagtgccctgccgtggcccccatgctccccaactccctactgtgtctgctggacgtttgaacagcctcctgccctaaaccttgcatcctgccacctctggcccactctccaccctggcctactcttcaccctggcccactctccactctgcagccaagtgatcttttccagcagcacatgtgactgagtattgctgatggctgcgactgctttcaggatcaaattgtgtctcttccgaaagagacatcagataagagacattggaaaagaacatgaattgcggtcacccagagctctttcgcggtttgggattaagccatgcagaaaggtgtgcaggagcctagatcacctgccaacctgcctcttgccatcctctattttgtacgctcagtcaccccagaaaattgctccggcccttggatttacctccgtgtcactgtccatccggtaccctctgcctgggatgcctcctgggtctccatcacccgcctcactcgtttttcctctgcacatggcatctacttccgcccttccgcaggacaccttcccaggctgggtctggaccaccctgcggactcgctcctcgcaatactggccacatgccctcaagcccatctgtttcttagagtcgatgtcccctaaggtgtgagttcctggtgagcaggagaacctgtgccttttataacctggtgtgctgctcggcgtgccgaaggaaccaaggcgatgttgagaaatgaatggaacagctgtactgtgcagagatacgtgcagagaggggcaggaggaagcctccacttcagacttcagtgtgaaaaagagacactggaaaagaacatgaaatgtggttgcccgatgctcctttgtggtttgggatgaagccctgcagaaaggtccgggcagcactgcagccccgccatgctgcttgccccacgtgggttctggagtctggtggcacctggaagagcaggtggagtggaagctgctagaaggtgggaacctgagggtcctgggctggcagaggccttgcccccgctttgcctagggaggcagtgagcttcctccttcatttgaactttgccctgaagagctgggccttccttgttcatggggagcctgatgcttcttcccagcacaccacagccacacaggaggtgcagcagagcatgcggagatccacctggcaactcacagccagccgcggcgtcactgtcaggactctgtgaaaaacaaggtttctgtttggcgcggggacgaccagagggaaggagactggtagagcctaagtattcagccgaccattaaaaagtgaaagtcagaagcaatgtaagtcaaaactcaggacatctcagggtgaccttggccactcacagttgttcgtgtttgaaatcacattgattctcgcagctgtccaaggcgcaggaaataaccactctgggtgatgtcgttgggatggttttgtcagcactcaggatttgggggtttgttatgaaaatttcacgttacaaaaaagggagaagtgcagttttgtgtgtttagggttattggtggctagacatctgaaaatcaggatccccgctcattgattttttttttttttttgagatggagtcttgctctgttgcccaggctagagtgcagtggccaatcttggttcactgcaacctcggcctcccaagttcaagcgattctcctgcctcagcctcctgagtaactgggattacaggcgcctgccccccgcctggctaatttttgtatttttagtagagacagggttttaacatgttagccaggctggtaactcctgacctcaggtgatcagcctacctcggcctcccaaagtgctgggattacaggcggtgccgctccttacattttgttgctgttcccaggaagattgatggagggaaaacacactctccacagaggagatcctgtgtttacagccgtcttagatagagtcgtgatgaggaggaggactctgggccgacagtgtatgagggttccgcctcataaggctgtttggtgtttgtgcccacactgggtgtgacgggttgaagcagtggataacaagcctattactgttatgcaaatgtgggcggcccagttgcattcttcatgcatgtgtctctccctaatgagtttcaaaatcttaatttagatcttgattttgttgcagataggattccaatttaaagagcgtttgtcattcagagactgtggtagacaggaaaatggtcttcagagatatccacaccctagctgtggcgcctgtaaatctgttactttatgtgacagaaaggactttgcagatctgattaagttatggatcttgagatggagagattattctggattattcaggtgggcccttataatcatggtgacccttataagaaggaagctggaggagttaattgtcagaggagaaggtgctgtgacgatggaagtggagattgaagtgatgcactttgaagatggaggaagcggctgcaagccaaggaatgcaggtggcttctagaagccagaaaaggcaaggaaacagattcttgcctagagcctccgtaaagaaccaggccagtcgacaccatgaccttagcccaaggagacctgcgtgggattcctttctttttattttctttcttttcttttcttttttttgagacaggatcttgctctgtcatccaggctggagtgcagtggcgccatctcagctcactgcaacctccacctcttaggttcaagccattttcgtgcctcaaccacccatgtagctgggatacaggcacatgccaccatgtctggctaatttttgcatttttttgtaaagataaggtcttgctatattgcctaggctgttcttgaactcctgggctcaagggatccacctgcctcagcctcgccaagtgctgggattataggcgtgagccactgcactcagccctctgtgggatttctgaactatagaactgtaagagagcaagttggtgttgtctgaagtcactagatttatggtgacttgtcacagcagccataggaagctaacacagagactcagggaccaagcctttccattgcagcaagattgatcagttgttctctcccatcacggggctctcattttgctcaagtcctatgtcatcgtccctcttttcctggagagcaggagctgacttcagacgccagatcttcttttcctgccacagcgcacttgcagctcttgggaggtgaaggttctgcctgctgctcttctggaatgataaacgctgggcccttagtggaaatgtcaggtgaaatggaaggcagctccttgggtgcagtgacaggacctgcagtgggcctgttggagctggcactgagggctgctccccatccctctgtgggtgtattggctgcatgctgactggccgtcctcgtgggcgtggcctggtgtgtgtgcaggtggacagaggctggagtatccttgagaggctgtgcgttctctcggcttcttttggagccagagccatcagggagccatcacctgtcctggcctgacctgtcctgtcatgagtgctgtgttccttgagctgcctctcaggctaggggatgaggtggctgtgctcaggcctggcttctgcaggcttcttcctatctttggagcggctccaccactggaatctgtgacatgagaggcccgtagcccaggcccatcatctagaatggagaggcagccccacagcctcctgggaaccagagctccttgcctgggtcatcacagaactaagccttaaaatcaggaggcctcagcaaagcgcctctagagactcaaaccaccttgtaaatctcactgggagtgaacgattgactttttactcagtaccaggactacatactacctcatttatgggtttttcctctaaattgctaatgtttgaagtggaaattttcaaaactgactaatgtctctgcttcaagatttgctgtcaggcaacttatttataaataaagcagcttttcaaggagcactaacaaacaatccctcgtgttaggagactcagagccaagtcgtggctctaggttggccttgcagggtgttagggagccagttctccaccccagggccatggacttctgggtccttgcaccatccagagaggtgatgatgtggttattcccatgtatagagtctactgttttcagggggcatttgcatctgtggtttcattagatgttcagagcatccccacaggggttagttcatgtagagaaggaatcagaggctcacagaggttcagggtttgctgggtcaccagctcctaagaggggccctttgggctgaggccacggcgctttctttcttgcaagacagaaattttccttttcctttctttgccataatggccacctccttccaccccatatccttcttccctttggccactggtgagttctgattatttttggaaaaaaaaaaaaattaaaactctgggagcttgagactgaggtaaagtcccctttcgtagagatttttggactgacatgttagctctctgccctgtgtaacttcagagtttggtaggtgatggggacacgcctgttggagagtcctggtgtgtccagttttgtccccgcagcttcactggctgtcagagccacagcctttgcttacggctacgccctggaatatttaacagcaatttcttttcgctttcttctgtcgtgttctgtctgtgtcagtgttttgtggtcttactgtacctgttgttttattataggcagatactgtaaacgctgatacagtctgtgccctgcggttgtggtttttagggccttgcggcggcatctttgctagtgctcactgcaaataggggcaggaagcagttgtttgggaatgagccacatggtggaatatcttgaatgtcccaggccaggcacagagcagctgctcagtaaatgttgctgagtgagaggctggggggttggtgaggataggcaggggtgggcgtccaaggctgcagagttgtaaagcggggggtggggcagccagcaagtccagctcgaggaaacaccacggggttcaggggctctgtgtaagaaatggcagaggtttggcttcgcttttagttgttttgtttcttgttcaagtgaggagaacacaccgagaagggaggagagcaaggctggctgagcgtcatggcagggtggtaaaggaatcaatcacccggacaggttgtccgttcatgtgccgttgtttgcattgctgtgatacagactgctgtgccactgaaaccttccgaaaagcaagccacccagagagtgacttgggcaggtgtgtattcatgtgtgcatcagggagaggaatacttgcaaggagcagagcttccagaagaccaagattcagtggaggcagcaagtcagggccgggcagaagcccctggggtatctgcggaagagcactttccagggtgcatggatggatgcgttaaccagccagttcctacgcatcacggaggagaggtgcctgccctcctgggagccgtgcctattccattgcttctgttgtttttttgagacagggtctcactctgtcacccaggctggagtgcagtggcacgatttcagctcactgcagcctctgcctcccaggctcaagcgatcctcccacctcagcctcccaattagatgggacttcaggtgagcaccaccatgcctggctaatttttaaatgttttgtagaaacggggtctcactgtattgcccagactgttctcgaactcctgggctcaagtgatcctcatgcctccacctcccaaagtgctgggatttcaggcgtgagttaccacacccggcctcttgttgttgttagtaaacttttaattctagaacagctttaaagttataaaaaagttgcaaagactgcagagaattcccatgcttgcttcctccagtcttctctctcgttaacatcttacatcacacggtgcatttggcataactgaggaaccaacgtgggtccattgctatgaactaaactctgcagtttattccaatttccttagtttttgcttaatgttttttttctgtcccaggagcctgtccaggccactacgttacctatagtccttgcgtctccttagcctcctctggtctgtgacagtttttcagctttccttgtttttaatgaccttgatagttttcaagagtacaggtctttgtgaatatccttcgatttgggtttatctgctgttcttctcatggttagactggagttatgggtttgggggaggaaaaccacagaagcgaagcaccattttcaacatacatcaatgttgcatgatatcaatatgactcataactatcgatgttgaccccgatcagctggctgaggtagcatgtgccagttgctcactgtaagattaccccaccttcagcggggtgcggtggctcatgcctgtaatcccagcactttgggaggccgagtgggtggatcatgaggtcaggagatcgagaccatcttggctaacatggtgaaaccccgtctctattaaaaatacaaaaaattagccaggcgtggtggtgggcacctgtagtcccagctacttgggagactgaggcaggagaatggcgtgaacccaggaggcagagcttgcagtgagctgagatcacgccactgcactccaccctaggcgacagagtgagattctgtctcaaaaaaaaaaaaagaaagcaaaaaaagattaccccaccttctttccatagtcctccctggaaggaggtcgatgtgcagagcccatgcttaaggaatgtggagttacactccactccttcatggggggtggggatatctgtataaattatttggaatatttctgtatgggggacttatctattctcccccatttatttattcaaacatttacatcaatatggatttgtggatatataatttataccttgctttataatccagtgctgtgttatttattttattgctcaaactgtcccagctttgactatatgaagctctttcaggtggcatcccatgtcccttagagagatccctacctttttgtttttttgagtacagtcagttggccatatccgtgagttctgcatctgtggattcaaccaaccttagatgggaaatatctgggagaaaaatagatggttgcatctctactgaacagactttttgtcttgtcatcattccttaaacaatacagtataacaacgatttatatagcatttacattgtactaggtattataaataatctagaaaggatttaaaatatattgaagaatgtgcataggttatatgcagattctacaccattttatagaagggacttgagcattgaggattatggtatctacaggggggcctagataaccaatcccttacagatacccaaagaaaactgtacctctttctggcacaagatactcaggctcatcttgaatttttcctacccagtcctggactcagctatttctgcaaggatccctgccttattttattgaagaatggtatctagaaaccaaggtctggagacagggttcttcttgtcaccgaggtacattgcttccaggccctctcagcagacagagctaggaaatatgcatgtatgctaatctgtgtatacatatgtatctcccatagtttttttttatttttttattttttgagacaaagccttgctctgttgccaggctggagtgcagtggcacgatctccactcactgcaacctccgcctcccaaattcaagcaactttcccgcctcagcctccctagtagctgggactacaggcgtgtgccaccacacccagctaatttttgtacttttagtagacagagtttcaccatgttggccaggatggtcttgatctcttgacctcatgatccatccgccttggcctcccaaagtgctgggattacaggcgtgagcccactgcactcagccttttttttttttttttttttttttttaagacagagtctccctctgttgctcaagctggagtgaatggcacaatcttgtctcactgtaatctccacctcatgggttcaagggattctcttgcctcagcctcctgagtagctgggattataggcatgcaccaccacgcctggctaatttttgtgtcccatagcttttttttgaatgcacgaccccatctggcggcgaagccctggacctagccttctgatcactcatgggaaccatgaccacgtgtcacatagtagaaaggaaaacttggacaacttactgtgtagacaggagcagcaacaacaaaaaagacttggaaggcttaaagaatattttccaagtatacacaaatacagagaataataagaggaatgactttgagagcctgaggcaggaggattgcttgagcccaggagttcaagaacagtctgggtagcatagagtgaccttgtctctacaaaaaaattaaaaaaaaaagccaggtgtggtgacgcgcaccagtggtcccacctccgtgggaggcagaggcaagaggatcacttgagcctgggaagttgaggctgcagtgagccatgattataccactgcattccatcctggctaacagaccaagactctgtttaagaaaaaaggagtatctggggtacctgctatccagtttaagacatgtacaaatatgattcagccttccatgagcatgcctccccagccacccctgtgaaacccagtaaattgaatttactgtttgttttttggaggcatgttttatttttacactgcatgtatgcctaaatgatatatcccattgttatgatattttcaaactttgtagaaatgataccttactgtgttcctacaacttgaattttcattaactgagacattttacatgtatttatcttcttagcaatcctgagaaaagcaagagtcactatctccattgtatagatagagaaactgataatgtagagcaatgatgtgatttttgctaatttcaagcagctaatggagatcgactcacatttgtaccttcagagccctagtccatgctctttgtatgacataaatgtcaagattcatcaggaaaaggaagaacaggcgggtcttgttggttactctgtgaccctgttgcttccctgggacctggaagtcctggtgtctcccttagcctggaatcccagtctccatctgggttttgcaggctccaggagttttgatgaaatgaggacccatatggctggttgagactcccaccccctcatcactccctaccagcgtttgtgcagaatcctcctctcctcccgagttggaaataatgtatagttggctcaaaagtcagcccctccttattttagcaccagatgctgcctctcagcttcacgctgccctccagcagcattgcctgtggtccatgggatcttggccttcacactcagcattgaaacagctgccttccgctcccatcataggaaagagaacagaagtctcttgctcccactccccccgccccaccccctgctgctggcctatttctgtgctttgttttgctgtagaacttctggaaagagttgtctgcagtggctttctccatttcctcccttcccgttctctcttatacccgctccagtcggacttttgccccttccacagacacctctcctgacacttttgaccccatcacttagagatcaagatctgtaagactccaagtctccagatccagtggtcagctctcggtcccttcccatgtgactgaccagcagtgtttgccacagtcgtcccctctaggaaacaccttcttcccttggcttgtggggcactctgtgcttgggattttcttcctgcttcactggactttgctcagtccccttactgacccgtgagtgtcagagtgtccctgcggtcagtccatgcccctcttctccgctcggtccacactcccaccatggttgacctcattccgacttgtggcacaaggagctcacatttatcttttagctctgatttctcttctgacctccagactgtacaccctgttgctcacccagcgctttcccttagagttctaattgacgtccccacacaacaggcaccaagctgtccctggccatctcaaccccaatctccacatctcagtaaatggcagctccatgcttccggacacctagaccatagacttggagccaaccttgactcctgtctctcttaaaccccacatggaatctgttccgtaagctgcccatggtcacaccggcaccgctgccgtgcgatgagagcctgtcatctccttgctagattgctgtgccagtttcctgatggttcctgtttccacactgactgcataccttcccacccaagtctgtgtctgctcagcagctggtttattgcatacaaacttaaatgagaatgctcctccgaccagagctctccgttccctggccatcccattaagagtaaatgctggaagcccctcctcaactgactttatttcttaaaactctatcctgcaaaatcctgcctggctaataactttatcaccttcttcgtgttggttccaacgttcccttctgcaggtggcttctgcggactttggtactggcccacatccctgagctggtaaccccccaccatgcacaggcacccccacattaattctgtagcttatttgtttattgttgtctgtgccactccagacaggaagcctgtgggggttgggggcttggtctgccttcttcagccctgggctcacagtcctgacatcttcttgaagacggcgctcacggtcaggctgcagcaaattcacagttgacatctaggagtgagggcctcctgccatgctgcactctggcctctcacctgcctcctgctagtcctgggcacacctggaggacaatcagggaatttctttccccatctgctttggcatcctccaaacctgggaacctttctaacacctgactgcttggtgaccatgtgtgtgctctgtggatttctgtccaggagggtccctcactctggccctcagggccatgtgcatgtggacaccgactggtagggttggtttcctatgcagagagcagggccagaggcatagccggcccacccccagccccattgctcacggttcacccagtcccctggcctttccgacgctgtgcgcatctgtatttgttgcagtgaacagagcctagaattataggactttgtcagacagtttgattttcaaccccgtaaaaaatacattttacttaaccacctaggatacctctacattatagacctcaagcagaagtttcaggagacagtttcttactctcattagaggtgatgcgttttgtgtggtcttcggtttcattgccccataaactcacttggcgatctgcctgtgggtccccagcagtctgtaagccacagctttctcaaccgtacttcctgttctggaggagaaacctgagctgcaaagagctaagggtcttgctaaggtcataccagtgaattcaccaaacagccagtactggaaccctgtcctctgattcccatcctgtggcttttttaggcttgtgtaatcaattttaatgattgtaccattgtagcttatttaaattaccccaggaggaacatcagctctgttcaagaaatgttattgtagttgctcacctgctttgttcagggaaatgcatcttttgtgggatttcttctgagtaattaagagggtctaagaagccagttttatagtcatttatttaactgtagagaacaatgaagttaaacacaaaagctggttccatctgcaggaacatatgagtgatttgcattagaaagggtgttcatcaaagctcctcccaggtgcctagggaggcatggggggccttggtgggttccctgagggtcgggccaaggccttgggccagggagcacagttccattgcactgggtgtgttggggcagaaccttgtgcttggaggtaggtgttgcttctggccctcggttgcttgctcctgcaggcagggccgtggacccgtagctcagcaaccatggaggagctgtgagaaatgcacagtctcaggccccaccctggctctgctgacttggaacctgcatgttaacgagactgggggtttgtatgcacatcacatccggtccagctctggcctgaggactccggtctgtggtttctagtttttatcatccagctggtcatcctcagcagtagagaatgtggttggttaccatgtgcagggcagcctgctatgtgctgtggtaacagaagggtggggcagagccctcctagccctcccagccctctggggcttgctgtctctagggcaggcaggggctggcatatgcagttgtacaccatggtgttttacaaagcacgagtgccatggaccccatgggtgggctggattgagatgcaaggagggaaaacagatggggtggggtcccaagcaggaggaactgcatgaggaaaggcgtggaggctggacagatgcagaggcagtcagggaatagccagtgtcagaatggagcaggcgacagccgggttttggaggctttcagtcccacgtttagatatttggactttatccagtgggtcatggaagctactataaactttttaaaattaaatactattttatttaaaaaattgtgtaaaatacacataacataggattcaccttctggaaccatgtttaagtgtagagctcagtcgcattaagtacatttacacggttgtgcaaccatcaccccatccacctccagagctctcctcaccctgcaaaactgaaactctgtccccattaaacacttaactcccattcctcctcccctcaccccctggcacccaccattgtactttctgtctatgattttgacgacttcaggtgcctcgtatgagagcaattgtataggatttatattttgtgactggcatatttcactctcaacgtcctcacggtgcacacacgtcgtagtgtagcacgtgtcacagtctccttgtctgttaaggtcgaggaatacttccttgtatgaatagaccacattttgttgatcgttcatctggtgaaggatgcttgggttgcttttacctcttggctgttgtgaatcatgctgctgtgaacatgggggtacaatctctttgagctcttgttttctttttctttttttttctttttcttttgagatggagtctcgttctgtcacccaggctggagtgcagtggtgcaatctcagctcactgcaagctccgcctcccgggttcacgccattctcctgcctcagcctcccgagtagctgggactacaggcgcccgccaccgtgcctggctaatttttttaagtatttttagtagagacggggtttcactgtgttagccacgatggtctcaatctcctgacctcgtgatccgcccgcctcggcctcccaaagtgctgggattgattacaggcgtgagctactgcgcccggcctgagctcttgttttcacttccttcgggcatacccccagaagtggagtcattcctagatcatatggtgattctatttttaatgttttaaggatagcattttccaaaggggctgcacaccattttacattcctacccaccgtgtacaagggttccagttttctccacatcctcaccaacacttgttattttctggtttttcaatcgtggccaccctgatgggagtggggtagcagctctctgtggtttggatggcgttttcctgatgcacgatggtgtggagcacctctcctgtgtgggagcactgtggcctggtgagcaggggctctgtggtggggaggcgcgtgccgagggctgtaggagagggcgacgggtggtgctgtgcatcaggttcggggtgatgggaacgctgtctcttgcacctgcacatcaggcctcccccatgctactttggtggcttctgtgggagcacaatatgtccagggtgccatccccaaggcagaagggagcaccatctggtttgatgtgtggcctgtacttcaccaagcccaccacatttggcctatgactgtgtcctgctgcgactgggttgaagtcagaggagccgagacaggcgggggagcatttggaggacgtgtcccttgctgtggtgtctttgcagaagtggccagcacttgcactgcccagtagtattttcgatgctcctgggaacatgagaggattgcactctctgctttctcaaagttagataagaccatgtgccttgcttcagccaatgacatgtaagcagaagtgacttgtgggtagaagctggaagggactttctatgctgtcctttctccagtcacatcggtcctagaagcacatgcctaggaggaggggccataatagcaacgtggctgttatttgctttggactcacagtggactttgagtgagcaagacagaaaccattactgggcccaggccctgtggcgtgggagctgtttgttgtcacagcacagcctagcctgtcctcactgatccaggaggaacctgaaaagtattttaagtgcacagataggtgaagatgaaagtgtagcgttttgggataattctgcatgcttcttagtatctccagcagtttcgagatttggcgaaggggctgaacttttctgtaggtaaatctcttgctgaagagttcattatcagctggtaatggcttcattttgtcagcggcacagagctctggcttgtgcgtgtctgaggcctgtccccactggggcagggaggtaatgagaactcatgaaccctgcatctctgcctggctttaacagcctctgtgttttccagtgcttatcaaatccagagctgtttacatttcaggagacaacttcagactctgtggacctcattatacttccaaagcaggagggtcgttgtttttaagcattattcccaacttttttttttttgactgcagaaatgcctttttaatatcagaaaatttccaagttttccttacttggctatagtcttgtttttagtactgctttggtggttcagtaactattcattaaacaaatctcttcattttaagtttatttcttctatagggctcttctcttctcttctgttctcttctcttctttttgatacagaatctccctctgtcgccaggctggagtgcagtggtgcgaccttggttcactgcaacctccacctcctgggttaaagctattctcctgcctcagtctcccgagtagctgggactgcaggtgcatgccgccatgcccagctaatttttgtatttttagtggagacggggtttcaccatgttggccaggacggtcttgatctcttgacctcatgatccacctgcctcggcctcccaaagtgctgggattacaggcatgagcctccgcattcaaatatatgtaaaaacggagagaattgtgatccctgaaaattcatgtgttgaaatcttcacccccaggacctcagaatgtgactgtatttggagagagggtctttgaagaggtaactgagttaaaatgatatcatcaaggtagcttaatccaatctgactgatgttcttgtaagaagagattcagacacagacaggcacagacggatggccgtgtacatacatggcggaagacagccgtatgtgagccaaggagcgaggcctcctgagaaaccagccctgctgacaccataatctcgacttccagtcgccagaactggaagaaaatacatttctgttggttaagtcccctagcctgtggtactttgtgatagcattcctagaaaactaatacagtgcctgtgtgctattgttcagtgtcagcagttccagtttttaagcaatcttcatggactgctcccgaagttcagggagcatggggcctatagcagagaactaggcagcacctgcccttgtgaaactgacactctacggaaactggaaaaattcatgaggacaagcttcagttaacaacactttgaggctgggtgtgggagcttgagcctgtaatcccagcacttcgggaggccgaggcaggtggatcacttgaacccaggaatttgagagcagcctgggcaacatggtgaaacgccatctctactaaaaatacaaacaattagctgggcctggtggcagttgcctgtggtcccagctacttgggaggctgaggtgggaggattgcttgagcccaggaggcggaggttacagtgagctgagattgcaccactgcacttcagtcagcccaggtgacagagtgagaccttgtttcaaaaaaaaaaaaaaaaaaaagacactttgagactgggcgaagtggctcgtgcctgtaatcccagcagttcaggaagcagaggcaggagtactgcttgaggccaggagttcaaaaccagcctgagcaacacagcaagacccctgtctccacaaaaaatatattaaaattagctgggtgtggtggtggatgcctgtagtcccagctacttagaggctgaggcaggaggattgcctgagcctgagaggttgaggctgcagtaagctatgatcatgccactgtattccagtctgggtgataaagcaagaccttgtctcaaaaaaaaaaaaaagagcactttgaattctcataatcataatcatatgacatctgtctaccttagaaaccctcgctggtgggtggtcacacataatgctggtggtctgcggggggcagatggactctcacaccctcctaggttcccctttaggaactgaggcttcaggtatgggaagggtttgtggaataaatggatgaaaatggaatgagaagctttgcccacgtcagagccaacctatcatgtggaccaggattcagaccacccctgggagaggaaccaggatgcacccatcattctttttttttttttttttgagacggagtgtcacactgtcacccaggctggagtgcagtggtgtgatctcggctcgccgcaacctccgcctcccaggttcaaatgattctcctgcctcagcctcccgagtagctgggattacaggcgtgcaccaccatgcctggctaattttgtatttttagtagagacagggtttctccatgttggtcaggctggtctcgaactcccgacctcaggtgattcacctgcctcagcctcccagagtgctgggattacaggcgtgagccaccgcacctagccgacacccatcattcttacacagtgaagacccagggagatgatgagtcacaccgggaagtgattcatttgcttactgttaagttcatccaggattcctttaaataccaaatccccatatacgcttaaaaatacctagttcactcagaaacagtgtgctgactgacggaagccagacatgaaagactatgtggtgcaattccatgtataggacgtttctagaaagggcctaatgacagagatggaaagcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttggtaaggagagacagctgcaggggactcctggtggaggaacaggatcccgggggagcggccgggcgggtgactgaggcgccaatggaaggagaagcctgtcacaggtgagggcattgaagggaactgcagggacacccagcgcttctcaactctgactgcagatttccagctgccatttctaaaggacaggtgcctgggctccactcctggaggtttggatttaatcagtctcgggtatagatcccggacgttagtatttttaagcatatttttaaatgaagtgatactctaattctatcattttctttttacttctcagcttgttgcttctctaaagagatacctccctttatccattttgtggtcacccagtgggacagttgagagagaaaaggccgggtggcatgtgattcttctacttcatttaccagttttgaagatgatgaatttgtttcccatgaccttccaaaggtggttttttaaaatttattttaatctatcgtcgtgaactcctggggcgtgaacgtgtgtcataggtttcaaaccactgcaatcattatcctcattgaggttcattgtggctggtggtagtgtcttcatattggcctctgagaccttctgacctgattctagttatctttgataatttccttgtctttaaaaaattataattgtatatattttttaataataaagatgggtttcggctgggcgcggtggctcacgcctgtaatcccagcactttgggatgcagaggtgggcagttcacgaggtcaggagattgagaccatcctggccaacatggtgaaaccccatctctactaaaaatacaaaattaactgggcatggtggcgggcgcctgtagtcccagctactcaggaggctgaggcaggggaatcgcttgaacccaggaggcggaggttacagtgagcagagatcgcgccactgcactccagcctggcgacagtgagactccgtctcaaaaaataataataatagtaataataataataaagacagattttgccatgttgcccaggcttgtctcgaactcctgggctcaagccatctgcccacctctgcctcccaaaatgctgggattacagtgtgagccaccatggcccagcctaacttccttgccttttaagagtaaagcagttttatttcccattgctcttccactagctttaagtatgtgttaatttattattttaggttgtcctagaggttatgatctgcagactcattagatgctagtgatgctggtcttctttaaattggtactttaaccgcttcctggacaaggcagggactttgcatacagatatatcagtatggtgtggaagacagctacactcaccattataccacctgcacagatatcagtatgttttgaaagttgcctggagaccttggtggcaatccagggctgaaaactctgggtggggcactaggtgggtggcaggtgcactggggactgaatgggatgctgtggcagagaggaccagacctaaagcctttagtgaagaaggcctggtgtgaattttttagctggttatcaggttcatattttaaagaatatttttctaattacgtttgtttgtttggtctggcctgatgtgggacgtggtattttcagtgtataggtcttcctagagttgggaaggagggatgcccttctgttggagatgtttctgttaactcaggtgctttaggaatggaaaggaaagtcatgcagctcaggcccggcaggggcattgttgaagatcctcagccagtgaggcgccttccctgtgcccagcacattgctgaggaccttgcctgaaagatgtcctttcatcctccccacccacctgaaagatgagaagtggaggactgatgagaaccttccagatgggttctccaagccacacagctaacaggtgccagagtcggaatttgaactcagctgtgacttacttctgttaccagcagaagtgggtgagaaagccggccacagtccactaaacacgggctatgaccaaggtctctttgacaacataatccaacaaataggcttgttttagaatataaatctcaaggaatttggggggagttgatatactcttgttttttactttttattttgaaatatttttagattcacaggaggttgcaaagaaatattcaagaagatcctgaacactcttcacttagccccgcttcaatgttaacattatgcataacgatagtacaatagtcaaaccaggaaactgacagtgatgtagtcaacagaaactagtcagactccagtagttataatgtatgtatgtgtgtgtgtatgtgtgtgattctgtccaattgcatgtgcaacttcatgtaaccaccaccacaatcaagatatttaattgtatcatcagcaaaggactgcctcatgctaccccattgtagccacatgcacagtccctcttccatcattcctaacctatggcaaccactggaggacatttggagtttccagtttggggctgttatgaacccagatctgctatatgaacattcacttacaagtttctatgtgaaaacaagtttttattcctctatgatcaattatctacaattgctggattgcatggtaaattcatttttacttttaaaggagttgccaaactattttccagagtggctgtaccattttatattcccattagcaatgtatggatgattcagtttctccacatccttgccagcatttggtgttatcactgttttttattttagctattctcataggtgtgtagtgatatctagttgtggtttagattgcatttttctgatgcctaataatgttggggatcttttcatatgattatttgccatctgtgtatcttcacgggtgaaatatctgttcatcacttttgctcattttttttttttttttgagacgaagtcttgctcttgtcttccaggctgtagtgcagtggcacgaacttggctcactgcaacctccgcctcctagattcaagtgattctcctgcctcagcctcccgagtagctgggattacaggcgcctgccaccacgcctggctaatttttgtatttttagtagagatggggtttcaccatgttggccaggctggtcttgaactcctgacctcaggtgatcagcccacctcggcctccgaaagtgctgggattacaggcatgagccaccgcacctggcccacttttgctcattttctaattagattttttttttaattgttgagttttaagggctgtttatatattctagatacaagtcctttgttaggtacgtgatttgcaaataatttctcccagagtataatttttttttctgttatcttaacttgacccttgacagaatgaaagtttttaattttgaggaggtcaaagttttatcaaattttttccttttatggatattgtgtttggtgtatgtctaggaactctttgcctaatcattaaggtcccaaagctctttcctttgattttttttttctacatgtcttatagttttatatttaagtccttgattcattttgcgttagtttttgtataaggtatgaaatttatgtcaaatttcttttttctttttttgcctatagatgtgcaaatactccagcgccattaattgaaaaggctgtccctccttcatggaattacttttgctccttgtgacaaatcagttgggcatatttgtagggatcatttttcctgggctctctactccattccatttgatctctgtgtctctccctttgcctatatcacactgtcttgattactatatctctgtaggaagccttaatatcaggcagggtgatttccccaattttattctcctttttcaaagttatttggctattctcaggcttttctctttctaataaattttagaataagtttgtttgcatctacaaaataccttacaaagtttgacaggacttttgttaagcctgtcagtcaatttaggcagaatcgaccttttaactatgttgagcgttccagtccatgagtatgtctcttcagtatttaggtctttgatttccttccttgtcattttgtaatttttattttatatagatcctgtacatattttgttagatatattcataagtatcttcttgttatctttagagcaactttaaatggtgttgcatttaacagtcttgatttccacttctttgttattagtgtatagacatgcaatcagtttttgaatgttgatcttgtaccctgaaaccttactgaactatatgttttcctctcagcactgtctgagctgcatcctaccaacttggtatgtcgtgttgtcattttagtgcagttctatatagtttaaaatttcccttgagatttcccctttgacctatggattagttagaagtgtgttggttaatttccaagtatttggagattttcctgtagtttttttgtcattgatttctagttggagtccattttggtcaacatattctgcatgattttaatttttttgaatttattaaggcttttttttgtgacccaggatatggtctatctgagtgtatgttccatggacaattgaaaagaatgtgtattctgcagtttttgggttgaattttctataaatgtcaatttgatctttttgttggatggtgttgcacacttctgtatctttgctgatcttctgtccagtagttgtgtcagttgctcagagtgggtactgacatccccaaatattattgtgaatttgtcgatttttctcttggcaagatttgtttttgctgtatgtgttttgtggtctggggggtacgcatttagaatttctgtatgttcttggtaggctgggcattttattattatgtaatattattccttgtctttatttagtttctttactctgaagtctgcctggatattaatatagccacttttgctttctcatgattagtgttggcatgacatgtcttttcccatcctttactttcagtctacccatgttgttatgtttgaaatgagtttcttgtaggtagcttgtaggttattttttaaatccattctgccaatgtctgttatttgatgtagttagaccatttatatttaaaatgattattgacttgctagggtttaagtctgcattttatgatttttttccttctctttctcattcctctgtttctttttccttgccttcctatggtgacaaacattttttagagtcccacatttccttatttatactgtgtttgaatgtacggctttggatagtgttctttatgattgctgtaaatattatgtcagcctactggtgtcagagttttaccactttggaccctttaccctcactactttttaaatataattgtcttaagtatttcctccgtatccactgagtaccttatcgtatgacataataacttttgcttcaacttaaagtatgattaaagaacctcatgaggtgaaggacagtctagtcttcttctgttagtctctttttctgtttgaagacatttctttagcccttctttaaaggttggtctgctagtaataaattctttagcttctcttctcctgagaatatcttaatttctccttcatttcttttttttgatagcaaatttattgagtcataattcacataccatgtaactcatacctttaaactgtacaattcagtggtttttagtgtattcacagagttttgaatcataaccacaatctaatgtaataaaattgtaagtctggctttttgcatgtgatagaggggagaaggaaaagcagtctatatcatcttgctctggaactagaagttgatagtcttttcaagtgttttataaatttcaggttcctctctccatccctttatttttatttatttatttattttgagatggagtctcgctctgtcacctaggctggagtgcagtggcacgatcttggcccactgcaagctccgcctcccgggttcacaccattctcctgcctcagcctcccaagtagctgggactacagacacctgccaccacgcccggctaattttttgtatttttagtagagatggggtttcaccgtgttagccaggatggtctcgatctcctaacctcatgatccacccgcctcggcctcccaaagtgctaggattataggtgtgagcctccgcgcccggcccctttctttatttttaaaatgtattttaatttttagttcttaattgtggcaagagatacatacaaatgtatcatcttaagcattgtttaggtgtacaggtcagtgacgttaaggacattgacattgttgtccagctatcaccaccactcatctccagaatgatttcatcttcccaaaatttaacctctgcactcattaagcagtaattgtccattcccctcttttcacaccccctggcaaccaccattctactttctggctgtgaatttgactcttccaggtacctcacgtaagtggaatcctacaatatttttgtgcgtgactgacttctttcccttagcatagtgttctcgcaacgttgtagtaagtgtcagaattcccttgcctgtgaaggctgaataatactccaccgtatgtgtagaccacattttgtttatccattcatccatgatggacacttgggttgtttccacgttttggggactgtgaataatgttgctatgagcatgagtgtgcaaataatctcttggagatagaccctgcttttcattcttttgggtgtatactcagaagtgggattgctgaatgatgtggtaatttatgtttttaattttggggggaactgctatactatctgtccctgtcttttccttacaaacacgtgtggaagactttgaggcatttgacctgtggaacatctcccttcttattttggatgggtgcactcctggtgaagttcagcgtgtccctttgtcctctctctcctgcacattggcagctggatccagtacctttgctggacttggttccgtctctttcgcaggattagaggaagtgctctatgtctgttcacccatctttttgtgagcaggcagctgttgatgctcaatgcccctgttttgggtaaaattgtgtctccccaaaattcatttgttgaagtcttaagctccagcatctcagaacctgcccttatttggagaaatggtctttacagagcttatcaaagcaaaatgaggtcattagggcaggccctaatccagcatgcccagcgtacttccaagaagaggaaatgcggaagcagacacgtgcagagggaggatgggaagatgtggtgactccatataaacataaacacggctgtctcttgcccttcattcttgaacgctttgctggacaggaaatccttgagtgtcttaaataggctactctttttttttctggaggtaatcatggttgtcaaaaagtcttaagggtcagccacagtggctcacccctgtaatgccagcactctcggaagtcaaggcaggaggatcatcggagctcaggagttagagatcagtctgcgcaacatagggagaccctgtctacaaaaaccttacctttcatttctttttctttctttctttctttctttctttctttctttctttctttctttctttcttttttttattttttatttttgagacagtctctctctgccggccaggctggatccagtggcacaatctcggctcactgcaacctccgtctcgcgggctcaagcgattctcctgcctcagcctcacaagtagctgggattacatgcatgcaccaccaagcctggctaatttttgtgtttttagtagagatggggtttcacctataggccaggctggtctcgaactcctgacctcaggtaatctgcccaccttggcctcccaaagtgctgggattacaggtgtgagccactgcaccgggccttaacctttcatttcaaataaaaaggagataacctggaattctgtgtgggctctcagtgtaaagatagaaggacacacagagtgttttgaaacatgcccctccctgatcagcaggtgtcctgctgtgtcacatgtgactgtcagttcccgacccctcggccgagcagaaagggctttggcaaggtgtccggagttggaggtggcctctgggaggtttgctgcccgagggtcctgttgccgccaggactggtgaggagactgaggattgaaggggccaaaagctgacaaaattctgtgcgggggctgagtggcagattcgggtctgaatcatttcctggttcctggaatattcccacttaggtgccgaagccagaattggagggagcgtggcgcctactcatggagcctgccaaggcactgccagctgctcacaggccaggccgggcgggcagagcctcctcgctgcctgctggctttgaaattcatgtttgagacacacattccagccttcactgcttgttcaaggtgatacatgattttcagactggacagcttggcctcttgtctgttcttgtgttttcctttatgtaccaggataatgttaaacccttcccatgatgctgcaaaaaccaaatagtgcagcacacaccccacagcccgaaacaactgcaggtgcgtgtgccagtggttctgaaaggaatacagagacgtgtggtttccgaatccgctgattgttttattatatactgttacagatcatgttattctaaattacaaaataaaacttatgttaatatacatttatacaacgtatatattatacattatatagcatgtagtgatgtatgatgtaatgtatgatatgtactatataataatttataatatattataattattataataaaaatgactggccaggcaccgtggttcatgcttgtcatctcagccctttgggaggccgaggcaggagggttgcttgaggtcaggagtctgagaccagcctggggccacatagtgagaccctgtctttctaaaaaaaaaaaaaaaaatagtaatttgttattattcttcctattactatttttaagggacaattttggaaacatactttactttttctagtgtagcaaagaatttacattttgtcacctgaaagcgtcctggaaaatccatcctagtgtcttgtaattctaacagtcaccaggaaggctactttgagaaaatttcatatggtatgagggaaaacaagaacattctcatttttttttgtcttgctgaattaaaaaaaaaaaataaaagcaacaacaagaaaaaacaaagcccagggctggggttaagtaggtgaaggaggaaagggagtccccacctgccagtctcagtgccgctctttgccatgcacacacccgtatgtgtgcccatgtgtgtgcacacagacaccaccgggtccccttggagttaccaggcaaatgcatgtcatcagctgttgtgccttgatgtctcctaagctacatagaatcccctcagaccacgcctgacacccaggacaccagggcagtaatccgcacgcccatttcactctcaccatgtaaattgcgttttctattttcatttcattttatgtcacttttcttcaacaagtaattattctagggctttataagaacgctgtgctttcttagtctatttataatgagtaagaagttgtttttattctatttcttttctgtctgtgcttgccattttttttaatcacgattggataaggggggatccctgcaagataacagcgcccaccaaattagaatctccctgaaaaacatacagttaatcaggaggaaaatatagttgcccatagtccatgattatagcacaactaggggacaattaatgtagcaaacctctgtttccacccaagaccaggatacagggtttcagggccaggccagagccccgagccatcaggaccgggcacaggagagtgcagcagcggcctggtcccaccctcactcgggagataataagagacatctgaaatgtcactcaggaataaaagagagggtcttggaaagtgcatgggatgggagagtctgctcctgggagatgtttcctggaggtttggtgtgaaagggaagagaagaattagctgaaaataaggaacttagtaaaacaacaaatcatccacaaagaagagctcctctcaggggaggaggaggtggaagaagaggaaaatctctctccttaattaaaaaaactgtactttagagaagtaagagaagagtgcatggctgaaccatgttcctgagcaagccacacagacctctccctccctactgactctactcatcagcttttggggagtctaagtaaattaatataaacccaagcacacctagcgtccatacaatattactgtaagaaaaagaaatagaaaatgtgtagcaaaatgctggacatgaaaacagccaagaagcacaaatgaaatgtaagtaataggcaattgcaaatgtgaaaaaacaccatgagccagctcttcataaaataagactggaaatggataaacaacgggagatatgaaatgagagctaattaaggaaagcaaatgaagaaaagtctaagataatctctgaaattaatagtaaatgataaggttccccaaagggatagtagttacagctgaaagcacagtagggatagaaatgaaagaaatagaaaagatcaaaaccaaagtgtctgttggaaagacatccaatttacctgtaattggtgaccctgaagaactaaaacaaggcaatggaacagaactaaaaatttaaaactgcaagtcaagaaaactttcctaaaataaaattaagacccaaatctacatggaaatatagtccactgccattccgggaatggttgactcaagatttatgctctaggaagactaaattctaaagataaagagaatatcagcagggcctccaggcaaaaggaccaagttatttacaaaggaaatttacagagttgtttacaaagttacaagttatatgcaaagtctggtgtcagacttataacaacaacaaagaaagcaagacagcaatgcacaatacttttaagaaactcaaggaaagaaaacgtgagtgaaggattttatgcccagccaatggttctttaagtgattcagaaacaaaaatattgtgcccaccaggcacacttaaagaatcagctggcattagtgatatgtcagaggctggacggcagaaatggtctgccctggttgcaggcaatgaggagtttcatcatctgtcgataatttaaaaacaataataaaactgactgaaagtccgtctgctttttatgtcactgtgatccaacacttttaaacaatgtcagccaaaaaatactcctcctgaaaaaacctattgttggtctaatttctaagcaatttttcctattacaattgcattttaatgctatgtgtaaacctcaaattagcatatttgcattacttatgctttaataaacattatattctacatggcatttaatttggagaactcccaagtatacgatcagcccctgacatctgcagactgaggcacatgtgtttattttgagaggaagtttgtagcaatccagaatcatgcaaactccattgaggtccggactcctgtgaccctgtgtattcctctgtttggatagcagattaggaataaccagtgatatcacaataggtaaagacaaagaaacagaacttggatttcttcaattctgtcattctatgtgaacactagaggtttttattggtgtgtaaaatttgaagagtaagagcacagatgatgagattggatatttttgtttgattggtgcaacttgtagttgacacatgaaatattttactgaatatgagctgtaccattaggactgaaattcatcttttaaaattgtccatggtttttaaaattacagatccagttaaggaaatagtgattattactggttattatgtgataattactgaaaacactgttgtcacatagaggatgaaggtgttaaaaattagccacattatgtatgccacatagcaggggacaggcttcatccaatgaaaagatgatgtgggaaactttggcgaaggcactgatagtatttttacacttaaacaagtattttaaaatgtttaaaaaaaattgtatatgtatgaccgaaagaaaggtagggataagtatggaggaatggctataaatgttatatattctgacaaaatagaaataatgaataaaaataatagttggagtaggaagagcaaaagaggaacagagaatcagctcattgattgccctgcaggtaggaaagtggtaacattgtttggtatacaagaatgaccactgaaacaaaaatatagaccttaaatacccaaagaaatgcaaaaacaaaacaaaacaacttttaaagaagcaaacaaaccatatagtgaaatacacacggtcaatataacactaaagaatagaactgagaccaaacctagcagccgcatcagtaaattagagtggatttaacccatttattaaaaggcaagactgattttcagattggttcacatagtggcacccaactctatgctgtataaagaagtcatatccaaaacacagtgatccaggaaggctgaaaatgacaggagggtgtatagcaatgaagagagaaaaagagcttgggagttttaatcctgactgcagccaagctagtatcaggccaaaagcattaatggaaacaaagagggccgctgtcaatgctaaaggctgcaatttgcagagaagatacactaggtgtggttatgtctgcttcacataacatcaccagaacctctacgatgcggaaaccacaggggcggtggggagacatgagggacacgcagttccaggacattgtgactgccttgctcagcctgagacatgtgaaggggaccaaaacatacgcctccaaatgtaccagactttgtgctgtgataatagggaatacaactttgtttcgagactacttggaacacttaggaaagttgacatatattagcttacaaagacaacctcaatgagttccgtaacagaaataatacaaacaacattctgtgctcacaatgcaataaaactaaaaattaatcataagattaaaaaccaaaaaggcccttcaatttgaagagttacaagattaaactctattaaataagtttttaggtgaaaggaaatacacaaaccaagtgcataatttttgaatttgacgataattaaaatatatcactctgtggaatacacataaagctgtggttataacctcagaaatgaaaccaaacgaattaatggatttatcatctaactaaaaatgatagataaaaatagccaaataaacttagagtagaatgacaaaaaataagagtaagattggaaattcatgagttttaggaatgagaaaaaaatgaaactgataaatacacaaaatactacatcctagaaaaagaatcaagtggacaaacctctgtctaagctaatcatgaaggggagagagagagaccccaaacaacacagaataagaaatgacattaacagaacagagcatatttaaaaaaatcattaaaagcttactttgtatagtgctttgcaagtaagtgtgaagacctggatagaaagggaacttctttaggaaaatataatttattcagattgaccccagtagacacagaaagttttaaaaaaaaattcctactggaaaaaaattcaaatctatattttcacaggagaattctatcaaatcttcaaagaacagatatctcaatgctacttaaattattctagaacatagaaaaagaaaccttaagattattcaatgagaaaaccacacaccaatctcacttaggaatattgatgtaaaatgcctaagtaaaacagtattagagagaaccctttaaaaatggttttgagacaactggatagccatttggaaaaagataaaattttgtcgatatctttcatcatctacaagcatacatttcaaatgtctctaaataggtagttaccagaaaaactaccacaagaaaacatgggtaaattttaaaataacctgtgggtagggaaaattatgattcaaaatccaaaagcaatgtaaaaaagattgagaaatttggttgcattaggaaaaaaacaaaacaaaactgctttcgcatgatgggggagggacaccataagcaaagtgaaaaagccaggtaataaaccagtagaaaatatttgcatcttatatcacaaagctaattccttcaaaatatagattataacaagataccatttctcatgggccatattggcagagaggaaaaaactcaaaacaaaacaatacaagtttgatggcgccctctattggcgaggctgtggagcagccattcagattgctccacccctggaggaaacaggatgccttgggacttggtgcacctgcatagaccctgactcagccatgcctccttcctgaatttacctggaagacaatactccaaatccaaacatgctcatggcatatggagatcttaaattaataggtcctcttttatgtctttcaataaagtaacagatatgtttctatagaggtcttccatttttacattaaattgattcccaggtatgaaattttggctactgtcccagtggcagccctctggaaatgacctttgttgagtttgtgttttgacctggtatccagcaaccttgcttaacagtctgaagagcagcttggggcttttctctatggacagtatgtctcctgcatgtaatgacagttggctttcattcatccattgcaatcttcatcctttaatttctttttgttttcttacttctgtggttgggagtgacagaacagtgttaagcagaagcagttatactgcaaattcttgtcttattccttcttgtagggccatctctaatggtccaccatgaggtgtggagtttgctgtggacttgtggtagatcctcactttgttaaggaagtctccttctggtcctaatttgctaggagttttttctccctttaattgtgaatgcatgttgaactttatgaaatggtttttgggcatcaattgagatgatctgttaatgtgatgaattatgtgattgcgacaatagcttttctaatattacaccaagttgacatgcctgggataaacctgtatttcatcatgatatgtctcttaaaaattgctgggttcacttggctaatactttatttaggatgttttttcacctgtttataaatgagtttggcctataatttacctttcttattctgcctttcattggttttagtgtggagattatattagacccataacattcagcatctcatccttttctcttttggagagcaattaatataagactgaggtgatatgttcctcaatggtattgttaaaacttacctgtgacaccttctggttccagtgcattactagtggccagatttcaagtgactaattaaatttccttaacatttaaagtctattcacaatgaggaaataaaccttacctcatcagttggcttccttcaacactaccatttttcttctttcttgtgagtatgtgagccttagttcaggctgctataacaaaaatatcatagattagtttagagaacacacattcattcctcacagttctgaaggctgggaagtctaacgtcaaggggctggtgattcctggtgagggccctctgcttggtttgcagatggctgccttcttcctgtgctctcacatcggggagagagagagcatctctctcgtgacttttcttctcattcccattcatgagggcctaatttcttcccaaaggccccacattataatagcatcacattaaggattaggcttcaacctctgaatttgggaggagcacattcagcccttagcagaaccccacccccaagattttcctaagtgaatgaatagtcatcccccagccttgttcctggcctctaacagcattttagaaggaggtttctcatgactggggttggctgagatgggaatttcctgattccattggctgtgattcagccccatgccatcctgccagtaagatgaacacatgagtcatgctcagctgctagggtgcctggtgctgcttccagttcctctgggtgacctctgtccagcacataaacctcctgaagcattccgaatttgcggaaagtgagccaccctcccaatgtgtacatgtctgggcctaccttcctgctctcgtatgtgacaggcacacagcctttccagaaggtacctcattgcctagtacagaaatgctgaggttctcacaggagtgagaaccctactgactggctgttgtgtctctcccatacagtcgggtgtggagcagttggacccacatacctatctgcgcccatcctcagttgaaaggtagtgaacagcttgggctgtggactcaggcaggcctcggttcaaatcccagctctgccactcaggggctgtgtgtgcagataggctgcatctattgtccaaagccaaacatggggaaaaccaaacaatctctcaaaggggtgtggtgagggcttaggcaaaagactggtgtaccgtggctcggatggattagtttccattctccctctctctgtttccagctttcctctcactacaagatgagggccctgtccctcttgggcgtttgccaaaggaaggtctggacacccagcagctcattcatgtcgcttcccagtttgctgttaccatgttgcagtgcagaagccataagccgcatgatccgtgagcctggccctgcaacttggctcctccacacagcagcgtttgccttcattgtcacagatgactatgagaagatgcccttggtcatctttggtctgggctctggagttctgtagagctttgagccgccagagctaagggggtgaggcttgccccaggccggtggcacacccaggactgggcctggatgactttaatggtaggacagaaggaagagaaaggagctccccagagtccagctgctgggctgtgcagcccatttgcagtgtacttccaggagccttgatggtgaatgctgtaaaagggggaatctttcttccccacctttctttaaatcatagagctattgtgatggcttctgagctgcaatagaatcacccatgaggatttttgtttgttgtcttggcatgaagttcctgtcccttcacagtaatccggcaggtgcctcccagggcatggagtcattgtgtcacattcttctccaggactgcaggagggtgggcacagagttccacaacttgaaatgcagcagacagttgaaaggattctgctcacaccaggagttggattgtatttttccaaatgcattaagtattttaagcagcttgagctgcttaatgggcctgaaagcatttgattagtccaaagggctctatgcccggcaggtcaggggacaagaagttcttaaaatcctatgggtctgaccccttctgctctctctggctatctggctacaacgggtccccagggttgcagcaatagctgtgacctgcttatcttcccagaagtgctggaggcaagctgatccctgagcactgtgcctggagcactgcaggtgccctgcagccatctccatccacaccccctgcctggcctgccccgattccaggctgggcctcgggctcccctcccttcttcgtccccctcctcatctatctgtggctctttctctcgggccctaccaccaagccctctccttgccattctcttctgtccctcaagccgtattcctcagcatcacatggtcctcccgggtcccggtccactcctgtcatgtgagaacaaatggtgtctgctggaatttgcttcgggcctctgttgtgttttgagccaatgtgtgtggtcctcctaacgtcatttgattcatccggcaaaaggctctgctgcctgcctgtctggggcagagcttctaagaccctgtcagttttggacaatgaggcttccctgggggtgcagagtggtgaagctgtttggaatccttctcttgaggtggagtccagagtttcttcctgtcagttcctccccatttgtgtcagcagggtgctatgtccagcgcaggtcctcccctggcccctttctggccttgcagagtgcccccggccccgtgtgagcagatggccttctgggcggagcgtgcagtctcttggcagggcagccaagttgggggtgagatggacctagggctctctgaccccgtaggtttggcctaggctgagactctgagcaggtcacttacctctgggtcctcatgctcaggttcaaaatgagacagacagtggagttaagagatgatttttctgatccttctttgggtctttgcatcagttattttaaaaaaagagaaaagcaagccaacacaaccatcctcggctgattggtggagcagggcttacttatgtggctagttaaaagaaaatttatttttgaaagctgcatggagattttccgtaagcacagtaatgtgagccggggtcaaagctgtctttcagagacagggaagtgcagagatgttcaatgtaaattgtgccttttagctaaacacttggtagattcagcactggccgtgtaggtttgtcctgcttgttttgggggaaccagaaaagatctgattgaatttaatctgatttctgctagagtttggtcatgtaagatttgaaaaagtgaaccttcctgagccagagcaatcaggcaacaaagaaataaaaggcatccaaataagaaaagaagccaaactgtctgtcttcactgatgttatgattctatacatagaaaaccctaaagactttgccaaaaggctcctgtaactgataaacaacttcaataaagtttcaagatacaacatcaatgtagaaaagtcagtagcatttctctacaccaataatgttcaagctgagagccaaatcaggaacacaatcccatttacaatcgccacacacaaaaatacttaggactacagcgaaccaaggaggtgaaagaaatcagagatgacacaaacaaatggaaaaacattctatcctcatggattgaaagaatcaatattgttaaaatgaccatactgcccaaagcaattgacagattcagtgctcttcctatcaaactgccaaggccatttttcacagagctagaaaaaactattccaaaattaatatggaaccaaaacagagccagatagccaaagcaatctgagcaaaaagaaaagccagaggcaccaattaccaaacttcaaactatactacgaggctgcagtaaccaaaacagcatgggactgatacagaagcagacacacagagcagtggaaccgagtagagaacccagaaataaagccacacacctacaaccatctgccctttgacaaagctgccaaaaataagccatggggagaggactccctattcagtaaatggtgctgggatagctggctagccttatgcagaagaatgaaactggatccctaccttttaccatgtaaaaaatcaactcagttggattaaagattcaacctatgagaatcctagaagaaaacctagagaaacatcattctggatattggccttgggaaagaatttatgactaagtcctcaaaagcaattgcaacaaaaacaaaaatcaacaagtggaacctaattaactaaagagcttctgcacagcaaaagagtaaacagacaacctacagaatgggagaaaatacaaactatgcatccaacaaaagtctaatatcacaactctacaaggagcttaaacaattgaacaagcaagaaccaaataacctcgttaaaaattgggcaaaggacatgaacagacacttctcaaaagaaaacaggtaagaagccaacaagcatatgaaaaaatgctcaacatcactaatcatcagaagaatgcaaatcagtaccacagtgagataccatctcacatcagtcagaatggctatttttcaaaagcaaaaaaaataacagttgctggcaaggctctgaggaaaagggaactcttacacactattggtaggaatgtaaattattcagccaccttggaaagcagtttggagatttctcaaaggacttaaaacagaactacatttgacccagcaatcccattcctcagtatatttccaaaagaaaataaatcactctaccaaaaagacacatgcacttgtatgttcatcactgtggtattcacaagggcaaagacacataatcagtctaggtgcccatcagcagtggactagataaagaaattatggtacatatacaccatggaatactatggagccataaaaaagaacaaagtcatgtcctttacagcaacatagatgcagctggaggccattatcctaagcaaattaacacagaaacagaaaaccgaataccacatgttctcacttataagtgggagtcaaacattaggtactcataaagatggcaacagtagacaccaaggactactagagggcagagggtgacagcggggcaagggttgaaaactaactgttgggtactgtgcttgttacctggatgacgggattaatcataccccaaagcttagcatcacacaatatacccaggtaacaaacctgcacgtggactccctgaatgtaaaataaaggttgaaattagtcaaaaaataaggaaaagtgggccttccccgccccccacacttataaagagttaaggattttgtgtttattttaagccatgttgaactcagcccaacatattgacacaaggcaggacttagtgcagtgtcactaggctttaattttgttgccctttgggctaataaagtcaggttatctcactgggctgtttccttatccattaagacatttgatgtaactaagtacccatcctatggtgacataaactttttcttatgtcattggaaagtccagaatacctggttgcaggcaaggtttgatctagcagcttgaccttgttagcacaggtccagtttctttccctcagtcctccctggtattttatcagcttcatcctaaggctggttcagggaagatattctgatgatatatatttctgctttggcaatggaggatttatattcgattgtcagaagtcctcatgtcctatttaaagtctagtcattggaaaataggttgataaggatggacctgaagaaaataaagcagcaatttgtcatgacaaagcaagactaggaagaggcattggaccagcatgaccaattcaaggacacgttgatgatgtcttcagcgcaagtgttcttcccaagcttgggggacctggcagggctgcctacagggctggtgtccagcctgctctatagaaggcgaattagagatcgcaataacgggccagcttccatgatgaccccaggttgtagtgatgtctatgtagaaatgaaataaatgcataattaaaaccaaaggtaggcttgcatttgggttgaggtcctggcacctacggaggccacaagtgtgtcagggtggaaggtaacttggtgaaataggaagtcactgcctattgcccactcatgtccccactgatggagttagctgggggatcccctggtgcagaccctggagaggcatcactgtcttccttgttcagtgggcttgggtcacctgcatgaattctgaggttgggaaggtgtaaacatttccctcaacacctgcagcccagccgccgtctccctgggtgcttcagtcagccgtcacgttggggaggcgtcatgtaaggtggtccttgtctgagtagaacctgattttgaaaatgaaattcatttccttgccttcattttccagacgaaaagatatgtatttgtggtgtgtgtgtggcgggagagtaattggctttggttttgacaaggaggacaccagagtcctgttctgatactcagttttgggcccatgcgtgacaattctgtgtttcttttcagcatttgccaatacattattttctagagtctctcccagcatacggaaaaaccccaaattcaaatttgacttttctcttcgaggctggttgtggcatgctgaagctcccaaggcatgtaatgtagtgaacaaggtggcctccaggagcgctgtcggctcatgggccccacccacccacctcgcggtgtaggaggatccaccaagtcactgtcagagtgggttggagagacctggcctggggtcagctctgtgggcagatgggccctttcccccactgggtggagtacgctccttagtagcccaagacagaacattgccttctcccgagaaacccacctctggggaaggttaggccatgggatctgcgggaagggttttaggagtagattaatgggatttgtgatcccaagcacccaggccactctgtggtccccacccctgggcttgagtcctgctgaggtataagtggtgctagaagacctctgccctgccctgccctgccctgccccaggaacctggctttctctgggctaatgagtgtcctctctgaaggtatccagaggccgtgcagacactcacactttggtgtgaggcgtgccctcggttgatcagttacactgctgtggggtgcacaggtggcaaggtgggggattctgggatcggggaggctagtctgggtgtagggtcctgccctggaggggctcacagtggggttgaaagcaagctctcgaggcgttattattcgggactctgagtgccgggccatgctgggggagtgagggcagggggagctgcggaggcagggctctgagggctttagaacaagagccggtgtgtgtttcccactgagtacctgccggcacctcatttatgccacgtagcaaccccatgacataggcttataggggactataattatccccatttcacagctgggagaacctaggcttagtgtcacagaacctaggcttagccactgggtggctgatactgccacccagttctgagccagtatcagcttccagccccctgactcagtctctctgctgtggtttcctctcaagtgccaggatccttcctggtcccgtttccaactcagaccagtggaggggcgcgctgtggttaccactcattagaagagaggcagggtctctctgtctctctctgggtgtcccccactgccatctctgggtgctgggggagctgctgtatatctctctctgtctatccctatctctccctccactgccatctctgggggttgggagagctgctctgtctctctatctctctccccccccaccccactgccatctctggagtttgggggagctgctcgctctctctcccccctcccactgccatctctggaggttgggggagctgctctatctctctctctctctctctctctccccccactgccatctctgggggttggggggagctgctctctctctctctctctctctctccctctctccccctccgccaaccactgccgtctctggaggttgggggagctgcctgggatgcagagcggcttggattggtgctccctctgcctcagtggttgagctgacctctgtccagtctgtacacattggatcctgaggctgagcttgggtggctgtggcaggaaggtttggtgacatcacacccttcaggcttgtgtctgtctgagccaggctctgactggctgggagaagaggaggaggtggggttctgggaggccctgaggctgagcacggctgctgtgctctgtggctgcactgcaggggcacgggctcagcatgttctgggccagggcacacaatgctttcagatcaggctccagcaccccacacgccccttcatgctttgcactttttgtctaccagccagagggcagtgaataatgagaacaaacaacatcgggtccagattttcgtggtcattttcctaacaagccgaggtcagagagcactgaaaggaggcctaagtgcttctgccacctcagctgactgtttttcaaaaaggaaagcatgcgtgggatgtgtgtattaggtgttacggtgatgtctgttgtcagatcatggccagaaaaggggttgtttcaattaaaatggattttggacttcgtttttcttggaatgagtaaattgagggaaatagcacatgttgagattttggatttctgctcttagaaaggatttaaaataagtggtcttcagtagttccacagcggatcttcgagactggtacagatggggtctcctggatgtaacgagttcttgctgctttaactggatccggttgactctgtctgaccagctcagctggttcgttctatgaaacgcacttctgctttctggaatctgaaggaaggagagagatagaagacaaagaaggacagatgtgttggtggccagaccctggcttctgaacagtccttcctgatggcttcaggacctgggaggagcggcggagcaggtggctgccctgggcttgccagacacctccattccagcaagatcctcctgggggatgtggtgccctccctgcctctcaggcacaagcatatgcttgtttggcctaaaaaagtctccttaattaaaattaatatcgtaatgcagtaaatccttctgcctcctcttcccctgcccagttacaattcccggcggctctccagcccatagaggaggcttctcaaagtttcctgcctcctggaggagagaagccattccccgatcacccaaaaggacaaagtatgtgcccactctgcgtccttgcttgtcactgcccaacatctgcaaacattaactaaagtgctgagcccattcaggtgtaggactcactagttggttaatgtgacagacagcgtttcctgtgccagcgctggctggtcacttcctgtcatccagcactcttgagtgttgcagtggatgcctgtttcgtaggaacactcagcctgttccgtaagaaggagcgccacttctcagcctgtacttagcaggtcactactgttggccactctgcttttctttttaaaattttaattattaaaaaaattttttttgagagtttccctctgttgtccaagctgaagtgcagtggtatgatcttggctcactgtcacctctgcctccctagtagctgggattacaggtgtgtgccaccacgcctggctaatttttgtatttttagtagagacggggtttcaccatgttggccaggctggtcttgaactcctgacctcaggtgatctgcctgccttggcctcccagagtgttcggattacaggcatgagctactgctcctggtccccttcttatttttatgttagtctttggaaacaattggcatatattttagtctgtttaggttactgtaacaaaataccataaactaggtggtttacaaacaacagacatttatttctcacagttctggatgtgggaagtctaagatcaaggcgccaacagatttgctgtctggtgagggcttcctggttcatagaaggccatcttctcactacatcctcacttggtggaaggctcaggagagttctctggagtctcttttacaaaggcacaaatcccattaatcacctcccaaaggcccactgtctaatagcatcactttgggcattaggttttaacatgtgaatttggagaagggcaggcacaaacattcagtctgtagcagcatacaaaaatgtaacaagaataatgtgatgaacagctaggtatccacaagctgctaaaggtagagaatactaccatattggttacctatttctgtgtaacatattatgccaacacttagtggtataaaacagtaaacatttattatctcacacatagtctgtgggccaggaatatggaagcagctgagctgggtggttctagtggaggggaaagatgtgagctggggcacctgaaggcttgactggggcaggaggatccacgtccaagatcgacttcacctggctgttggctggcaagagggctcagttctttgccatatagacctttccacagagctgcttgagtgtcctcacaacatggcaggcggattcccccagcctcagtgattcaagagagagtatagagagagtagagaggaagccgctgtgccttttatgacctggtctcattagtcatacactgtcatttctgcttatgtctgttcactagaagcaagtcactaaattcaggccacactcaaagagaaaggaattaggttccactctttgaagggagtgtcaaagaatatgtggagagagatatatatatatatatatatatattcttttttttttttttttgagatggagtctcaccactctgtcacccaggctggagtgcagtgatgtgatctcagctcaccgcaacctccgcctgccaggttcaagtgattcttctgcctcagcctcccaagtagctggaatttacaggcacacaccaccacacctggctaatttgggtatttttaataaggcagggtttcactatgttggccaggctggtctcgaattcctgacctcaagtggtctgcccgcctcagcctcccaaagtgctgggattacaggcatgagccaccatgcccagcctgtggatgtattttaaagcatcataacaccattgcagctagagcccctccccagttgcatcttgtctttcacacagaggtaactactgttgaagtttgatccttgtttatggcctagtacatgtataagtatttctatccctgttagttctgcattttgtctgtaagcgttatgtaaatgatatcaccttgtatttttttctgtagtgtgcctttttttttttttgagatggagtcttgctctgttgcccaggctggagtgcagtggcgtgatctcggctcacggcaagctccacctcctgggttcaagcgattctcctacctcagcttcccgagtagctgggattacaggcgcccgccactgcacacagctaatttttgtatttttggtagagacgaggtttcgccatgttggccaggctggtctcgaactcctggcctcaagtgatccgcctaccttggcctcccaaaatgctaggattgcaggcctgagccaccgcgcccatccagtgtgccttttttgcttaacattatgtttgtgagattcatccatgtgaaaacaggtggctgtatttcatgcattttcactgctgtgtggtattgcattgtacaaacataagactatttgtcgttctccattgatggatgcttagttgggttcctgtgacttgctgctacaaacaaggttgtcttgagtactcaggtatgtgtctctctgtgaacgtgagctggatttgtcagtatatttagcaaggattggaattgctatgggagagagtacagtaatcttcaaacgtactagaaacagctaaattttattccaaagtgtgtgggtgtcctcatgagtggtcccactgacagcgtatgagtttcctcttctcctttttcttgacagcacttggtgttgtcagacattttacatttttgtctaatgcgtgaaagtgctgtctacatgaggtattaatttgcatttccctgcgtgccagtgaggctaacatctttccatgtatctattttcacatatatattttttcatatatttggtattctgtgaatgactggccatatcttttgcacctttttttctgttttcttattgatcaatctgatccgttgttgagtttatgtaccataaatatcttttttcttttcttccttctaacataatgtagaagctaagagtgtggattctggggccacattgccagggttaaatcccagcttcaacacttcctgtgtggccttaggcttagtctgtgtatgcctcagtgtcctcatctgcaaaatgggatgatggctccccacggtgggcctgggaggatgcgcaggttcgtatctgtgaatcagttagtgcctgtcatagtaagcacaagatagactaatgcaacctagtgtgctgggccctgtgtggccacacggggctgtatgcacaggcgtcaccatggccagagctggagctcagatgtgtctgagaagattggcagatgctgcttcactctggctcccggtctcctgggtggccctgcttccatccctgagctgcctgaacggaaaacgaaatcccatccccgctccagggggtgcctgggaattggaaggcatcaggctcctcacagcaaaaatagaagcctcatttgcttaggagagaacaatgacgaggaggcaagccagcagaggcggccttggcgggctgtgtacaccctctgcttgtctccgcactccctggggtcagacgtagacgtggctaagctgcctgcagaccttctcttccccttcatcctggcctgcagtgggcatcagggtccatcctgggacgtgggctgtcttggcaccaagttccagttcttaatacctcagtgtcacactgttccctgatttctcaaagccaggaaggaattgcagaaaacaaggtcagtttagtatcgagaatcactggagagccgtgtcagagccctgctgagaagggcgcggggaactgtgttcctgtctacctgatgctgtgggctgcacaaggacggacttactgaagattacaggccagggggaagagggcacgtttagtgtcaaccctacacagaagaagttagctccgctgggcgcggtgggcactttgggaggctgaggcgggtggatcacctgaggtcaggagttcaagaccagcctggccaacgtggcgaaactgcgtctttactaaaaatacaaaaattaacctgttgtggtggcatatgcctgtaatcccagctactcgggaggctgaggcgggagaattgcttgaacccggggtgggagaggttgcagtgagctgcactccagcctgggcaacggaaactccgtcttaaaaaaaaaaaaaaaaaagaacaagtcagctcagccccactgcaaggagctcctgggtttatttaagtgagcctcagataactttacataaaagcaaatgtgtaaaaagcgataaagtcagatatattgaacatttgtcctgagggcaaatttctgagctctaaaagccagtttggttttagataacatctgtgagtctggaaacaggctgagatactctatatctgcactcccaactctgcctttggctttgtgagccctgtggtctccttgaaagaattggtccccagtgggtgaactaatcacccatgaagagtctcccaattcaaatctggaataaaaagtgaggacatgggggcagaatgttactcatcacatgtggcccgtcagtactagacttcaaggtaagtttccaagaacagagctctgtgaccattttcatgatagcaatttgtacattattactaagtaattttaatgccgtgtttacaggccaccttcccaaacaaaacaattgtttctggaagttagactcttgaagacttaacttttaatccagtttgttctcaaaacatttgcacaaatgagagtcttgaggtttgagctttctattctaaaggctcagcttcttgcccaggagaaaaataatacatgctcgtgtttataaataagagttatggcattggagtcctttacattgcagccagcctagggactcagttattcagaatttaaacattttacttgtaaagagcactttggtatccaccccaagggccctcctctgcctgtctcagcaccatctctgtgtgtcccatcaggaagcaacagacaactccctaagccccacagtaaaaacgtctctcctggtctgggggcgcatccatcccccatgtccccagtcccatcctgggtgttctgggattccagccacagctgtggggacaccgccatctcactgcatccctcttgctcttgcggcagcttggctgagctacagggccgggccgcaggaggcgtccttgtgccggagctcaccttgtgccggagctcaccttgtgccaggtgttgagctctgccagctgcccggccccactgtgaggccgccccttgcaggtgagttcactggcagcccagccagcccacgaaggccatgtgagtgtgaacccccattacaagctttccctcatgagatggcgctgatcagtctgggggatacctgcctttcagtatgggctgcagccattaggctggtaccaggaggagccaggtcgagctggcactggggcgacgctctgtctttgatgcaccctgatgcctcccccatcctgctgaccatggtgctcagcacagaccccttccaacccatcccagggcctctgctcagtgtggccagagcctcctgtcaacaagtatgtcactgccttcgggttattattgttcaccagattccacttgctctacaacccaggcacagtgcaccagagtttcccaaacctgtgtgccgagtgccagccccttagcaagtgcagcgttgcccatttcactctgggaaatgcagccatagctctggggccagctagaggaaggagtgtgattgtgccttcccgggacagcttccaggtctgggagtctgtgatgttgtgagtgttgccttagctttgctaagaaaatgcttagggagatgggttccttcacccattcttccactcatgtgcctttctggctccagggctggtgtcccctgctttggaggggacgctcacatgagctgccctattggggttccgtcaagtttctcttagcctaagcggcttcctgtctcgggctccctccccagccatttgggtcaccttgggtccctgaggatcgcttctggatcttggaccccctcaccaactcctgtgacataataatcaaaggtaatcaggaaatgtatgaatcgtcttctttaaggaatatttagcatttctgctcattccagagtccctggaagcatggcatttcaaaggcttggttagatcacaagtccaatttactgccagaaatttgcacgtagaataatacagagcctatgatggcagttgaagtggtatcctgtgagaaaattaattagtcctgaaactaaatgccgacagcctcagcaaaatattcatgagagaagcaaacctcgtgcgtggtgtttgaagtcaggcagctgaggctgtgtactggacgtgttctctgtggctgagttctgctgtggattctgggctagtctaggcaaggcctgcctctccttctggactggctcccagggctgggggctcaggaaggccctgcaccctggagaagaagggagcccctgagactctttggccttgtatttgtgtgtccctctgggctgcagggctgcagaataaaccagctcccaatcctccaaacaaaaataaagacctgtgaatggctacacttggagagcagagtgttttgatatcatggggagacctgtgtacttaatttacggcctgaagattgagaaggatttaattgttccaaaaatggtgagaaaagagcaggtcccagcctttctgtctgatcacaaacagccgagggggactggggaagtggcctggtcctcactgcccctggaggggcaggaagaggatggagtgatgtgcttggcagatgcaggaatggccaggcagtgggaaaagcctagggtttccaagccatgtctgatcctctgtgttccttctgcctgctgggatggagcccgccccccaaatatgcctggctcacttacgactcagagtcagctgcccccagggacttcccggctctcgtgaccttgctgggcatgactttcaggggagccctctgtccaggagacataggtcactcgaatcacacagccgtgctttagtgaatgctagccaggggccctggagagggcaaggacaggacactcctgcatggaaacgaaaatgaatatttttctctgcagaaaatgaaaagtggtgctgggtccaagtggtaggtgacctggcttttgagcgaaaatgctgctgggaaatgagagaaaagaaacatgaaaagaatgcaaatgagggtggtggacaggggcccagaggcctgattcctccaccctccgcaaaggctgggtgtgtgatgcctataaatagacactcaaaacccgttctaaatggagtgaagacatgggcctgcttcctcttatggaaaggccttacataaggtgcagtgctgctattgctcctgggcggtgtgatgattctgtgcctttgtcggaagtcagtgtgaagcctgtggggcttctgggggatgcacatggatgagctctgggctttctggagactcgcagactctgggaaggaggcggtgggcgatgggcaggtctcctagggctgggaaacagtcctgagacaggctccgggtttcctgaggcgcttctgggccaggagcaagtgggaaaagctggactgcagggcttggtcaagtgacagctgcccagagccggagtttagggtgcctggagaggacaggggctggcaggcctgactttctcactgatccacttggggtcacagagccaacctgtaacagagtgaggaactgaggccgcattgctggactcccagtggaggattcttgctgctggactaacctttagttcatgaactcacccagaaattacttatttttggaggaccgcagatggcgagcttaggagtgaagaagggaatactatttgatgctaatgtgattccaggcaacattctagaggttcccttgcaattcaccttcccagccacctttgaagtagttattggccagttttatacacgatgaaactgacagagatggtgtgaagggattttctgacgttcacacaggaagcaagcagcccatgctgactccactgcggaaagcgtgtgtgtgattgacatgctttttgtgtggtgctcactttgggtgtgataaagaggcctccttgcaaagggccaggatctgtgaagcaccatgttgcttcacagaacaggccgtgaaaagccacagaagcaccatagcctgggaaagaaatggaacaacggtgcaaacagccagtttcccctgagcagaggcaagcaggttacggctctgcagctcccttaacgggtagcttgttcaacatggaaacatctttagcctcctcagagacgttgggtcatctcctttacatggggaccagaagtatcttccctgggccattttgggtggaggaaatttcgtaattataaccctctgctaggggtgtctacctaggaagtgagagcaactggccgctttcttagagaagtgaagacgctgagtagactaaacctttgtgatgaagtcgaagccactgtgttgcctgtgtcctgtttccttccccagtgaatggggctcttccctacgactgcagaccccaggaccagattgcaggtgccctgtccagcagcgcagccattcgtgaagggctcgcagcctggcccggctcaacagctgatgcccccgggaggaggctgtattactatcctttttgaaaggaacacagaaagccctttgtaactttgtctgtagccaacatggagggagaggcagaattcagatgtgatgttgcagacaattgaacacccctcctcctgttccaccccagcttcctgcccgtagccttctaatgcccttgccctgaattcctgatccaacccaagggcctggccttgaaacccccgagcctgctggcagtagcttcctcttcagccttcctgtgcagagcttcctctattcagggaagtctgagacctggtggcctctttctcattcttttcatgaaaccatcttgcccaggagaaggtgggctgagaccctgggcattggaaaggagaggtggtcctccttcctctcttcactttcatcgcagtcctctccccgcccacccccatatgcacaccctccgcagtctgaaagtgtcgtgaagcaccagctctgcaaacccgtggggtcaagctttgttgtgggaaaatacatattcatgagggctttgaggagcctcattaaaatgcagagagtctctcctttcagaatggtacataagccatctctttatttgcccaacacattgttcttaaggcaataattatgcgatgaatggctaaagaaacattttaattatttgtttagggtaatttctgattatctcattagaattataatctgtccacttttacaggtgattcaaagcctcatatttacatttttatacttgaaggagctctatgtgcgcacctgtatcattgctgaagtgaaagtaattttctctgttttcttctgctttattccagaaagatttgatcaccaggagatttttcgggacattaccaaaccactcattttaggtaagaaatacaaggcagcgttgcatggaatgaggttttgcttttgccatgtggggagcggaccgtttcactggagggaaaatgctacattgcaggcagagctggcaactgccgtggctctttgttttctgggatcctgtgtgtgtgagcttggggagtttgaagctggggtttgagtcacagccaaggagtggatggacactggggacgcttctggcacttaccttgcccggaaccgacctgcccaccacccaatgacaacacagcaagacacgcactccccatctgtcctctcctcattatactggtgtttctgtaaaccatggtcctcaccagactcagtcattgatttgtgtaacccctacctaggttcctagttacagcgaaagtagacacatgtatatcggcaataataggtagcactcgaacctttcactctccagtgtgggcagtggctggtctactttgagaagggaccagccattgtgagataccaggaagctgagcagaagaaatctaactttgataaaaagaggcctcctcatcttgccagggatggagcgtggtccatcctccctccctgtgcatggagcagtattgcagccctgaagacactgccccatggtcagcatctggcttgcccttgccctgtaggactggtaggaacagagccctggtgccagccgagtgttccacacaggggagacttgcaagggacaggttctgcactgcagatgaattggctgtcttcttctgtggctggagacacacaaggcagcggctttgtagggaaactggtgtacagggtggggcgtgtttggagaacgaggagcagagggcattgttgctggagttaaagaagcagagccagggatggtcttcatgtcctgatgcccagagcaggcctgagcttctgatggattctgggggttcttatgtattcttgggaaggagcatgtggtaagcttggacagggaggcagttcagagtgttacatgcaaggcagcggtggccttgggaacaccccccctgcctgaccaaggcaaggaacactttgtgtgtcccagtgtggaatctctgtgccagttgtgaggggacggatgaagaccagcaggggtgaggacgggattctggagtgtcaagactcaggttcagaatcacagtttttcttccagggcagcacaaggccacaagtgtggctatttgaagccacccaaaaagccattatttgtaaagcaaggcagctttattgatttcactttctgccctgcatctttcccacattgtggtaaccactcaccatccctgttctgctgatgaggcaggaattcccttgcatccagttggggagcattcttgtcacaaatgtcctggatgaattacacggtggctctccgtggagggagcacattcacaaggcatttaagagatgcaggacaatcagccctcgtccatgaaacagggtgaaacgtagaagagctgcgtgattattaatgggtttggacataagctggagtgtttactgaaatttttctcagttgtcagttttcaaagtttgtgaatgtacttttgtgctctcaacaggccttttctgctctatttaactttctacttagggttgtaaacatacttcagccgtaatgacattagatacatcatccactctcagctctgaaaatgctggagattttgattatcaccagcagtaaggacagcttatgaagggagatgttacttatggagacacagctcatgattccataaaattccagtcttctgggagcccagggttaagcagctgcctcagcccatccaccctctagggactgtccacggtgaaattggcttcttgacgttttccttatggaacctggggtgtcattacattctgttagagtcatagggtggttctatttatgcctgtaaggtataaggtatttttttcttctgagtctagaaaagacctactggaatttttatgtatcctgaaatactattagacgatcaaaatcaattgcaatagagaaggtgctgggctctcttcccaattgctctcacccatctgcagtgtaataggcctatcatgtaagtgaatatactcatcacaattctctgcagcttcccagcagaaaagcatattccttctcagagagaaaggcggcaaggagatggatatttttaaatgccaattatgccagaatgagtctctgtgaggagatctgtaaagagaagaaagggccggggtttatttatttttctgctgcgaatggaatcattctgtagcttcagaatactaatccctgtgatgtgcctgatgtcttttcataggataatttgtgaatgtgcttccacttacaggaaaagtttgaggctcttttcttattcttctttttcttttttttttttttttgagaattaaattctaggcctcactatatcctatgataaccgtcctataggccctcgatctataaaatgtgtgcataatgaaatatataaaatcagcgattatcctgaaggaacacagaaaagattaataagctgtatttaaatcacggcaagtctcagaacatatattaagttagaagacatcacgtcctgaaaatgacgggctgatgtgatactagcatgtacccccgtatggatgcatataaatgctgtgtaaaacctagcccaaagtgttctttaaaacctaagatccaaagaaaggcatggaaattccaagctatgagacatgaagagaaaacacaaagccagagcactaagggaggaggccatgagacccccaagcagtgaggttcctgatggagagccaggatgatgaagactgtgtgacatttgtgcagggagagacacggcaatggctgggacagggtagcaaggctaggagcaagtgctcatatgtataggaagccaggaggtggcagacgtgtgttatggaccaggtgggatgtgatgcaggacagctggttggccacataggaaaagagaaaagataaagtgagatccctacctcacagcacatgtaccagtaaacggccatagaattaaaggcctatgccgggcacggtggttcacacctgtaatcccagcattttgggaggccgaggtgggcagatcacctgaggtcgggagttcgagacgagcctggccaacatggcaaaaccccatctctactaaaaatataaaaaattagctgggtgtggtggcggacatctataatcccagctactcgggaggctgaggcaggagaattgcttgaacctggggggcggaggttgcagtgagcgagatcatgccactgcactccagcctgggtgacagaatgagactccatctcaaaaaaaaagaaaaaaaaaaaggccaaaatgtaaagacaaaaatgttaaaatacatagaagattttttctatctgctcttgaggtgggaaacatacacacatcataaaagaaaagatggattaatcaaacatcagtattagcaacttctttaagagaactacaggctggaataaatattcatgatgaatttactgtgagagatttgtattctgtttgtatcaagaactctttcaaattaattttaaaaagacaatagaattgaaaaatgagcaaatactatgaagaagaaaaaatgaaaatgtcaaatagacaaatgaactctgccttgctcctaatctgggaactgcctgggagaccatgagatgttggcaaattagaaagtctgataatcgaagggttgcccagagtgtgaagcaagggggccttcatgtcctgtttatcaagggcaagttagtaaacccctttagagaacaattaggtgttatctagtaaggttgaaatgtggatcccccatgacccagcaattctgctcatgaaagggattcagtgttgtattagtcagttctctcaaaaacagaaccaataggatcagtttatcttagagtttatgtatcgatcaatcgattgattggtcaattgatataaggtattggcttgcatgatatggcatctgggaagtctcacaatctgccatctgcaagctggagacccagggaagccagtattgtagtgcaaaggcctggaaagcagagaactggtgcagattccagtccaggccgaaaggcctgagaaccagcagcatggagggcagagaagaccaatgtcccagtcaagcagtcaggcagagagtgaattcaaccctcctctgctgttttgttctatgcaggtcctcactggagtggacgatgcccacctacactgaggagggccgtctgctttactcagtctgccaattccaatggtaaccgcttccagaaacacctcacagactatccagaaacagtgtttaaccagacgcatgggcaccttgtggcccagtcaggttgatacataaaattaaccatcacaagtgggtcacaaccagcgttttctaaaaatatgaaccagattagaacagaagatatcagagtttgttctgcatagtgaatgatagtgatcctgagaagggggactttgaggggatgggactgacagcgatggttaagcctgaatggaggtttgctacattgttttctatacttctatgtatttgcaaagttgaggagaaaagaagttgtggtaaacccctggatgtaggcacacggaccccagtgttctgtgctgtgggtccctctgatgcagccgtcttgctcccgtcttgctggttcatcctccaccttggctgactacctggcctcacccttgtacaggtgcttctgtttgtctcttcattgaaatgggtgggatttattgatttatttagagacagggtcttgctctattgcccaggctggagtgcagtggtctgatcatggcgcactgcaaccctgacctccagggctcaatcaaccctccctccttggcctcctgagtagcagggactacaggcatgtgccaccacacccagcttatttttatgtattgtttttatagaggtgggattttgccatgttgaccaggctggtcttgaactccttggcccctagaatgctaggattacaagtgtaagccatcattccctgtgtgaaatgagtaggatttctgaatgagccaggctttgcacattgacctggctctgcctcttgaactgctgccttcacatgggaggctccttctggccctgcctgtgtggctgattcctctctcaggtgcttctctttatcttcacagacgaggctcatgggcttcactttttgggaccttaggtggacatctgagtccacagccctcctgcctggcttctgtctctgtggatttgcaggcctgcttgtcccatatcctccagtgcccagcccagtgcctcatgtacagtggatgctcaagaagtgtgtagtcatcacatagctctagtttcttatttttatttttatttatttattttttttgagacagggtctcactctgtcacccaggctggagtgcagtggcatgatcataactcactgcagccttgaactgggctcaagcaatcttcccacctcagccccctgagtagctaggactacaggtgagtgccaccatgcccagctaattttaaaatcttttgtagagagggcatttcaccatattgttcagactggtctcgaactcctggcctcaagtggtcctcccacgtgggcctcccgcagtgctgggattacaggcatgagccactgcctctagactttagaaatgttcagaagctcaccttcccatctgcaaagtggagactcatgagttgggggcgggtagattgtgagaatgaaccacataatgaagaggggatgtgtagcacatgtgagttttcccatcttgctggtttccttccctggaagaggcaaagagaggacaaggagctggctgttactatttgcttgcagacttggtgtgtgctttcaaattggaagctcctgctctgacacccagttcttttttgttttaagttgtactttagaagagaaaaaaattcatcaacacccttttttttaaaagatggaaaatgggttaagaaagtagcacgaggaactgtgagcccaacataattagtgtgatgaaagagaagttagccatttctgtatgtaacttttgattaatgatattcagctctaattaattatgtccaattctaattaatgacattagtgtgcaagctggcattctcaaactatattctgaggattcccagcggatgttcttgaatataatagtccccggtcacattaggttgggaagtgctgtgtgtactgcccgtcttggacactcccaaagcaccatataaaaggccttcagaagtcctgcaagaaaaggaacaatttaaatttcttttaacctgtcatttcccagacttacttttaccatgtgtgctgctaggcacatacggacatgctaatttaactctcataccacaaggtgtgcttggatgaattgatgagcaatgtacatgtcatggagacgttttctaagtcttccagagtcatagcaggggtctcctgtatcgcagcagagcatactgcaaagaattgcatttccatacagtctagggctgctgtgaactaatctcctttcttgggcaaatcgcttaatctccttcaatcagttcatacatctgcagaggaaagggtgatggcatgccaccctggatggtgggaggactcctagcagtggtggctgttaccatctcataagaaaccctcattacaagaaagtccacgtcatttgccatgtgctggtctcggggggtcagcgagtggggggctgcagggagagaccaccagttacctcctgagcctcacgtgtggggtacactgtgttttgtccgttgttggatttgtattcattgttcatctaaaagtgattatgttgaaaaacagaatggtggcagacaggcatgtttggcatgggttaatgcgaggctggaaagagagcccctgaccttcagttcgagaatcagccactgcaggaaagggtggcgtcttggtggccgcatactgtgaatgtcaagggagacgaagagtgcaccctggggagggcggactcatcagtccagtgggttgtccaggagggagtgagggttgatctttcatctcgaaggatgaatatacatttctgcgagagagggggaagacgggcgttccaggcaaacaagcgtgtatatataactgaagcgtggacagaggaagcagcgtggctggtctgggaatggaattgtttgatctggcttgatggaggagctagggggtgaggtagaagaggtggcagaggccagcttgacctgtgtagatggcttgggagaagccctggcaggtctttgttggagggctgacaggaagggatatgtgctttccatagttgaccttggagggtgcggcatggggtggaggcccgtgcaccagaggctcctcatagagtctctacagagagatgaccaggctagcgttttcatggcatgaaggttgtcttcagaaactcgcttcacaatctacttaagatgagtcaaatctaccctccaaagaacatctgctgctactggagatagcgcttcaaaagctaatgcaggtgctgaatgtttttccaccatgagggttccttctgtgcatcaattagtctagactcttgctgtttgaggaaagaggctcagagtagttaagccactagctccaggtctcatagctggctgataggacatcaacctgcggagtctctatggaggtggaatagtttcagtggtgcactgaaacagtaggggatggataggagaaaggcttggtctattagtcaggttgagccagagaagcagtaagggatggatatgaggagatacattgtgaggaatctgcacacgtggttttgggacctggccaggcaagcctgaagcccgcagggcaggccatggggaagggcaggctggaactcccaggcatggctgcagctgcagtccacaggcagaatttcttcttcctgaaggaagccttggctctacttttaaggtctcctgacaaattgatccagacccagacagattgtctgggatgatctcctttctaaaagtcaactcattatggactttaatgacatggacagaagactttcacagcaacgtctggaagagtggctgattgcctagccaagtcagtacctcaaaaagaccacactcttgataacacgtgggggctccaggaccaaaagctggtgctgcagatgtgtggggtggcagcattgtcacttcctgtctcccactaacctcagggtcacagtgggctggtggctgtagcatgctccacacctgctctcagggatgctggagggagactgaggcccaggcttttgtcttagagacttgggatatgtctaggatcccttctaaaagccaagttctagatagaatctggcctttcagggttggagagaccccatgtggcttctgagcagacttccttcctgatctcagtcttggaagtgaaggtcttacccctggttgcccccttcctgtgacagagggctctttgcctctttgcactccatgccccagagacaatcagtgctggggacaattttgtcagaaatctattcccagccctagcttagcctagtggcactctcagtcctgaaagctagaggccatttccacattggtgtagcaccgtggttctcagactgtgtttgctatcaggatcacctggggaacttggtaaaaatacaaatgcaggtcatattctgcttcctccatcctgggcctctgtgttctttattagccttcttggtggttctgacctacatcaaagttgaggaccactggcataacgcacggctgctcgaactccagtgtgcgccggaatctcctggggatctcatttattttatttttattttttgagacggagaatcactcttgttgcccaggctggagtgcagtggcacgatctctgctcaccgtaccctccgcctcctgggttcaagcaattctcctgcctcagcctcccgagtagctgggattataggcacatgccaccacgcctgactaatttttgtatttttagtagagatggcgtttctccatgttggccaggctggtctcaaactcctgatctcaggtgatccacccgccttgggctctcaaagtgctggggttacaggcgtgagccatcacgcccggccagggaccttgtttaaatgcagattctgattccatggtttttggtggatcctgcgattttgtgtttctaacaaccccccaggtggtgcagttgcttctggtcctcaggccacatcttaaatagcaaaggcgtagataggggccgaaattaagcacttaagaattacccagacttgcatcggaattctgcctctaccacttaactgtctctgtgttaccctgagcagactgcttgatctctctaagccttgatttccttatctggacaatgggaataatgtgcctttttttttgtttttttgaggtagcacctctgtctgttgcctagcgtggagtgcagtgctgcaatctcagctcactgcagcctcaacctcctgggctcaagcggtcctcccaccttggtctcccgagtagctgggacctcaggcacacaccaccacacccagctaatttttaaatttttaattagagacagggtctcattgtgttgcccagactggtcttaaactcctgagctcgggcagtcctccctccttggcctccgaaagtgctgggattacaggcgtgagtcactgctcttgctgctttttaaataaaaactgctggccgggtgcagtggctcacgccagcaaattccagtgctttgggaggccaaggcaggtggatcacttgaggtcaggagttcaagaccatcctggccaacatggtgcaaccccatctctactaaaaatacaaaaattgcctgtcgtggtggcagacccctgtaatcccagctactcaggaggctgaggcaggagaatcacttaaacccaggaggcagaggttgcagtgagccgagatcatgccactgcactccaacctgggcaacagagcgagactctgtctcaaaataaataaataaataaataaataaatattgctttgacagttagaaaagaaagagtttaataccgcaacataataaagaccatacaggcaaagccaccagccaacagcatacccagtggtgaaaaattgcaaaggcttttcctcttaagatcagaaacaagacaaggatgccccctttcaccacttctatttaacatagtactagaaattctagccagaacaatttggcaagaaaaagaaatcagaggcatccaaattggaaaggaagaggtgaaattttctctcttttcacatgtcatggtcttatgcaatatgtagaaggccttaaagacttcacacgaaacacacaaagctgttataactaatacatgaattcagtaaagttgcaggatccaaaatcaacacacaaatatcagttgcatttctatacactaacagtgagcaatctggaaggggagttaagaaaaaaattccattaaccaaggaagcaaaaaaattgtacacagaaaactaccgaacattgctgagagaaattaaagaagacaccagtaaatggaaagacatggaatgtttttagattagaagacaatattgttaagatgtcaatactacctatattagtccattctcatgctgctaatacagacatactcgagactgggtaatttacaaaggaaagaggtttaatggactcacagttccacatggctggggaggcctgacaatcatggttgaagatgaaggaagagcaaagtcatgttttacatggcagcaggcaagagagcttgtgcaggggaactctcatttataaaaccatcagatctcatgagatttattcactaccacaagaacagtgtgggggaaccacccccatgatacagttatcgctacctggccccacccttgacgtgaggattattgcagttgagggcaagatttggcgtgggacatagccaaactatgtcatatccaaagcaatctacagattcattgcaatccctatcaaaatcccaatgatgctttttgtagaaataggaaaattcgtcctaaaattcttgtgcaatctcaagggaccctgaatagtaatagcaatcttaaaaagaaggacaaagttggcgatctcacacttcctaatttcaaaactagctacaaagctgtagtcatcaaaacaatgtagtagttgcataaagacagacatacagacgaaaggaattgagtagacagcccccaagtaaaccctgacatatatgggcaaatgattttttgacaaggatttcaaggtcattcagtggggaaaggatagtttcttcaaatggtgttggaaaaactgaaaacaatataaaaacaacacaagagaatacaaaaatcaactcaaaatagatcaaagacctgaacataagagctgagaccataaaactcagaagaaaacaggtgcacaacttcatgacattggatttggtagtgacttcttggatgtgacaccaaaggcacaggcagcaacaggaaaagataggtaagttggacttcatctaatataaaaacttcctcaaaggacacagtcagcagtgaaaaggcaacccaaggaatggacggaaatctttgtaattcatacatctgataaagggttaatagccagaatgtgtgaagaattcttagaatttaacataaaaagaagccacctgattaacaaacgaacaaagggcttgaataaacatttctccacagaagatagacacatggccagtaaacacagaaaaacatgctcagcatcacaaatcgttagagaattgcaagtcgaaatcacaagataccacctcatatctattaggccggctattacaaaacaaaacaaaacagaaaataagtgtctgtgaggatgtggcagaattggaacccttgtgcactttaggtgggaatgtaaatggtgcagcccgtcggaaaacagtatgacagttcctcaaaaaattgaaaatagaattgccgtggaatctaggcgtggtttcacttctgggcatatgcccaagggaagtaaaagcaggggctcaaggaaatatctgtacattcatgttcatgcagcatgattcacaatagtcaaggggtggaagcaacccaggagtccattggcagatgaatggatcaacaaaatgtggtgtatacatagaatggaatattattttgccttgaaaaggaaggaaattctgacacatgctataacatggatgaaccttgaaccttgaggtcattatgctaaatgaaggaagccagatagaatagcacagatcctgtgtggttccactgacatgaggtactcagaatagtcaaattcatggagacagaaagtagaatggtggttgccaggggctagaaggagagggaagggggttagtgtttaattaggacagaggttcagttttacaaagtgaaaagagttctggagatggatggtcatgatggtagcacagcagtgtgaatgtacttagtgtcactaagctgtattcttaaaaaggcttccaatggtaaatttatgttacgtgtattttaccacaatttttttttcttacaacggaaaggactcaacaccatatctagtaaaacacacactgaatgttgttattgaaagcatagatggcaggatcacttgagtccaggagttcgagaccagcctgggcaacactgggagactcccatctctacatagaattaaaataacagattagctaggtgtcctagctactcaggaggctgaagtgggagggtcctttgagcctggaagttcgaggctgcagtgagctgtgatcatatcactgcattccagcctaggtaacagagcgagatcccatctcagaacaacaacaaaaaacaaataaaaaaataaaagcacagagccagtcacagggacactccatacatatgaattctacccacagtcattcgtgcccctgagtgtctgccttcccaccattctctgggagttggtttccattccctcacctctcctgttctctctgacaaaggtaattgaaactatgtttctgttctttcagtatggccaggtgggaagctgttctctagtgtgagttaaccaggacagagggtgtgtatgtgcaggggagagaagccggcaggctcttcctcccagatgctggactatggaatgtgatactaacatggggatcctccccaagagccttggatcccctagtgcaccaaagtatcctactgagaaggcatcagaaaatctgactcacagaagttagggcagtgtttacagtaccatgacagcaggcagagcttggggttcaaagcagaatctgaggaaagactctaaaaagacgagcccctgcccaagatatggtgccttttctagtctcatagcacattgcaccccctcccctcactgtaacaatccacaccctcagaacgcgcacctggagttgttcatggagactaaagtgggaggaagctttggacagtcacctttttgaagtctgttttgaattgaacagtgtgcaaatgataagccacttattttaaaataagcttcttaattcaagtgtaatataaacagaaaagtacaaaaatcctaagtgtttattaccatgaatattttcaaagtgaacacatccatgaaactaccatccagactaggaaacaaaacatcaccacaacccaagaatctcccctagggtcctctcccagccataacccacccccgaccactaccaccaccacctaaaggtaatcagaatcctagcaccaaatgttatttttgcaaatgtttgaatttttttttaaataaatgaatttctacaatatatactgttttatgtcagcttattttatgcaacattatgtttgtgagagtcactcacaggtggtgtgacagtagttcattgactcactgttacagagcattgtaaaaatacaaataattcatccattctatgtttgatggacatttgcatcttttctagttttgggtcatgattgctgctgggaacactgttacacatttgttgtacacatgattgcatttctattgagggtacatccaggattggaatgggtaggtcacagggtctgggtatgtttctattttagtgaacactgccagtcctttttctgacgtgattgtacccaattacactcccacctgcaaataggagtttcatttgctccacatccttgctcataactggtggtgttagtcattttaatttgatttttagtggatgcatggtgggatcctctggtatgattttcagttcactgaagactgttgaatatctctttcgaatacttgtcttgtgcttttcgaaaccttctcttgaagtttttgtgcaagtttttgctcatttttctgttgcattttctttcttagtgctttgtaggagttctttttttgttttatgagatggagtctcgctctgtcgcccaggcttgagtgcagtggtgcgatctcagctcactgtaagcttcgcctcgtgggttcacgcccttctcctgcctcagcctcccaagtaggtaggactacaggcgcccgccaccagcccggctaattttttgtattttttagtagagacggggtttcaccgtgttagccaggatagtctcgatctcctgacctcgtgatccgcccaactcggcctcccaaagtgctgggattacaggtgcgagccaccacacccggccgggagttctttatatagttagtacctgagacctttgctagatgtacatattacaaatattttctcacactttctcacgttcagtggtatcttttgatgagaaggcccagattatcaatcttttcctttaaggttaatgctttttgtgccctgtttaggaaatctatgcatacctaagaacatgaaaacaacagcatatttattttttccagccattcttgttttctaatatatgattttagggttataaatagcctattaagcctgctttagctgtaatccactatttttaaaaattgtagtaaaaaaacacagcataaaatttaccatcttaaccatttttaagtgtacagttcggtagtgttaagtaaattcataatgttgtgaagcagatctctagaactttttcatcttgcgaatctgaacatctatacccattaaacagcaacttctcattctccttgccccagcctctgggagccaccattctactttccgactactctaggtacctcaagtggaatcctacagtttctgtctttttgtgactggcttattttgcttagtacagtgtcctcaaggttcatctgtgctgggttgtgtgataagattttctccctttttaaggctgaataatattatgtggtatgaatagaccacattttgtttatccatcatccatcgatagacattgggttgcttttattccttggccatgatgaatagtgctgctgtgaacatggctggctgtccagcaccatttttggatacgttgtatttttattattaattagttcaaaatctgttcactttttaaaatttctcctttgaaatgtgggttattttaaagtagttgatttccaaatgcctccatattttctggttatatttttgttatttatttctagcttgcttaccccgtagtcaggaacagattatttacaatgttaacattttgaaatttgtttacactggctttagacttgtccaccatatgattaattttgacagactatcccatgtgcccttgtgtgtagttcctcagttcagtactttcgatatattcatgaggaaaaatgggtaattgtggtgttcaaatcttatatttccattcttatttttacttctttgttatatcatttactgaaagaagtgtgttaaattatccagctgctcataatgtctgtgtctaatagacataaatttcataatgtctaatactttagatttgtcttattatagtcctgtcaattctccctttataaattttgagtgcatttaactagatacatataaatttagaatttattcctagtaggttgccctttttaattatgaattctttcttttccataagaatgctgcttttcgtaaaatctagtttgtctaattaccaatataggtatataaactttcttttttaacttactgctttagaatagttttagattcacagagatgttgcgaagatagtagagagttcccatacatcctgtacctacttttccctgttgttaacatctcacattagtatggtacatttgttacaattaatgaaccagtgccaatgcattattattaactgaagtccatacttcattcacattttcttagtttttatcaaatgtccttttgctgttccaggattctattaggagactgctttgagttcagttattatgtcgctttaggttcttttagactgtgacagttcctctgactttccttgtttctgatgaccttgacaattttgaagagtagtggtcaggtattctatagaatatctttaaatttgagtgtgcttggcatttttctcatggttcaataggggctatgggctttggggcagaagatcccatctgaaaaagtgccattcttatcctatcaaatcagggctacataatttatcactgctgatgttaccctcaatcgtctgagtgttatgcaccatctccatgagggaacagtatctacacaaattatttgcaattctgcacagggagattggtctgttctcactcatttattttctcattcatttatttatatttgtatggactcatggatattcattgtatactttgggctataaaccagtattgcattattaattttgttgttcagatagttccagcttttgccctttcctaagatagtggactcacccctctgtgtttcaactctaccaatttggaccctcaagttcttgttgccttattagccataaattgcaatttcttatttccccagtcctctgagactactgaaagttctgcttaggcctattgcctcttaaccactactttcttcctgtgtgtgtttttaaccttttggcttccatcactcacaaatccccaaatgccttgacgagaaaagcagcacagaatgctgagcttatttctgggtaattatctacttgtcatgatctcagcccctcaagtcctagctgccttggactctctgatgcttccacagagatcatttaaaaaaatttcgtcaagagtttctagttgttcttggtgagaggattagtctgacacaagctagtgcatcatagcaggcggtggaattcttcagacataatatttttttttacttcttctactatgtcatagttgatggtgcctcatggtattttaatatctgatgctttgcacccatacagcaactatcctgagtaacgaagatgttatgtcatataggaaaatgagtcattcttttttttttttttttttttttttgagacagagtcttgctctttcgcccaggccggactgcagtggcatgatctcggcttgctgcgagctccgcctcacgggttcacgccattctcctgcctcagcctcccaagtagctgggactacaggcgcccgccaccgcgcctggccaattttttgtattttttaagtagagacggggtttcaccgtgttagccaagatggtcttgatgtcctgacctcgtgatccacccacctcggcctcccaaagtgctgggattacaggcgtgagccaccgcccccggccgaaaatgagtcattctttgcatttcattcatttatgcccttagtcacaagggctttagcaaagaattggcttccaccctctctttaaggtaaggaaataaataatgaccttggaagacagtattcatcataaaagcgcttgatgaaaggagcaattggagtgaactatgtaaaacaggcttttcagtctaatgggacagtgtaattactggtgcagatttctagttaggccttaaagaaattaagcctccctatatggttaataatggacttgtgtaagaagattgcttcagagatgaagtttgtgattcacattagcatatttggcagtgaaagcgttacctttctcaatcaagcaggatatgtaagatctttgtgtatgcttttgctaaactttactgctgccatccctgaacttgacttgatatttttacatccccttcaagtctgcatcccagttttgtgtcatctacagttctgaagagctgccttgtgctttatcatcatccagggttgaaaagagccagatcattggagaatccccacagactgacagttttccctgaatcgatgcctgcttattgtgctcatgcaggtagctcctattccatctcacttcgctgcatgcagctcacatatttcagatgatccacaagaacattgggaaggacctgccaaaatcctgccttgctaaagtccaggtatactctcttccagatctcccttaactgcctttgcagattctatatcggagaaagaagtgaggctaatttcacaaacttattcttaccgaattcatttatagctctaataattaccacttttcttagatgtgatcccaaaacaatcctttaataaatgcattttagaactgcactgtccatagtggcagctacttgccatttaaatttaatttaaatgaattaaaatgaagcagacaaaaaatgcagtttctctattggactaaccatgtttcaagtgttcaatacctgccatattgggcagtgcagatagaacacttctatcattgcagaaatttctgttgaacagagctgttctaaaaccttgttttagaatcagatctgagctcacccgtctgcagattactcagtcatcatttgactgtttttttttttttttttttaaagagacagggtctcactttgttatccaggctggagtgcagtggtgccatcatagctcactgcagccttggactcctgagctcaagtgatcctcctgcctgtctcctgagtagctgggcctacaggtacatggcaccaggcctggacattatttaagtctttaagaaacatctacatgtgttttttcctgtcacctctctttttctccatttccttcaaaatcaccttgaaggcgactccatttctgtattgcccaaatcagtctacagtgtaggtgttggatgtggactttttttttggtttctaatgaggttgtgttgcagatgagctgaagccacctttgatattctaggatttgtgcctgaagaatagcgctttctgtcttgctgatgtttatatgactgctatgattgtcaagggaaataaggagaaatgaatgggatccacgttgcttggcccagcatacctgtttctgagtgctgttggagctgagaggcatgctcttggagaatcagccatcaagctgtcttttccagagtggatgttgtccagggcagttgcagagtgagcacactgtcaatgagtgcctggggtccttcatttatttctttacagcatctgtagtagaataaaattccagtgttaagagacaaaaaaaatgtgcccagctctcctggggttgacagtctcagttggtaaatcccatcccaagggggcagctcctctcctgtctgtggtttgcctgctgtcccccaggagccacactcaccagtttggtcagctggcagatgataagagggagagaatcttttagaaaacagatcctggagatcattgttagtggagaacttattatcaagtcaggaagaagaaaaatcattgttagttgagtgaatacattttaaaaaatgataaagtgttcgtcaggcacttgggatttcttgctcatatgctaataggatttttgaaaatccactcactgtttggaaacttgcttgctcagtgacaactgcatccaaatagcagatcatgagccaggtttgtggggggacaagagtgaagggagttcggaggaagtcgctctgggccaggaggcagggaccctggccaccagccatgtgacccggggcagatccttgcagtgctgggccttggttttggccactgccccctggccccccacttcccagaattattgtgaggaactgtgcgtgtatgtgcaggaactgggttaacatatctacttatggttggccgggcgcggtggctcacgcttgtaatcccagcactttgggaggccaaggcgggcggatcacaaggtcaagagatcgagaccatcctggccaacatggtgaaaccctgtctctactacaaacacaaaaattagctgggcattgtggcgcatgcctgtgatcccagctacttgggaggctgagacaggagaatcacatgaaccagggagtcgaaggttgcagtgagctgatatggcgccactgcactccagcctggagacagagtgagactcagtctcaaaaaacaaacaaacaagcagacaaacaaacatatctacctctggtcaacacagaaacaaggtaagcttttgttatcccctttgatagacaaagcaacagagcttaatgagcatgcatgtcacaaggaagcacaaattcacgcttattatttttatgggaagacccctcacttcctggtcctgatgttctctgtgggacctttggtgagtcagggaaggcctcacagtatggagacaacagtcccagcctctgacttgcaggagtgtggggactaagtgacactggaagtgtgctgcacacgtgcaggcctggattattaggagggaaggttagaaatcaagagccaggggaaaactgggaatagctggctggcttttcagaagggagtcattattttgtgcaccttgcaactcaggcagtgagcctggcggggaaagagaaatggctgctctttttttctgtccatgtgtcaccccctgtcagtgtgttactgggtgcaggtgtctcctctgatggtgtctgggcttttctttcccctcccttccttctttgcctgcttctcctttgctcctctgtctccgtttctctctccctgcattttgtctctttctattccttctttcttccttttttatcttcagattttaacctgttcctttcatcaaatgatgcttattaaatacatttggtgatttatatttttgtttctaagaaagctgatcaaaataactgtgtaagttcagtccgtgaaaagacaataatgatgacaggcaggcagcgctttggaggaaggagggttgggtcccgggtacccctgattcggtgggtgtttgtgcatagagtggtacctgcctgcttgaggataggaggctttgcagcttgaggtccttgctccctggtgtggggcatctgaagggctgtggtgggaagagggtcagaaccaaggccagatgcacccggagcttgctgcacgcacttctgggaggtttcctcttattttctctattttaatttctccattttctcttttctctctttcctctctttctggaattcccatctatctgatttttgacctattcattctatctttgaagtctctcttttctttcatatttttccatcttcttttctttctttctttttttttttttttttttttgagatggaatctctctctgttgcccactgcaacctccacctcctaggttcaagcaattctcctgcctcagcgtccagagtagctgggattacaggagcccgccactgcgcccggctaatttttgtgtttttagtagagacagcaatttcaccatgttggccaggctggtcttgaactcctgacctcaagtgatccgtccaccctggcctcccaaagtgctgggattacaggcatgcgccaatgtgcccggcaccatcttcttttctttccgttctgttttctgggatagttcaacgactttaaatacccatattgaaatgtttatgcttgctcttactttggctctctgagggctctttctattctttcgtcatttcttattttgtagcactgtatctttgtgtttctgcggcaatatcttcttctatttatttaaaggtattaatttgttattttgtttcttttttgacaattacttctgtttccttcactatcttttttcctttgctgtccttgtacttgcttgcctggattttcttcttcctgtttgagaccttcctcccagatctgtgagccgtggttgttaattcgcattgagaagtgaagcactgaaaattgactggagtgtctgcaacgtggctgcacattagcatcacctggaagcattaaaaactacctctcccgggggacagtctcagggccattggatgaagatctgttagattggggtctgcatattgataggttgataaataaagatattgatagagatcggtaggtagaaatacagattttccctcctcagcaattctaatgtgcaagcagggctgagcgttgtatagtcttgggtgacagtgccgggcctctggagagttggtataattaccgtgcagcgaaaccactctgcgttttactgtgccgggtgcctggaagactttgattgcatccatatgattctttttctgtacctctggcaaattgcagattgggaggaattatatatccctacagagacttcagtgaatgaagtttcagggacctatgagcaagaaggatgaactggcttcccggggaggggccagcagtccttctgccagacaagtcatcagggctgggacaggaagcatgggaagggcagctgtgcagagcaggatccaggaggggccacctggtggcaggtgtggccactgagcagcccctggctagggatggagctggagctgccagggaagctttgaggccaggtaacttggctcttgggctctcatgaagccaactgttcctctcccaagctctgagaaaacagtggagtcctggagtgacaggatatggtagctccataaggaggaggaacctgtagttggaggggcaacaccaggaggccagtgagcgatactctgtacctgagagaggtggccggaacctgggcccccacttgctgccagtgaccttgcacctgccacaccttctcttggagttttggcttctttaactgggacatgaggatcctgaccatctctgccaagcaggagaggaaatgggctgatgtgtgttgtgaggcagtagagactggggcataggaagcaaattgactctcagagtttatggtataaccttctcccacgctgtagggatcaggtttgcccctaaacctgcagactggctaaggccagggctggaaagggaaaaaagtaagcagaggacaggtcatgctgcaggccggcccctcacccctggtgacttgtgctcttggagtgagggcccaggagggggttgcctgcctatgcgtgtctctccctttccccctcctgttctgtggggctgggcctcacacggccattcttcgaaggaggaaggtggccttttgcattccctgttggtgtgttacttattgtcacttatttttgattaaggatattatatttagggagaaattatttgcattttctttgtaaatcatctgaagaattgtgcaacacaggagtgcattcgggaagaaaattcagacatcagagataaagcagagttctcccttggctgcatctacaaccttcctctccctagagaaccactctgtggttagtgtgttttccttcattatcttatataagcatttatgcatgtgtagatgtagatggctgtgttttgtttttatgcacatagaaggtatctgtgcattgttctgctgccggagttgttcagaacatggtattgtggagaaccacatgactgtacacacaggtctatcttagagacctgcctcatttgctttaactgctgcagaggcttccagggaccgtgtgtacagtactagatactgtttaatgaacactttcctactgatgaacatttaggttgtttcctaatgtttgctgtcacaaacagtgatgctggtgggttaatgcttctctaggggagagagcaagaagcagaagtgctggctgtcatctgcattctgcagtttaccagatactgtcaggttcccttcccaaatggctacagagtggtttggtccctgcagtgtcatcagttcccgacattataactttgcagatgtgatagggagaaaatctccattttattttttcatttcctggattatttgtgaagtcaagtatatttgcctgtgtttactggcacatgtattttctctttggtcaatttcccttttgtaatttttgctcagtttcccatggggttattcgtctttttcttattgatatctaggaaggtcacacgttcatgtgagtgtttgggtgtgtgggtatacaagcaaaaaaaggtttaatacatcctggatgctcattctttgatacatttacttcgactattttcttccagtctgttgtcttctgttttaggtgttttttttttttctcatccaggtttaaacattgtttattgttgtagctaaataattcactttatttagggattataagaaaatgtagaaagtaaatttgcattcttttcctttttcttagtattatgaaacttatttcttttttaaaaaaccagtctgttgaggtaagattgccatataaaagctgtacacattttttttttccagtgacttttttaaaaaatatatttaaaaacaaaaccggccgggtgctgtggctcacgcccgtaatcccagcactttgagaggccgagaggggtggatcacctgaggtcaggagtttgagaccagcctgaccaacatggtgaaacccggtctctactaaaaatacaaaaaaaaattagctgggtgtggtggcatgtacctgtaatcccagctactcgggaggctggggcaggagaattgcttgaacccgggaggcagaggttgcaatgagctgagatcatgccattgcactccagcctgggcaacaagagtgagactccatctcaaaaaacaaaagacaaaacgacctcctcccaaataacccccaaacaaacaaaaaaccagattaaataaaatttacagtgaatatacccagcaaacatttgtatgtgcaattcaatactgtgtctgttactgcggcacgaacctcagacaatatataagcgttctggggggtcgggagagtcccaagttttaactctgtggggtctaggaagacaagatggggaagtgagagaatggggaaatccgttttgtttatcttaattctttccatataaatatattcataaagaccaaaaaggaaaggaagcttgggatgttaaggtaataggagaataggagagtgtgggactttcccaattctgactgaccaaaaaatatgaaaggaattaattttatggtgggagaagagatttaaaaaataaaaaaaagaggatgggggccaggcacagtggctcatgcctgtaatcccagcactttgggaagccaaggcgggcggatcacctgaggtcaggagttgagaccagcctggccaacatggtgaaaccccgtctctactaaaaatacaaaaattagctgggcatggtggcgcgcgcctgtagtgccagctactcgggaggctgaggcaggagaatcacttgaacccaggagccacaggttgcagtgagccaagatcatgccactgcactccaaaaagctgtacatatttaatgtacaactttgtgagtttagagcgaagccaacccccatgaaaccattgccacagcgtgtgccgtaaacagatccatcacctgctcacgtttcctcctgcctactttattacgatgatgatgatttgtgatgagaaactcaacagaagatccaccttctcagcagatttttaactgtacaatacagtgttgttagctgtaggcactgtgctttatagtaaatctccagaacttactcagctcggacagctgataccgtgtaccctcggcccagcatctttccacttcccctacccccagctcctggaaacccccattctactctctgcttctatgagttgactttttaagattctgaatataagtgagatcatgcggtatttatctttctgtgcctggcctatttcacttaatgtcctccagtttcatccgtgtggctgtacatggcaggatttccttctttttaaaagccgaataacactccattgtaagtgtataccatgttttctttatctgttcatccctcaaaggacatttagattattcacatatcttgggtattgtgaataatgccgcagtgagcgtgggagtgcagacttctctctgaaataccgatttcagttcctttggatgtatgcccagcagtaggattgctggatcattcggaagttctatttttaattttttgaggaacctccatactattttccataatagtgataccaatttgtattcctatcaacagtgcacaaggattttcttttctgcacattctcaccaacgcttcttatctttcatccttttgatactagccattcttacaggtaatagtgtgttttgcatttccccgattggtcttttccttgatgattttttattgtcttatttaagaagggcttccttatactgagtatctaacattttagagtcacctattttacaataagtctttagtccccttgaaatttatttttgtgaatagcgtaactcagggatatatatatagcttttaaaaaatgagttgcaaagtttataacccattccccccaccagctgatttgacatgttacctttatcatatggtaaatcattatagatgatgagttgttctggactgtcttctgctggtctatttgtatactctcgtggaataaaaaattctatggttttatatccttcattgttcttctagagtgtttctgcaattgtttcctctgccatctgaattttattattctcattggaggttcttttggaattgcactgactttctaagttgatttggaccaaattaaaatacttaaaattgaaatatttactatattaaaatgcagtattatttgtttttatctgggaatgtagtgtatttttttcttgaaagttttgtacacttttgttatgttctttccctatatgctttatagttttgttgctattgtgtatgaaatattttttattattacattttctatttggttgttgctggtgcttaggagagccattgatttatgtgttaaactcatacctggccaccttgctaaacctttttcttagtcctaataattcgtccgttgattctcttggttttctataaagacaggaatattgtctgaaaaaaatgcctccttcttcccctcttccttctcaaactgtacacctcttgagatgtctctttgtgtttgtacttctaggtagggtaaccagccccagactgaaaggtgacagtgatagcagccttcctaatcttgtccctaaatttacaggggatacttttatggcgtcactataaaatgagatgttttgctgcacttggctgataaatatcctttatcaagttaagggagtttgcttcttggtctaccttttaaggtttattttaaatcaggaatgggttgtcgaatttgatggccattatacctttttccttttttttttttttttttttttttttttttttgagacagagtcttgctctgttgcctaggctggagtgtagtggcgcgatcttggctcactgcaacctctgtctccgaggttcaagcgattctcctgcctcagcctcccgagtaactgtgaatacaggcgtccgcccccatgcttgactaatttttgtatttttagtagagatggagttttgccatgttggccaggctggtcttgaactcctgacctcaagtgatccacctgcctcagcctcccaaagtgctgggattataggcatgagccaccacacttggccccattttatacctttttcatggaagtaaacattttctaattcacaataaaagagaaaaaagtataataaacacaacatatccattgccatatttgcttagatttgttgttagcattttattatatttgctacttctttcctttttgtcgattttttttttttttttgagatacagtctcgctctgttgcccaggctggagtacagtggcatgatctcggctcactgcaacctccacctcccaagttcaagcgattcttctgcctcagcctcctgagtagctgggattacaggtgcatgccaccatgcctggctaatttttgtatttttagtagagacggggtttcaccatgttagccaggctggtctcgaactgctgacctcaagtgacccacccacctcagcctcccaaagtgctagaattataggcacaagccactgtgcccggccttttttgctgaagttttaaaagttgtagccatcattatttggccatataagttcagcgtgcactttaaaaataagcacatcttcctacatttccacgagaccattatcatagtaacagcattcacagtaattcattgataacatttaatacccagtctatggtaaacactctccagttgttaccagaatgtcctctacagctggtttctttaccagggcctggtcactgcggagacagcactgtgggccctgatgtctccactccttctctaactggaatgcaccctcttcctttttgttccattacacctctctattgcagagactcacgtggaccagctgtcctgcatcaaatcccatcttcagcgttcgtctgattgctttctgggctagcatttaacttttctctctagctcttgcgcttcttgtaaatgggaatttcagtccaaaggcttgtgtgtttttgctgtgaaacaacagcagaatctcataggacgagaatttttcttcctgtttgtaggcagggtcagcaaaagggcaggtttgttcaggttgcaggtctgctggggtagctctgcctgacatgtttattctgagacccaaactagagggtaggggctgcatggggctcgtgttgcccatggtgagtcagaggaacacaggaggagcggatggaagcaggagatggcctgaggtatagccttggggcttgcaggtggacggttcccattccactgtcgagtatcaatggagtgggcagtgtgcttgtcccatggaggaggaaggggtatttgctgaatgattaaatccaacccaccaaagcatgtttagattcagactaaaagttcttggcaagaatacttcataagcggtggtgtatgcattctattgcagcatgtcacaattcacatgtaatacgtggttgtctcattagcaactgatctgactagttaccatttattaataagatgctgtgctgaacttctgttaacctcaaaaggggaaagcaccaggttcaaggctgaagaagagacccagagccaggaaacaagaattgggattttttttttttttttttttgagatggaatcttgttctgtcgcccaggctggcatgcagtggcgccatcttagctcactgcagtctccgccacctgggttcaagcaattttcctgtctcagcctcctgagcagctgggactacaggcacgtgccaccctgcccagctaatttttttgtaatttttagtagagacaggttttcaccgtgttagccaggatggtctcgattcgatctcttgaccttgtgatccgcctgcctcggcctcccagagtgctgggattacaggcgtgaggcactgcgcctggccaagacttgggattttattaggggcctgcatacaggggagacggatggtggtggattggaccagagaaccgccttatgtacagagatggtccagtgatgggctgggcgtggtggctcacgcctataatcccagcaatttgcgaggccgaggcgggcagatcacctgaggtcaggagttcgaggccaggctggccaccgtggtgaaaccccatctctgcaaaaatacaaaaattagccaggcgtggtggtgggtgcctgtaatcccagctactcgggaggctgaggcaggagaattgcttgaacccgggaggcagaggttgcagtgagccaagatcgtgccactgcactccagcctgggcgacagagcaagactccgactcaaaaaaaaaaaaaaagaaaagaaatggcccagagatggcgggctggataacatatcggccttcctgcagtcttgtggcagtgggctgggcaggaaagctgcaacttcttgccaactttatgcagtttatttagcatttctacttaacaccctcctcttaatgacccctacccagcaaccttcatttaccccaaaactcagggcctcaatgccctgtatggcccgtgttccataggatgttccaggggctcaaatgttcctcatagacaaggaacgaatctctgggttggccacacctgattccccagctcagagcacacactcaggtgcatctgccatacagggtccttctgagggtaggttcaagttatcgctgtcaggtgcatttaccctacagctggtgacagcttgagtcttcttttataaagtttcttatgcttgagactgacaagaaatctgtggctagttctttggcaccatgtatatgaacggccagttaaccctctgttatccattggtgatcctggcctgaatcagttaattcattagttgttgcaaattggtggtttcacaattctctcatactgttttcatttattagctgttattcttctgtaaagaagagattttccttatcacctggagctgttagaccaccctgaaatacagtatcgttagaacaggccgggcatggtggctcacgcctgtaatcccagcactttgggaggctgaggtgagcggatcacgaggtcaggagatcaagaccatcctatctaacaaggtgaaaccccgtctctactgaaaatacagaaaaaaaaaaaattagctgggcatggtgttgggcgcccatactcccagctactcatgaggctgaggcaggagaatggtgtgaagccaggaggcggagcttgcagtgagccgagatcctgccactgcactccagcctgggcgacagagcaagactctgtctcaaaaaaacaagaacaaaaaaaaccaaatccttatttctcttcaattgttaattttcagaataagaagttggcaatagccaattttaatggtatgatacattctcagggtgtgccatcttcccctttatgatataaaccatttttggtcatgacgtgttagtttttaatgctaatagtgaacctatttgttaaagtttgaggtaagatctttgcctctctcatgttggagactagtttgtgcttatcctttcataaaataaattgcttcagctttccatctcttttttgagatgtgacatcatggtaatctattccttgaaaatgtaataaaacgtgtttgtcaattcatctcggtctggcctttattaggttaccttgttattttaaaatatcttctatagctattcagtttttctacttattgagccaattgtggtaatttatattttcttagaaaatcttacatttcattcagttagatttgcaaattcattggcataaagttctgaaaagtattctcataattttataaatttttctgcatctgtaattatgggcttttcagttctaatgtttgtgttttctttctttttcttgatttgtcttatgatatgtattctttttatactgggccaactttcaattaattactgtcttaattttttttagtcttttatcttttttttctttttttttctttttgaggcagtcttgctctgttgcccaggctggagtgcagtggtgtgatctcagctcactgcagcctccgcctcccgggttcccgcattctcctgcctcagcccaccgagtagctgggactacaggcgcctgccaccacgcctggctaattttttgtatttttcgtagagatggggtttcaccgtgttagccaggatggtctcgatctcctgacctcatgatccgcccaccttgaagcctcccaaagtgctgggattacaggcgtgagccaccgtgcccggcctagtcttatatttttctaattccttcattttgattttcacttttatttcttagacttattttatacattaacactcttttcgtttttttttttaatttaatttttaagttttggggtacatgtgcaggatgtgcagcaggtttgttaggccggtaaacgtgtgccatggtggtttgctgcacctatcaacccatcaccgaggtattaagccccacatgcataagctgtttttcctaatgttctccctcccccgatcccacccctgacaggccccagtgtttgttgttcccctccctgtgtccatgttttctcagtgttcagctcccacttataagtgagaacatgtgatgtttggttttctgttcctttgtcagtttgctgaggataatggcttccagttccatccatgtttctgcaaaggatatgatgtcattcctttgtatggctgcatagtattccatggtatgtatatatgtaccacagtttctttatccagtctttcattgatgggcatttgggttgattccatgtctttgctattgtgaatagtgctgcagtgaacataggggtgcatgtatctttgtaacagaatgatttattttcctttgagcctataaaccagtaatgggatcactgggtcaaatggtatttctggttatagatctttgaggagtcaccacactgtcttccacagtggttgaactaacttgcattcccaccaacagtatacaagcattcctatttccccgaaacctcgccagcatttgttgtttcttgactttttaataatcaccatcctgactggcatgaggtggtatctcattgtggttttgatttgcatttctctaatgatcagtgatgttgagctttttttcatatgtttgatggccacataaatctcttcttttgagaagtgtctgttcatgttctttgcctgctttttaatggggttgtttgggttttttttcttgtaaatttaagttccttgtagattcttgatactagacctttgccaggtggctagattgcaaaaattttctcccactctgtgggttgcctgtttgctgtgatgatagtttcttttgctgtgcagaagctctttagtttaattagttcccatttgtcaatttttgcttttgatgcagttgcttttggcgatttcataatgaaatctttgctggtgcctatgtcctgaatggtattgtctagattttcttctagggtttttatagttttgggttttacatttaagtctttaatccatcttgagttaatttttgtatgaggtgtaaggaaggggtccagtttcaattttttgcatatagctagccacttcttccagcaccacttacaaacagggaatcctttccccattgcttgtttttgtcaggtctgttgaagatcagatgacattaacccacttttctaccaaaaaaaaaaaacccctctgtagtaaatgtgtatatttcctaatgagtactaatttggccatatcccctagttgtgatatctaattttttgttcatgtctaaaaatacatcatttacattttgaatgctttctaagcctcagttatttaatgtttaagaatttcccaggcatgtcatattttgttttgtttttgttctttaactatctttgtagcagtctgggtccactcaggagatgggaaccccagggggagcatcatatttaatagaattattaggtatgatgagagagtagctgttaagaggtggaagttctgtgtggtatcgtgggggtggagggagggggacctaagcaggggcagacctgggaaagccccagggaaggaccagcttgttagggaaggtgtggttcagcagtggagagcagggacagccgctggttcaggcagtccagcactggtctagagatgctgttggtcacaataggccaccctctggagtacaggctggggagcagtggcttgaggctgggcctgcggtgtgagttcgggcaccagcacgtccagaggtgccggacatgcagaaggaacgattgctcaacgcaggactctccagaccacgcgggctacatggggtttgtcgagggagtccagaggtggctggccatgtggagctctgggttcgaggcccaacaggtgtggccccaacaaggctgcagggttgcagaagaactaggtgcctctgtggcctgagccgggaactgcgggaaccgttttcctccagcaatgttgctccatcaccctctgcccagaaagcttaatgtgctcactctaaaggagaaacatgaccgggcccggtggctcacgcctgtaatcccagcactttggaaggcagaggcaggcggatcacgaaatcgggggatagagatcatcctggctaacatggtgaaaccccgtctctactaaaaatacttaaaaaaattagccgggcgtgatggcgggtgcctatagtcccagctactcgggaggctgaggcaggagaatggcgtgaacccgggaggcggagcttgcagtgagccgagatggccccactgcactctagcctgggccacagagccagactccgtctcaaaaaaataaaaataaataaataataataataataataaaataaaggagaaacgcttaagggaattctgtttattcagagaacatattgaggggtacattcagaattgggaggcaatgaattgataactgacacaacctttttgtcattcctttctaattgtcccattgtagtcagtgggtgtagccagtacagattctttgtagaatgtcacatttcttttgtggcctaatgctacataggcagttttggttaaacccatgtgagtatgtgtgtgtgtgtgtgtgtgtgtgtgtgtgtgtgtaaaacctccgccttctctatttgttaggtacggggttctaaataaatcttattgttatttaaatttttatatcccatctcatttttgtctggttaatttgattttaatctctcaatatgaatgtggctattaatttcaccttttatcattatttgcttggtttatattttgaagctatgttgtgaagtttataaaggtacatgatgctcttggtggattatttttgttattaatgggaatttttccttttatgcctttgcatactttgttgtttacattcattttgtctgattaatattgccatatgagccttctttttattagcacttgtctggtgtatcttttcctatacttttatttttagcagtcttcgtgccatttttttcaggtgtcatcagaagagactaagcaactcatggcttaattttctaaaataatctgaaaatctatgtttttcaacagatggactaaaagagagtataaagagcactgcattcatttgctcaggctgcggtaacaaaacacagacttggtgtcggaatccatagaaatgtattgcctcacagttctggaggctgggagtccaagatcaaggtgtcagcagggctggcctcctcgggccgtctctccttggccttgatgcccctgcatgtgttcttccttctgtgcctgttgtgtgcccctggggtctctctgtgtaccccaatttatcttttttttttgagatggagttttgctcttgttgcccaggctggagtgcagtggcgcaatcttggcccactgcaacctctgcctccccggttcaagtgattctctgccttagcctctggcaaaatgcccttttcaatcctccctgccattggctacttttaggatcctgctgattggtgcatgttacagattgctgattggtgtgttttacagagtgctgattggtgcattttacaatcctcttgctagctacagagtgctgattggtgcttttttacagagtgctaattggtgcattttacaatccacttgctagctacagagcgctgatgcattttacaatcctcttgtaagacagaaaagttctccaagtccccactcaacccaggaagttcagctggcttcacctctcacaaccaccccaagaaagttgagggtgaagtgcaggccatgcacaggatgctgtcttgatactgagaaaaggaaggtggtgttaaccacagaatttcatggccaggggtgagagttaatgtagcagaggggctctccttggaagggctgtctagaagaagagtgtgtaactctgggcaggataggaagaggtgacacctccatgagaaaagggactttgtcttttttgcccctgtctccccagcctgtggctggtgtgtgtcaaagaggcagagtcattcctgtgtagtcatgatggttagttttgtgtgttaactttgcccagctctggtgcccagttgatttgctcaaacaccagtctggatgttgctgggaaggtaatttttgggtaagatgaacatagtagaccttgagtaaagcagactgtccttcatatttggatgggcctaattcgatcagttgaaggccttaagaccaaaggctgaggttccccgaaggggaaggtcggcccccagacccccttgtgactcaagactggaatgtcaactcctcctggagttcccagcctgccggcctgccctgcagatttcagatttgccagcctctgcagtcatgtgagccaattccttgaaataaatctctttttatatatcctgttggttctctttctctgaaaattcctaatactgtagttttttcatctggtgatctatttggctatctcactaacttctgagttgggacagcctcagagtcagaagtcatgtgtctcctggaccctccatccccaaagcacagccccatgccaaaatatgcctttatgttagtagcactgcccagccctgttcagttttctgagatccagttcctacaagactgtggcactcagtacttttcatctcattgggttctgtgcctctggggctgttgcctctgagaccagatcccggatcctttctttgtgggctgctccacccctgctgtggaaatcacacagaaggcggacagtacatgtggacaggtcagacagacacactgattggccagctgcagcatggggagcatggactctgcccacagctgtggcgagatggctctgtggtgagatctgggctttcttgtgtgctgaggaatgggagcgtttgccatccttatccaagctgcatcactcagggctggcccctctgaggttgcactgtgggccccaccccagcctctgaacgagaattggcataccagccagatgcctaggtgatctgtgcatgtgctgcaggtggagaaggtctgcactagacatctccagaaggacgatctgggatcagggttagacaaggcccacgtctgctgcccagccctctcctctttgatgtcctttctgcacctgacacctcttcttgacattccctttccttggtttatgtggtaagacctctctgtccacaacaggaatggtcttacccatcttcttctcctaccatgtattaatagttccctgtgccttaaacccctgattcaaaacctgcttcctcaactctccaaagtcagccaagcgagaggttatgggcacagtcttccacaagactgccctcacttctgacaccagccccaaattcaggggtcctcaggcccatccttacttcttaccagctggtcaggggttcccatgaccagtcttaaattagataatttgctagaatgactcacagaactcagaacaccattatacttaacaatgacagtttcattatagcaaaaatttacaacccagaaccagacaaaagaaggaacacctggctgggcgcggtggctcacgcctgtaattccagcactttggaaggccgaggcagctggatcacgaggtcaggagatcgagaccatcctggctaataacggtgaaaccccgtctctactaaaaatatttttaaaaaattagccgagcgtggtggcgggcgcctgtagtcccagctactcgggaagctgaggcaggagaatggcgttaacccaggaggtggagcttgcagtgagctgagatggcaccactgcactccagcctgggcgacagagtgagactccatctcaaaaaaaaaaaaaaaaaaaaaaaaagaagaagggacacctagggtgaagtctgggaggcttccagatgcaaagctttggcgtcctcagagatgcattatcctcccagcatccaagtgtgacagtaatcaaagagtattgccaaaaaaggaacctcacctgagcttcaatgtctagagtttttatttgggattctttatgtaggtatgatgcatgatgaattgaatcagtgaattgattaaattgttggccatgtggttgagctcaatatctagccttcccagaagtcaggctggtagcccgtgtctcctgtctcaaagccccaaccctctagtagctagttggcctctctggcatcaccaacctccatcctgagtcatctcttttgcataaactttggaacgcaccacgaataacaaggacactcctatcacttggagattccaaggatgtagaggctccctccaaggtaccagaaggccagccaagttctttattacacaccaactgattgccatgacttagtggttaataaagagtggggcttggggttcctttagatttcaggcctgacacaaccccttggatatagactacatgaaatgaaagtgttaggaagggtgtatgcatgctatttgtttactttgaagagtgacacttggaaccaatgtcagttttacaggctgccctgacttgctggggcacagactgtgaagtgcatattcagaatgaatgaagtgttaccctacagcagtggctctcagacttgcaggcatcagaatcccctggagatcttttaacatgcagacttcagggtcctgcccctgagttttcattggtctgggggagggcccaagagtttctgtgtttgtggagttcccaggtgacactgatgctgctggcccagggaccacacttcaagaagccctggaatagactctgtggtgggtgtttgaactttggattcttggccataggtttttacattacaatgacagaatgggaagtttggcaggaataaagatgacttccacccacaggctcccggggaggtccttcttccctgggccctggcctggtgtctctgtctagcagctagctagcattcaggtcccaggtctcacattttggctggactttaatggcaattgatgggcaagtgcaggctgttcttgcaggggagggagtgctgcctctgcttgggctgctaggcttggggcctggtcacctggggccactgcccttccttcagtcttgccagacaggcagaggagtaagggcttgctaccggggcagagaacatcgaatgattgcaatcgtggggtcattaggattaattagtaaatagccatcagatcttaaaaaatagattcaggaacagcctgggagggcatttgggtgtggtttcccagtttgaggggaaagcatgaatcgactactatctcaggtagggctctggtgctgggaccctgctcaggccagttaagtgacagtggatgtggcctggaaatcctgtttctctcatgttcagtgagggtggaattaggggtgtgtgtggggaccttgggggcgccatgtgatgattaactgtagtctgtctcagttgtggaagctgctaatgtgtttttctgggacatcatcatgggatttttattattgatttcagcagggagactgctggctcattatgtgacaagaaatcgatgtggtgttccacgttcgaagcaggggttctccgtgacgtgcgggccctggaccagcagcctcagcatcccctgggcatgtgtgagcagtgcacactcccagcctccccctgacctgctgagccagaagctctagggctgggagccagaagccccgcaggtggctctgctgcatgggaaggaactgttgggatgcaaagcaggccagagaggacaggagcagacaaagatctgaagctgaatatggacccctcagggtgccagctgtcaccccggagcgcccccctacctggggaagctttggcaaccttcctggttgcaagccaaggcccagggactccaccgctggtgacccccttacctggccctggctgtgccctttggctcagggctgggcccgggaggctggagaggtgccagggttcattgccagaggctgccttgcccctcccttgtgtccttgtaggcagagccctcacccccctatgctttcccgccacccaccagccacacctccttgcccaggcctcagtgcctgacagatggcctgaatacatatatatatattttttgtcttaaaaaactattttttttaacatatctacagactctccccttaccaggtatttcttggggaagaaaatgttgcttagtagacaaatgtccccaggtctccttcagggaggatgagcatcacctgcattgaggaaggggtgcttcagcagagatgctcacttcaaagcgagcctcactagtagccacagggtgcacagctaggatgggaggcagtgctgctgagccaaggggtggtgggagcagctctggagaaacctggtcgggtggtgggtgaagctgcctccaccccagcaagcgatatggggcctccccactggactggggaactgtgtatgagggtttggggtgcagagacctcaggtggccttcaaaggaggggtggccagaggcccagcaggtgactcccacacctcttttacatcatctcctgctgaacaccccagagttccctgcttcttacagtggtaacatttgtttaggagttgtgcagtaagtagaccaggcatggtggttcatgcctgaaatcccaacattttgggaggctgaggcaggcagattgcttgagtccaagactttgagaccagcccgggcaacatggtgagaccctgtttctataaaaaatacaaaaattagccaggcaaggtggtgtgtacctgtcatctcagctattttggaggctaaggtaggaggattgcttgaacctgggaggtggaggttgcagtgagctgagatcacaccagtccactccagcctggataacagagagagaccctgtctccaaaaaaaaaaagagaaagttttgcataaataaagttaaattatttaaaataaaattatttaaaataaaagttaaattgtttaaaataagctaggagaaacttgctacttaaagacatcttttgggagaatttttattcagaagataatcatttatcaaagtgattgagtaacctgtaatttatccagtggagtttaatttaagcatttgaatttcatgtttacccttttagcagctatcattgaacccgtcttggtagctccaaagcacacttaaatatgagatgcagcccctgcctccattggcttatggactgggtgggtgtgtagccaccgtgtacagaaagttaaagatggttctagggaccaggcaaacagcctggggtgagttaccagaaggatgatgtgaatcatcgtgtgagattacaggttgcccatcaccatggccagtgcctctgagggtttgttgggattagaggggcagcttccaggcctttcaggagaggagggtctttacatgtcttttgtgggtgaggacctgaggcaagcagagagagacagccagagttacgtggggctggaagaaatcaggccagagtgactgggacccttgactctccttgttagagggtgtgtttgtccattttgtcctcttataacgtagtaccacagactgggtaatttataaagaaaagaagtttattggctcaaagttctggaggttgggaagtccaagagcatggtgccagcatctggtgagggcctttgtgctgcctcataacatggtggaaggcatcacatggcaaagagacagagagacaagataggggctaaacttaacctcttatgaggagccctctccctgggtaatggcattaatccattcctgacggcagagtcctcatggcctaatcacctcttcagcatactgtctcttaatactgttataatggcaatcaaatttccacatgagtattggcagggacttctgaaccatagcagagggactgccttccccatggatcctggtgtcctgcaccctgggcccagtccactctctggctggcacctctggttttgccccccaggactctgtaagctctagccaaggcagctggtgctgtgcttgccagctctgtgctttgacaacaacttctgccttccccacactgtctgaactccagggtctcctcttcgttttggtgttgggggactctggctcaccacagagctcctctccaggcacgtccctccacagcacctgggaaatccccttttctggctccaagtgacctatcttccgagggctacttgggaattcacagaacctcagctatggagaagctcagaggattgggggattgaaaccgtaggtcatccttgaatggttagcttttgaaaataattgtgcatttttccgtggtatgggttggtttcctgtcctgtctccacagtgctgaaccaaatcagcaacgctgcactttgcaactctgacagttgagcttcctggtcctgcgattagagccctcaagatagtactgaagcattaggtgaacggtggggacagaagcccagactctgtctggagtaggggccctggagggacacacacccacttcctatttggctctgtcctatatgcaggcattttttttttttttttttttttttctgagacgaagtctcactctgttgcccaagctggagtgcagtgaggccatcttggctcgctgcaacctccacctcctgggttcaaatgattctcttgcctcagcctcccgagtagctgggattacaggtgtgcgccaccacacctggctgatttttgtatgtttagtagagacaggatttcactatgttggccaggctggtctcaaactcctgacctcatgatctgcccgccttggcctcccaaagtgctgggattacaggtgtgagccactacgcctggcgcatgcattttttagaaggaccttgagatgatttactattgttgatcaaggaagaagatgaagcggggagatatgctgccttgaaagtgtcctttgagcatgcagccttatttcagctgtatgtcagggtgtgtgtgtgtgtgtgtgtgtgtgtgtgtgtgtgtgtgtgtgtgtgtgtgtgtgtgtatcagggttgctgctgaggagttgcattgcttccctaaggcccaccagggagattcctgtgagggggtcagacagggcctttgaagttttatgtgttattaaagaaggtcgtatcttattaccacaaagacctgggatatctgcagcagggagtggtagaggagaggctgtcaggccagcccttaacagcgtaactctctcattccttcctcagttcctccttatcctcctggcatccagctccccatcagaaactgtgaatcctaagatatgatgggaccatggacccttcacatttttgtcatattcattatagtggttctcagccttggctgcatgtcagccacccagagtgtccaaattctcctcacccagaaattctgacctcatggagctggggcaggatccaggaattgatattttttaaacctcctcaggttgattctagcatccaaccggggtttaggcccgaggaccacagcctgccagttttcgtgtggcgtgacctttcctgccgatgataatgctgatgatgtcaagcctagctgaacgctgatgggcagtgtctgattaatcgaatgaagtaaaaataaacaggttttaacttaatgtacctccccaaatctgtaaagagatccatggatgacatcagtgctgtccaggatggagtaagcccactatcgtccattccactcacggattagaactcaaaactctgaacagaatgaaaagcaaccccatcgggaagggggttggagcttgaatgcgcagcacattagaatagagtttctgtggttgggtttttttccctcctttgatctgagtgctgactgatttgggaaatagcacagtgggcagaggcagcaaaactctgtgagaaacccatctttgtggccagagggttgaaaagaggaacgctgcaagctgaagattaggagggatcactgttttgttttgtcttttcctctctcctggccctgccagacccagagcagtagcacctactaccctgagagaaaatccaactctctggttggaggaaccggttgttgcataaaggtggtgggaagaatccccatttttttctctttctcattctgctttgccctcagcaggggctgcagttgcaagaaactgtgaaagagtgtgatgtgttaggctaaaactctgggagagccccaactttatgggcagaggaaccaggaaaaggtgcatctggtagtagcggaatatggaagaaatcttggagaggggaaatctggaaaagagggtttatttatgtttctgaaccaactccatgtatgggatatacccagagaaccatagcaaaggctttggatttaagctgcaatagaaaccgtggcccgggtcccagacttaatccctgaatagctcgtgcttgaagccaactcacagagcacagcaaagggttttgaaaccgcactgacgttaactccatcccctaacgaaggggaaccagagcttgtgttctcaacctgagtggatttatcgtctgatgaagcagacacatgaaaatcaacattctctacattctcaacattctctctcattcaacatttttaatcagggttaaaatgtacatattaaagcgatctgggatgcaatctacaattatttgggatacaaagaagcaaaaaaatctgactaattcttcagtcaatcaattaaaaatattttttaaatgacccagttctcaagggaaaaggcaattaacaaatgtcaaccctgagatgacatagatgttgaaattatcaaagactttaaagtgactgttataaccatgttccatgaggtaaaagatggacagttctgaaattaacagaaacatagaaattcgcagcagggcaatatgaaaaaaaaaagaaaaaaataggaattttagaatgaagtaaaaatattactggatgagttcaaaagcaaatgtatatgacagaagaaagaatctaagttagctctaagtagatcaatagaaattatcctgaataaaagaaaaatgagtttaagaaatgagtaggccaggtgtgatggctcatgcctgtagtctcagcactttgggaggccaaggtgggaggatcattgagccaggagtttaagatcggcatgggcaatatggtaagacctcttctctactaaataaataagtaaataaataaaattttgctgagcctggtggcacacacctgtagtgccatctactcagaaggctgaggcaggaggatcacttgatccccagaggttgaggctgcagtgagccatatttgtgccactttactccagcctgggtgacagagcaagaccctgtctcagaaaaaaaaaaaaaaaagcaattattaaaaaaaggtatcatttacaatagcatccccccaaaaaagaaagaactacatataaataagaaaatatacaagatccgtatgctggagactaaagaatactgatgagagaaatcaaagacccaactcatggaaagatatatttatattttggaagattcagtatagttgtgaattctccccaaatcgacctatagattcattgcaatcccaatcaaatttccagcaggatttaaaaaactagatattgataatgggattctaaaatttatatagaaaaataagggatcaatagtggaaacaatggttagatccctggtgaaaaaatattcctgattacatgcgggagaatttcccagaagatgaaaaacaagggaactctgaactttgaataaagggcacatgatccttatggactttcttagttctctagggctgctgtaagaagtccacagactgggtggcataaacaacagaagcttactgtctcagttctggaggctggaagtcccagattgaggtgtcctcaggactggtgcctcatgagggctgtgagggaaagtctgtcccatgcgtctccgtttgcttgtggtggtttgctggcgatctttgatgttccctagtttagagccctgccttcatcctgtttgtgtgactgtctccacaattcccctctttagaggacaccagtcctattgggttagggcctacgcaaattactgtatgtcaactaattatatctgcagtaatccccttcctctctctctctcgctgtctcttcttttctttctttcctcactgtgttgccaggctggagtgcagtggcccgatctcagctcactgcaacctctgcctcccgagtttaagagagtctcctgcctcagcctcctgagtagctgggactacaagtgcatgccaccacgtgtatttttagtagagacagggtttcactgtgttagccaggatggtctcagtctcctgaccttgtgatccgcccgcctcggcctcccaaagtgctgggattacaggagtgagccaccacacccagctgcagtgatcctatttctaaacaaagtatattctgaggtacaggggatgagaacttaaacatatgaattttgaggggacataattcagccataacacggatgtggcttattttaaatctacacagtactgtatgcacttggaaatgactagaaaaatgtgaaaatcacagggcaacaagcagaagcagacttttccccctcgagtcttgtggccgcttctctgggggtgacagatttctttgtctctgaggatggatctggtagagggtgtatttagcagtgtacttctttgcacggggtcctggcagctgcagaagctgcgcccctttctccagcatgttaagaaaaaggtcagtgctggtaacgttctgtgttcagttgccctcttatctggaccctcgcttttcccctaaaggcatccaggagcaaacatgacatgcagaggtagactttgccaaggcaccgctatttccagaagttcttgtgggagagagttgacttcttactgttagacgtaacccaggaagaacagcaaataccggccaggccagaagtgcacacagttactctgttcctgttacggcattaatgctgctttcaggcgtggactacattgtgagatattgaaaatgccatttcctggagactagtattgatgatgaaggtctgacagcaattttaatgatgtttaaagggcagatcatcgccctttgcgtatttcgagatgaggatgcagtggggcagatgtctcagcatattgaatgcccagaaggaagaagttaggcccaacattaaccccaagcctcttccaagggctgctgagacttaacacccttcccaccgcagaaatgtcacctgacaggtatggctgcccaaggcttcctgggcttttttatgcttgtcttttttatgttatttgtctgtagaagtactatagccaggaatgactagaggaaggaaataggtaccattgtcccatcactcgaaggcagcccttgctaacgtcttaatgcatttcttcacagttgattctgtgtttatttgttgtgaataaatcataacaatacatattacatgctaagccttttgtaaatatttcagatgccacaaaattgtcttgtggaagtgctaacactgatttatctaggatcctgttattgaaggtttagtgtgtgctcaatatttttgtccatttcactgccgttttccaaagagaacacatccctttgtgaccctaagctaggttagagagccttgcttgacagtgttggatatcagtattgtttttggaagattaatttattagtgtcctttcagagcttgcggttgcctgtgatcttgaagtgaaatacttattcggtgacttttgtctggaatgcttgggctgattatacaagcattctccaggactgttcaaacccacatcatgtatagtgtatagtgaaagcaactaaattatatttgaaaggaacaaaataatattatctttacaacatgtgagaccaaatgggggacaagattggtgtcaggaacaatttggctgagtctgtttctcatttgtatgatacgttttcacccagcctgtattgtggtcactgaatagctatttttcatctggtctgctatattactagctcttctaagcaccagctaatgctattttcccgtgcaaaagaaaaacatggtttagaataaggacactggagctctttattgttgacaatgagcctttatttctcacatctaattagaatgtttcaggaggcgagtggtgagcacggtgtcgggggccgcattagctattgatttatgtgctgttatagaattaattgagtctggacatggagactcattttcttggacatgtagcaggtaatcatgcttctcctgtacatttgaattgctttccagatggtgtgttgtacaggatttatctttaatatgattgactagaagcaaaggacctgagtgtgtttgcatacatgctctgcaatgcaaagcccccagcccccactgtagagatggttaactctctcctggccacaccccccctgggctcatatggggacctgggccttggattgacactgtatgcagcaaagacagcgtcaaagggtcctggataaaggctctgggaggggagaaaaggcctatagtatattctgagggaaacagaataaacagcattacttattatgcaaaaccaggacataatgtgggttcagcaggggaatagttagtgtcttagtcagctcaggctgctatatcaaaaaacaccatagacttggtggctccaacagcagacatttatttctcacagctctggaggctgggaagtctgtgatcaaggtatgggcagattcagtgtctgctgaggtctgtctgctttctggttcataggtggccatcttctttctgtgtccacacatggtgaaaggggcaaggcagctctctggggtctttttcttctttcttttttccttccttccttcctctctccctccctccctccttctctctctctctctctctctctctctctctctcgtctcgcactgtcacctgggctggagtgcaatggcgtgatctcggctcactgcaacctccgcctcccaggttcgagtgattctctttgcctcagcctcccaagtagctgggattacaggtgcacgccaccatgcctggctaattttttttttttttttttgtatttttagtagagatgggatttcacaatgttggccaggctggtctcaaactcaagaccatgtgatctgccagcctcggcctcccaaagtgttgggattacaggcatgagccaccacgcccggcctggggtctctttcataagggcacagtcccactcatgagctccaccctcatgacctcatcactccccaaagaccccacctcctaatgccatcacactgggggtcaggatttctacatgtgaattttgggggcgatgcaaacattcagtctgtagtggtcagatgatatctattcagctgggaaataggatgtagccattaaaatgatacctatggagagcttgtgttgcttaccgcatgttaaaagagaacaacatggatttgtgtttacagtaaggtctcggctatgcaaaagagatgcacagataaaagactggaaagaaagaaaccaccaaacaaacactggctttctatgggtggaacaactgtgagtgggcatccattcctctctatatttcctattaagaacacagagcaaaacagattgtagtccttgttgctgggaagtaatgtgccctcagaaacagtcaccctctgagtacagaagtctgcccacatcagtttcacaaatgatgtgctagatgattagtcatatctccggctctctcctgccctcctacagggcagctgtccccatataacagttgtatccctagaaggagtatgcagttaaagtaattggagattctttgaccagacgttttgagagtctggcagcccggaaaggtgggatttggcagctatgtgggaccttccttcaggcactaaagggcttcctgaaaaagttgcttacacattgaggtgtgttaaatggaattctttatcataaggctgcaaactgcttctgtgcaaaaggcaatgtgttagttccttgcaggaatatgcttttagtgaactcaatgagataccagaaatccagtaggagaacactttctttgaaagaaccacttgtttctacctacgtttttgcccacctttccttctcacctccccttggccacaccccacttttgtgtcttgggaattatctgctgtgctctgaatagccccgtcctgccaggccacccacctttgcccttgtttgaagaagctggggacagttgtccttgctctccaccccctggagtaggggaagaaggcttggaatgtggtgggcctaggcttcttggtgagggccttgtatttgttgacaaggaggtcagatccattccctgggccgtcatcagagacctgcaagcatctacttagggcagagttttcaagtgcagtctttggacctccaacatgagaaccacctgcagctctagacctggcctttggcccacaaccttggaatcttgggccatgaacctgcacactctccaggtgggccttgtgcccaccaaagtgagcgaatcactgcattggaggagtgactcttggcttttcacaaggacctctccctgctttcctcagtccctccaagatgcacccatatcccactgcagggatgcaatttgcatacatagccagggacagtgtcatctggccacagccactcccagccacctgtgtcagcagagttccccgttcccatctaagacattcacctcatcaggcatctctcctggaccatttcattgacattttccttaactccctttatgtagtgtttatggagttcaggcctgcactggttgctctcttctttaactcgcttcaagccctgcaggcacatactgtcattttcagtttcctaaggaggggaaggccatctctccattaaatatcttgccccaggcctcacagtaaacagaggtctgaattgaaacaaggaccttcagtcttcatctttaacaggcgggctctttgtcttataccaaaagtgccccagtaggttccgtgtaattctgtggagtctttgaagacgtggctgccttctgggtagctgctgtgggtcccttaccctttgcactcatgggaaagagagctggatcagaatgtctgtggtgtcaaactcaggaaaagagctgccattagccagcgctagcattgtagtcatggtgaaaaacgggatcattaccagtccacagccaagccatattgcagcctgaggcaacaggaaaaatcaggaataccaatcctatcttcatttacaattttgatattttgttcatcatggatttattttgccttagttttgatttctaaagcattgcattaaaatattatttatttttgattgcttaggtttttggggcctccctgatctccccctggttcagccatcgtaaagtgaaagcattttcattgcaatgaggaataagtcaagggtgcctgttagtgccattgttaactcctcagggaagtgcagggcagggtagttagacaagatgaccacatgccggaaaggggaagcaaaatggtgacttctgaaagtgacatcatttacctagaaaaacattatcaactaaaaactattaggatttaaaaatagcttagtaaaatctatttttacaaaatcaatatcattttttttctgtatgccaacaataaccaggtaaatatataaggaagagatctattcgcaacagccacagaaatattatatttaagaaaaaacttaatatgagatgtctacagctataaagaaaattacaaagccgttgagagacatttaagacttcaataaataggaagatttttttgggtgaaattgggtaaaaagactcagtattgtaagtatgaataatttctgaggccggggcacggtggctcactcttgtaatcccagcactttgggaaaccgaggtggctgatcacttgaggcaggagttggacaccaacccggccaacatggcaaaacttcatctctacaaaaaatacaaaaattagccggagggtgatgacacatgcctgtaatcccagccactcaggaggctgaggcacaagaatcactttaacccaggaggcagagactgccgtgagctgggatcgtgctactgcactttagcctgggcgacagagcgagaccttgtctcaaaagaaaaaaaaattccctaaagtaatttataacttaaagttactccagccaaaatttcagtggaatattggggatacttggaaccactaactcttaagttcttttgggagaataaatgtgaaaatagcaggggaagatgacaaaatgagaataatgagagagaacttgccttatgtcgtattaaaatatgctctaaattcataataatgaaaatggcatggtactgttgctgggcagatagaaatgatgtagactagaaagtccagggacagatctaagtttatgtaagaatttagtgtatgatggctgggcggggtggctcacacctgtaatcccagcactttgggaggctgaggcaggtgaatcatgaggtcaagagatcgagaccatcctggccaacatggtgaaaccacatctctactaaaaaaaaaatacaaaaattagctgggcgtggtggtgcgcacctacctgtagtcctagctactcgggaggctgaggcaggagaatcacttgaacctgggaggtggaggtttcagtgagccgagatcacaccactgcactccggcctggcaacagagcaagactcagtctcaaaaaaaaaaaaaaagaatttagtgtatgacacgcagggtgaccagccatcccagttcctgtggaactgagggtttcctgggacatgagactttgagtgttaaagttgagatggttggtcactgtaaaacatgagaaacagaatagtctatttagtaaagggtattgggttacctgagtaaagctgtggtgcccacactttgctgtatattggaatcacctgggaaacttttatgaatactgatgcctagttcctatctgagacattctaggttcattggtatgtggtgtgacctgggcatcagggttttcaatgggtaacaaaacttgaaaatcactggggtaaccatcgtggagaacatgaagctgctccctaccttgtgtgtttacactttctgatgggttaaatatttcagtgtcaaaaataaaggattctagacagtgactggatttgcttgctccaagggaagaggtttgacccctcccatgaaaagtctggaacttctggagctagggacaggtgcagcacacagactcagggagtttcaggggagcaccttattcctgtgcctctaggaagggtggacattttccctggaagcaagcagatctggctgaggacagcctatctctgtcatacctaaaaaatacaggcacctcttcacatctcaacagtgaagtcccagatgaccaccctgactgcctccagctcaccataaaatcctctcccactgtatcttacactgcccagccatccaccagtcgctgaaagacatgcactggtgtctcaggggccctttgttgccagcaagagcaaagacaggtcacatgctatatcttgctgaaaagtgagttagtgttttggaaggtcaaatggaggaactaatttataccacacagaaaaaaatgtgaaatgggtgctatgagtgtaaagttcagtgatttggagggcaaattccagagatattccagaaagagaaaaaggccattagggagagaaataaaaaagaaatagcaagaatcttcctgtaactaaagtaagatgtgggacttgattcggaaagggctcaccaaatgaatctcacataaaattaatgagaccctcataaaattaaaaaagacccttatctagacatagtttgctggaatttctgaactctaagagtggagaggaaattgtatcagcttccagacggaaggaatagatttttgtaccaaggtaaaaagaatctgaatagtattaaaatgcacatctgcgagactgtaagctagaagatagtggaacagtgttagcaaattattgtgaaaaggatgcaatacaataatcttatacctagcaaaggtatcattctatgtgagatcagagccattttatagatacaaaagagttacctcctaagtaaacaaaatgactctaacaattatttttacaaaataaaaatgaaatcccactaaatagttcaagagaaagaaatgcaaaaagtataggaagcagtggtaagttatgaattgagtaattatagtccaaattatattgttgtcgtagtgttatacatctggaataaatttttctgaaatcatctgaaggcttggagagctaataggaaacaccagtggaaaataaactcctggttctattgtagttctcctacaatgtcctcagtgttttcatttttgaaaacttgaataacattttaataggatctggactgttccatgttactgtaatgtgtattttagtccttatgtcctatattggcctagagaatattttatttagtgttggtatacatatttatatgtgcatattacagattttatccccccgaatgacagagattttgaagttaagatagcaagagtactgtgtactttagtttgttctcttaacaaggatgtgcataccttcaacgtgcacagcttgatgtcagagcctggcgagaaacagggatgctgtagagatggcaccgctatgcaaggaatgggagctgtgtgctcatgtgccagtgatgtaccatctgccctttgccgtcctgacgtcaagacatggacgtctggttgcatgttagcagctgcattcagcacatgcttctgagagaccgttttgaggaatgtagttactggagattgtgtctgagagttgtggttgctaagtccctgacatcactcctgcagcctctctcttgtggctggctgtcctctgtgaagataagaaatctggtgacaagttatatgtggtctttgaggcagctcagtgttcttgatgtgtcctctgacacatctgggttgcagatgtcttagtgagtgctggccccttgttctcttctagggaacagctctttcgaattgtcctgccagtttcagggtttgcgaatggggtgacgggccctgcagggtccatctcagtgacaattttcctggtgtgggacatctttgctgtctgtgggccactctagggggagtgctgtgaattgctccgcataccagtgatgctcctgaaacacggccatggacaagcctgtgcaggtggcggagtaaacattgcttctttagatgtcaagtgtccttggagtgaattcacacgttggaagcatgtggctccatcagtaattgtgcccacactctgagtgtctggactggatgaaataattatctccttcttcgttcttttgggaatattcatactgctgtaaccgtgaccatctggtacactcagtctcataacaagatgtgttttgggcaccactacaaacaaggtgctgtgtttggagctctggggggatacacaatatggaaggccttgagtttgtggcctaaactaaagagacaagaggggaagaggaggtacaggaaggcaagatgagagcccgggcagtgactgctgagggtcactgatagctcctctttcatcttcacttcctgctcccatctgagcccagatccctttgcttctgccacctaaggtcctcactgagccacttctccactgtcctctctactgttttagtttaagctctccttttttttctttttaaaaattgcagtaaaatagacataaaaaatttagcattttaagcattttcaagtgtgcaagctcttaactggactactggaatatgtttttttaaataattgaactatcatgcaagcaaaaaggcatgtgtaatgtaagagtacagtttaaagaatatgacaaacatttggggaagcaattagctgaagaagtagaacgttgctgggcgtggcggctcacccctgtaatcccagcacttttagaggccgaggtgggcggatcacgaggtcaggagatcgtgaccatcctagctaacacggtgaaaccccgtctctactaaaaatacgaaaaattagctcggcatggtgggggacacctgtagtcccagctactcgggaggctgaggcaggagaatggtgtgaacccaggaggtggaacttgcagtgagctgagatggtgccactgcactccatcctgggcgacagagcgagactccatctcaaaaaaaaaaaaaagaagtagaacgttaagcaaacttttggacgtcctctgtgccactttcctgatgctagccccttgctttcccccagaagagagaatagccttttcactggtctccctgcctctagcctctagcctctgtccccacgccaggcccagagagacagggctaaaagaaaaaatgttgaaaatggctcagtgactgtgcacatgtcttagtctgttttctgttgctataacagaatacctaagactggttgattataaagaatggagatttgtttctcacagttctggaggctgggaagtccaaggtcaaggtgccagcatctggtaagggccttcttgctatgtcatcccaaggcagaggtgagaaggtgagggagaatgagaaagagagcaagagagagccaaactcacttttataacaaacccactctcacaataaagaacttcctcccaagataaagacattaatccattcatgagagcacagccctcatgacctaatcacctttcaaaggtcccacctctcaacactgttgcattagggattaagtctccaacgcatgaactttgggggacatattaaggccatagccgtgtggtttgggggataaagtgcagagtcctgggcactgggtccaggccctctcccagtttggcctgccaggtctctgcagctgccctgtcaccccacgatacctgcaggctgcggctgcaccctttgtcctcttctccccatggccgagcagtgctgtcccctctgctgagccctccagcctgccacgctggggacttgtgtagagcttttctgcacattgctcagcctggatggtccctgcgcatccagttcctcggtgaacattgttcagtttgagggggaagaggagggagaggatgggataagcctgaaggggaaggtacccaagatagtctttgaggggtcatggatttagattgggaagagttattgtccctcctcattggtcctcattatgtcttcttaatgaaagctgctcattttcttcgtgagagcaaacaacctgatcttctgaccatttgtcttggtcacctgggctacccaaactgagtgagaagtcaggaatgagccggtaggttcctggggagaggcgtgtgtcctcgtgagttgccggtgcctcccttgactgcttttcccggagctctgtgtgccctcgttctccttggtgtggatgcgtgttgttctgatgatgagttagcgggggtggggatggcgcactgtttgaacagatgtgccctcacatggctgcgggaggacgtggtgggaggtgctgtggtgaagtggccccacacatggctgggctttgtggggttttgactctgtccttcccaatgttcctccccacagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtaggaccctggctgtcctggggaagggagcagaggggcccgagagcaagggacctcagggtacaggccttgcagatgctgaagcgaggcggtggggggtgctgggtgcctcacagttctaatggtggctgagctcttcattggtccagttgggagacatgttgcgtggatgctccggccactcttaagctcaccgctcagactcaggactaaagccggttgagggctgagtggcaactcgtgtctcgcagaagacacccctcctcccaccctagaagagaggttcgatttcttgcccactgccctggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtctctgaaagcccgggggccttggcctgatgggcaatcagctgtgaatacctatttggaaaaggattttttgaaggtttgacaaaacctcggggaagaaacgcatgctaatgagggcagtggatgtcagcataactgtattttaattatagcaaagtcagcgtgcattctaataaacacatttgaaaagccaccttccaaaaaaagcctcactgtgagtatataaagaagatgtgattattggacttgtgtgaaggaacttctatttggccaattatgtggacttctgtcatatttttttacagccttaactgttaaatatttttttccgagaagagttcatgaatttgagtgtgtgtgtgtgtgtgtgtgtgtgtgtgtgtgtgtgtgtgtgtactgagagcttgggtttggaatggaaatcattggattttcagcacttatattttaattgactcctggattttcagcacttgtattttaatgtcttgtattctctctaaagaacgttaagtgtcagttgacttcactttgggggtgttcctgtcattcacagcaattccgtgtttacagggggctgtgggatgcataggagctcccatggtactagtgggtgttgggagagttcacccctaaggccaggaggctctggaccctgggtctgggctttaggccaaagcaaagtgtttctttggtctttagcagggcctgggcttgtcccacaacagtggtgaaggcacctcagggattgacgtgggctgtgcagagcgtgtgacatgctgcgtcttattgtgacaaatggcatcgctagccaagttcttgtcaaagaagattatctttagagcgtggtggggagtaagcaagacctgatattttctggttttgtgcttcatgctaaccagatggtaatttgggtaaaaacacagagatcttgcgattggagagctgggaggtaaatgagtgggaatgaatggatggatgggtgatagtagctgtttaaaagggcaggtggaggtaggggaagtccccagccattgtggaggatcaagaggatgtctgttcttcccagaagaggcattgaatgaaaaagtatgtcacttctccccctaaggagaatgtgtccttgaaggacatgctcttgtctgagacactggaaaagttcatttaaactggttaatgattgtatagcttttgttttgttttgtttttccctccctccctcctttctgtcctttcctcctttcctcccttcctcccttcctccctccctccctccctccctccctccctccctccttctctccctccctccctccctcctctctctctctctctctctctctctctttctttctttctttcctatcagttcacaaattaattctgtcaaggggaacacctgctagttccagagttccaggctgacaagtaccctggtgccaggggccctgactactctttctgaagactctaccaggcccgctgcacgtgggcagggtctccacattcttagatttgagtaccccattccagatgaggacctctttgaaacctgaccagaaagagccgtagaattcatcttgaaagcaagattttttatgaaggatgtgcactgggagatttggtgctgccttgcttgaaataacaacctgctttcctaagaacaatccccttcctcccctgggggacagccaggccgtgccaggagccaacaaaggcctggcctcaagcaggtgcacagggtgccatgtgtcccatgctcacctctctgatcccagtgctgtccacatagtgtagtgatccctatggttgaggctgcagtaaaaaaaaaatctgaagggagaaatgggcaatattggtcacttagatgctgtagactcctgtttttaaccctaacccagcagcattggcattactggggagccccgcccccacattgctgaatctgaaatctgcatttcaacaagatgccacattccagctgtgatgctgtaggagactcacttggaggaaattgtgtagcaaccctcccctctcttctactcattttacagcttgaaaaagtgtgtcctggatattttgaagaggactgaatagcatttagtcattgcacgaatggcaatagtaaaatagagttagaaaaaatgggaagatgaaaaatgtattctccatggtccctactaccctaacggatgagctatttcatcagtgtgccttttcagaccatagcattgagcataaatgatgtacgtagctgtcatcataacccagatgtatttttgtcatacagtttttaaaatctgatgtatgataaatgtttctccatgtcaccatataattttcatgattatttgtagtgacctttccatgatccatttgggcgatgatgtgctgtataacatatttctctgtacacactctaccattgagcatgcagattgtgagtggcattttctcttaggtgtaaggctgccacagacatctttgtacaaaccatgttttccttctttggtttattacctgaggataaatccccatgccgtacatcaacgttgaccatttcccctcgatgaccttgcctaattgtttcccttcttctgtggatgttggatgcatgccctttatcttttggggtttggatgcatttccatctcatagaagcactctctacactgtaggtgtgacttcctgttgcgtatgtcctcatctttagtacattttcttttgaattttggttatattattttcaccatctctgcagcatttttaagatgttaatgactcatctgtgacccctccacctcctttcggtacagagggatttaattggatgtttccttcttccctgtctgggtagatgtattcacagaggacattgctttggtctggtcgatacgaaaaatgagttgccggctgggtgcagtggctcacacttgtaatcccagcactttgggaggccaaggtgggcaaatcacctgaggtcaggagttcgagaccagcctgaccaacatggtgaaaccctgtctctgctaaaaatataaaaattagatgggcatggtagtgtgcaccagtaatcccagctactcaggaggctgaggcaggagaatcgcttgagcctgggaggcagaagctgcagtgagccgagatagcaccactgcactccaacgttggcaacaaagtgagactcccacctccaaaaaaaaaagaaaagaaaaatgagttgtgcctgtactaagaagtaggttgtgtggcctttggagccctcctgagctgtaggatgccatgcattttgaaaaggctccagtttgcagggagccctcccacctgtgccactctgctgagaccaagaggtctgcccgggggctgggatatgagaggcacaaaggtgatagagtttctaaaattgtaggaagacaggttggggaacagagatctacacttgaattattttagtaaaataaaaaaaggttatttcaaagcactgcaagtttactgaggaaaatttggaaaatacaggcaaaaaaatcttttgccatgtggcattgtagaattccactgtagagttttcaaatcaaagagacaaacctaggtcaggatttcccaaaacacgctcttagaggtgttgtgtaaacaaagtaccatttgatccttactattcatggatttgatatttgcaactttgttaacttgctaaaattgatttgtaaccctgaaatcaatactcgtagcactttcccagtcatttgtggaggtacagagaggggaagaatttgagtcacccaactctcacgttcccagctgaggttgaacaaggctttgccttcttgtttcagctctcatactgtaaacagctgttcttttcacaatctatttaatgttctttgcatttttgttgatatgtgtgtgtgtgtgtgtgtgttggtgataaaatggccctcaagtgtggtgctgaagcctagtgatcctaagcacagaatggctgccatgtgccttacatgtgctagagaagcttccttcagggctgagcgacagtgctgactcgtctatgctgccactctgggaggtgctaaagtaaacttctgtagcgtatgatgaagttaaggaaaaggtggaggaatggctaaatttgcagattcatgggacaataactgattaaaaaacacatagtggacaggtagaaaacccaagaactttactgtcttgtgatctagggtcagggaaatgttaaactcttctcagctagtgttttatgttaaagaaatattgcatataattaattatttataagaaatctatattaaacaaggtgcgtataaacagaaacacacataaaacaaggttctgtgttgattcattgacaaaaatgtgtcccgaggctcataggaacctaaccctgtatcgcccctaggagcaatgtattcagtattcatcaactcagtgctcagggcagctttacagaacataactatgtgaatgagaattggttgtatttggttggcaaatgactttgggaaactttgctgcaaagtttttcccttcttgggggtttactgatttctcacacacaagtagcataaagtcccacgttcgctatagcggagacaccagccagcctggccagtgcttcccaaacatggtgtatcagcaagcccttttccctccatgcagggtctgtgggagaatacagacccaagctttacaccctggggagtaaaggacccgtacacatgaactcccaaggcctctccctgtatgcttcagttccaagatgattcagcaaccccaaatggtgatgatggaaaggttgtcattgtgttatcatcaggacccttggcttctgcagatttaacctttcttattttgtggtttgtgtaaagtccgtgggtgccggtggaggtggcagcagtgttggcggtgactgccagcaccatgttaggggtgttaggaatatgatcgcagtaaatcctagagcaacccagagagagggagctagggttagtcccgtgttgcagatggcacagttaagtagctcacctgtgaatagactgtggactgtgttatgccaaaacccgtgcctctgaacagtgcataacacagcccttgaagaacctgagaagagaaagcgtccagttctgttcagtccgcgtttgagcctgcctgctggagggtgagtcagtgtgggggaactgtgcagtgttcctcctggagagtgatggtctcttctcctctgttgtctgtttccttgctgttgaaaggcttggcgtgccctgttgttctcagtgagtgggatacggtgccagtgaggtgaccagtagatacggaagcctccggtctgtaaaatgtccccatctcagtgctaacgtgtcctaagttcaccagggctcaggccacagatcaaacaagtcaagtaaagattgttcatgtggcatttttcttaatttttttgagctttgttgacataacgtattgattttttttttcatgcagtgattaaggaatacatgagttgggtccagcaaggctcgtattgtgtgacctgatggaattagtattactacacctacccatgtggccctctactatcaggcagtgaagcgtgagtggagggaggaccccagctgggcactggtacctggctcagtctcacagctccagggatgagcctgtggacctggcacgtccttggtgccttcccttgaagagagtagtttgctcatcagtgctttccctggggcaactcacccacactcctggggggcaccataagagcgtttgtccagcaccaaagatcctagttctgtgggtctgtggggtggccctggatggcatgttctctggatgcctctgggtggcctgtggaacataaagggtttggcgagggctggacggattgttttggagccccatcccacctgttaccttgtgacgtctatcaggagatacactgaaaaggtcagccctgcctgaaattctccctgtagagacttactcctttggaccttggagatttctggagctgcaggcattccttgtccaggacctccatggctaccgagttgaggtatttgatttactcagcaagtgtagaatagctccacaccttggaatggcaaaccaaatatgcgttttgattatttggggttttcatgatttctgtttatccctgacccagctggtgctttctagaaagagccttctgccaatagaaaaaagaagaaaaatcaatacatggtagccaacttaatacaagttaaagggaagcatggtcgagggccccgaggccacatcgaatgcagaattgtgcatcattgctcattgtagagatgctttggccgtgacttggcattcagtagaggcttgctttttgaagaaccttctgagagtgtgataggagtctggtgccaagggagagaaggtgctaaaagcacaggtaactgggtgtgtcccccaggtgggaggcagtggtaccgtgtgtgttctgagccacggcctcacacacatgccccgctgggcagcatatgaagtgagtgtcagtatctgctttacagaagaggactgagacaagagtggcatggggttgttggcacccaggcgccccccctccatcagcgtgtggtggggcagcaggtgtgcagatggggtggtcctgcacagaggggctttggggcttgcactgcgcccaggagggagtggtctggggtttgtctaaacctggcccacagtaggatggaacttgggaaagagcctgtaggtggtgctgagggcagggggttatggggggcattggggcatggtctgcctgggaaggggaaggtcctctccagcccccaggcctcagtggagtagtcggctccctcctttctgcagccatgcctcagattctagtgtcccttgccccgcccacccatggcgtcaggcctagcactcctgctctgcatacggggaggctgcacgggagggttcttggggtgctcctgtgtcccctgtcgtctgtactgaaccccttcccgtgcagctctgctcccagcactgtgacagggtggacaccgcacctcctgctactgattcccaggattgccttgaaaaataaaatcctacgggtgtgcattgacgtttcaatcctggctggctccgcatgagcttctgaacttgatgttcagaagctcagggcccatttgctgagtcagcacagctgccttctttgatttgtatgaagccttttgatgttttgatgacatgtcaccatgggtggctgttattttcagggagcagtttatctatcaggatctgggattgcttcgggtacttttaaaatctaggtaaagccggggtttctaaaacattgttctaaaacattgtcagggcagagcatgtaaagctctcccactaccactaatagtgatctaaaaagtgcctctcccctcaaacacaccctagtcctcggggagaaagcagagtgcggtggttaggaatgctggagccacagtcaggaagccggcatcccacccggctgcagcagcttggggcccgggaacattctggatgggccacctgtgccagcagccccccatctcgtggggctgtggggaggggagttgatctgggtcagtgtctgtatgggtggggaggggagttgatctggtcagtgtctgtatgggtggggaggggagttgatctgggtcagtgtctgtatgggtggggaggggagttgatctggtcagtgtctgtatgggtggggaggggagttgatctggtcagtgtctgtatgggtggtgcggggagttgatctcggtcagtgtctgtatgggtggggaggggagttgatctggtcagtgtctgtatgggtggtgcggggagttgatctggtcagtgtctgtatgggtggggaggggagttgatctgggtcagtgtctgtatgggtagggagggaagttgatctggtcagtgtctgtatgggtggggaggggagttgatctggtcagtgtctgtatgggtgatgcggggagttgatctggtcagtgtctgtatgggtggtgcagggagttgatctggtcagtgtctgtatgggtggtgcggggagttgatctggtcagtgtctgtatgggtggggaggggagttgatctggtcagtgtctgtatgggtggggaggggagttgatctgggtcagtgtctgtatgggttgggagggaagttgatctggtcagtgtctgtatgggtggtgcggggagttgatctggtcagtgtctgtatgggtggggaggggagttgatctggtcagtgtctgtatgggtggtgcggggagttgatctggtcagtgtctgtatgggtggggaggggagttgatctgggtcagtgtctgtatggatggtgcggggcatggagtgcttgtgcagatgatgatgatgatgatgagttttcagtccatgggaagctcatcgggtctgggggaggtgggtgggcaagtccctgcacccagtttgggtacaggccatgctgggcaggggtgaggacactagtggacctgtcctcgggagtgacacaaaggaggtggtgagccctgcttgtgagataggatgagaggaggaccaggactggtcagggccacactggagctgctgggggtgaggtcgggtaagggcctcccaaggtgcccccacgctgtcccctctgcagggccctcctgaatgtggcttgtgccctgctggagaagttctcacatgcctctttctactccagagtcactgatttgggagatggggcaacagctgcacagccccaagggctgccctgattttctcacaccgaatatctaataggaagttagctgagaagcccacacacctcttcttccaggtaggcaagctgggcctgggactacctgtctctcaccgactccaaatgatagccaagcctctcttaaccttgggcaccttttttccagtttccaccccgaattcacactcttcaaagccagctcctcctgctgggctgctcctgatgtggggggccggccctccctgcaaatctctggcatggcccttgcaaattggcacctgccacgtggttggcactgggactgcaaaggtgaaagtggcattatcctgcatttgaaactcattctagagggagacggatacatgagactctccccgcccccatccaggtgtggccaggctccagacgagttccaggcaggcttccaggacaggctccagagttagggacaggcggagaggctctgtgactttgagaggggctttgggaagtcagccgacaaggtggggatgaacatagaggtgtgtgggtgtcctcagcatggaaggggctggaatcgtgatgtggctttgagcctgaaacaagacaaagggaaggcgagggacatgggttgggggatggtgatgagagagagacagagggttccactgggggcatggaggggagccaggagagaactggggagctgaggggagggacattaggaaggccagatgtagcagggcagttaggagatatcttactggggaagaaagcacccgttggcggtggccacctgttggcggggtcccctgagcctgagcagctctggtggattgggaaggcagaggcatgggaatggtagatggacagtgtctatagagacttgcacggagggcccaaggaggtgccagcaagccgaggtgctcatagtgtgtgtgtgtgtgtgtgtgtgcacgcacgcttgtatgtgagatattgacttgcattgtactcatctgccggtggggtgtctagggcagattgtggggagtgagagcattgggtatgggacccaggctgtccacgtgcgtctgcttcttgaggccccgtacctcccgttcttgggcctccgtgacacctggcatcatgcctctcttgcaccagaggcttgagagacacccagttggcaaaatcagttagtctgtgacattccctaggaagtgcagggctcggtgcaagaagttatagaagtatctgtttaggaagaaagatcgcatggctgaacacgctgagatgcgtaatgtcacccatggtgtgcttgcccaagatgtgatagcgtggtgatggcagacatgggagttttaccccaaagcattcagatcacaaccagtgccagtcagttactatgaagacatgtgactatggtaatagggggctgacctattagaataactcctaatcctatgtcagataataccatgggcagctcaagaaaactacgcacaactcagacatgtggagaaaggagatgtggaatggaatggagccctctgggctgatagaggcctccaggacttgccacacccacgtctgcccccaattccccagtcagccttcacagaagagaagttggtctctctccagctgagaccaagccaagacccaaagtgctggagctgaaggaagtttgggctaggctcacagaagctattgtcccctcctccagtgtcaacagctacccatggtccaggcctccatctggtcctggtccttttaagagacactgggtgctgactcacttctgggtctgtcccacgggtggcctgcctggtctgctgtgggtgcagccagactgtgcaggttcgggagcccgaggtggacttcaggtagggagacgctgctccccaagagctgctcgggtgtgacgtcagggtggaggctgttgctgtgtgtggcggcatcagtcatttaccctctttctcattagcccctgtccttcggcccatgtgcttgcaggtggcctctgattctgcttctggagactgtctgccccctctgattcattcattgcggccccagttatgtgaaagatagcatgttcattattcattcattgggccccacttttagatatacttgtgttcatcttcgagagagggaggtcatccagccattccccagtcctcaaaacccactccacaggcaaagcagtggtgggtcagggctcctcttgctgcattgcggccttgtatttgctcttctgagccacaagcatagcgagaaagtacaaaagaaaaggatttcaatggtattcaccctgaaaaaggaagaaaattgtgacacaggctgcaatatggacaaaccttgaagacgtcctgctaagtgcaatgagccagtcacaaaaggacaagtactgtgtgattctacttctgaggcacccacagtagtcagagtcatagaaacaggaagtagagtggcggtggtcaggggctggagagagcagggagtggggagctggtgtttaatgggtgcagaggttcagttgtgaagatggaagcattctggaggtcatcggtggtgatggtcgctcaacagtgtgaatgtacttaatgccactgaattgtacacttaaaaatggttaagatggtaaattgtatgttatgtatacttaccacaataaaataaataaagaaaagaagaggtttttcagtgaataactggtttgaaccaatttggatcctctaaaaccaagttgagccagtctgaacccatgtagccattatcacaccgtgttaggctattcttgcactgctttaaagaaatacctggggctgggtaatttataagaaaagaggtttaattggctgacagttctgcaggctgtagaggaagcataatactaacatctgcttctggggaggcctcaggaagccttcaatggtgacagaaggcagagtgggagccagcacttcacatggtgagaatgggagcaagagagagagtgggggttggagggggaagcgccacacacttttaaacaaccagttctcttgtgcactcaaagtaaaacctcacttactaccaaggggatggcccacatcattcatgaaagattcaccccatgatccagacacctcctaccaggccccacttccagcattggggattgcatttcagtatgagatttgggcagggacaaatatccaaactatatcacccacaaagaagcaaaaacattttgggccaaatcaaaactatttagatgtagccacagtggggatgaactgtgattatacccattcaggcctgtggacctgtggacctggcgtgtgtggtcgtgaggcggtgggtcggcacatccctgggaggtttcaggaggacattcaagaccaaaatgagccatgagtaaataacacaaccacatcctgagtgggagtaggggagcctccccttctctcctaggtcttgtatgggtcatgatcccgccttggcaggagtggaaggaacagatcccacaggctgtggcttatggtaaagtgattgtggtcatgccttgtgagtgtcattaaaataaacatatatcgttaaatccaccatcaaataacagctatttctgccatcctctcgccttttccacaagtttaaatatcccagatattctactgtgtatattcctaaaagcagacaggtagatttagtaaagttaactggatcattggtaccttctttatagatcatctggtgaaacttgtttttcaaattatgagttgtagggctttgttttaatgtctgtagccttaggcagttccattgagactaagtttttttcttattaagactaatcttattgactggaactgtggactcctcgtattaggagaacagagatgtggcctacataaattagtggaagttaaatactgtagaaaatgctctctggaaaccaaagtctaacatcgacttactactggtcattcaatttccttttggcttgggcaccatcgttacattcatttttcagatgtcaagctagttttctcagaatgtgtgcagggctcgaggccaagtgtggaggccacaggggaggtcacaggtcaagccttctgggagaactgcaagcttgagcctctgataaagtcacgcgattgaattttagccccagtaggttgctgtcgttaaactgtgcacacagggcttcttgcttttaagttagcaggatggaaaaattgcggatgtttgcagcaaatgtgtagaaccagtggcagaagcagccatgctggcccctaagcaatggtattagaaagggttgatgaagattttctcatttgagagttgaacaaaaccaaatggaattctccctagttccgcagcactggtgggtgactctccctgggccggtctcagccctgcagaaaggggcactgtctgcttagcttggtcagcgcagggtctactgcagcagagtgccaggtggatcacagccctcttgtgggggaaggatgggcggagctcccaccttccccacaaatggacacagaatggcacctggtatgtgaggcaggtgcaggtgaccaggagaaggggctgtcagtggttgatggacagctgcctctgctgcctggatgacccaccccctcccctggaccatctcccactttgcctgggtgtcagtcactggagggttagctcagtacaagctggcggatgacctccgtagagcttaggtgaaggggctctcacagggcagtatgtttgagacccttagagggctctctttactcttgcttctcctattatttttaaactgtagtaatacacacgtaacataaagtttaccattttaaagtgtacaattcagtggcatttatcacaatgttgtgcaaccacctctgctctttagttccagaacattttcgctgcccccagaggagaccctgtatttattaagcagtcactccccattcttccctccgcccccagcccccacagtgaaaaatctgttttctctcactttggatttgtctattccggatattccataaagataggatcagacaatatgtgccctttagtgtctggcttatttcatcatcatgttttcagggttcatccctgttgtagtgtgtgtcagtactttgttcatttttgtggctgaatgatattccactgaatggctattttacattttattaatccactcatccactgatggacatttgagttgtttctaccgcatgattaatgtgaatagtgccactgtgaccatatgtgtacaagcttttgtgtagacacttgctttcagctcttttgggtgtatcactaggagtggaattcctgggtcatgtggttattcagtgtttaccgtttttaggaaccacagatgttttccacagtgacagaacattttacattttcaccagcaatgcatgagggttctgattactttcaaaggaaaaaaattaagcagccctgtcaccttgatggtttggtctctggcctcaccgcttcagctcctctggcctgatctcccagggcctgcttttgttcatgtgtgtgtctgtttataccctggctcatcctgtggagggtctgaggctggcaggatcactgggttctgtctccacattggaaggtgagctgtcctaggtcagggtctttgttgcatgcatcgtcctgtccttagcaagagctaccctgtgccatatgggacatacaacaggcacctgttcaggcctggccatgtgggcccacctttggatggtacttgacaaagcctcaaaatgcagtgacaagtttagataaatatgattctgttctgaaatgctgcactggacacagccatccactgcctgccctttacagggctctgtgaagagacagtgaacaatgaagtggaggacgtgtgcaggtggccccagtggtcggtgatggaggagagatttcagcagaccaagcacggagaataaagccaggccagagtgtgctatcagcctgtctgccccctagagctgatggactcagcaaataacagtatagggtacccagttacattcgaatttagacgggtataggattttggtttttcaagatgaaaaaacttatagtggtgagggttgtacaacattatgaatttaataacactgaactgtacactcaaaaatggttaagatagtatattttattgtatgtgtattttaccataataagcaattgaaaaaataagttgtatttcaggtagatagcgaataattttttagtataaatatgttccatgagatgtctggataccgggatgcaggagggactccccttcctcctcccattcacaggcctgcctagagatttgtaagtacagactgactggctgtttttcccagtgtgtcttgtcgtgatacttttaagccacagatccgctttgaaaagatatgatctcccccaggggagtaactattataagaacaaatactctatccaagcttccattctcctcaagataaacatcacaggagtgacctgaattgtaaagaggagtggaaggaaaagaacaataccgtaatgttttctgagccacgcagatgtcaggggacggatccaagggcgtctgaaagaagacgtccacgctgctgagtgagaccttcctctgtgctgctgagtgagaccttccatctgaccagggggtcatgctctcactgctcctgcttggagttctggtgctgtagcgggtctcggccgccccttctgagctgggtggaggaagaagtccctgttgaaatatcagatgagtagggatgatcgcctcttttgaaaacaggagccgtgaagggattcccagagaagattgtcatctaacggagtcattcgtccgcccaggacttctctgtcacagggttacgtttgggagaattttcacaggccactggggatggctgtggctagcctggctttccactgatgccctctatccctaacctcagctcctgacatggctgtcattccagagagtgcttggaagcatcctgactatgttgacgatggcctgagcggagtgagtgtgcactagtttggtgttgtttcatccaaagcaatgtgattatattgctgtactttcagtttcatcaagcaggcaaaatgagaattgacactttttaaaatccaagctttagtttcaccacctggagccaaggtgtttattagaaagatttattggcattagtgtatttttattacaagcatttatctctgtgctgaacagttgcccctgagtcccgtgtgctgtgaagagtctgtgccacaccacacattaattttctgtcctcagagctccggggacacacgctgattctcatgctgtgcctgccgccttctccgagtgatggctgatgtgggtttcaggccccactacagttactcagcgacagatgggaccccgtgtcctctgttggctgtagggagttgaggcgaccctggctggcatcttgttttgaggggtggctggctgctgtactttggggagggcataacaggatttaaatagtatctttatctaggatgcctggagccccaaatccatgtgggcctcccactgtgtgaatttcagatgctgccagccccccaaccccgccacccctgagatggaaattagagcaccagatgggctctcccaaggagaagcatcacaagcccaccctcctgcctctttggaaagtaaccctggctgtttattgtgagatgtggttgtcatggtgacaagtggacacccgcttgggagggagatagaggaaacgctgttatggaggaaaggtcacccctagagacaaccttgtgttgcccgtggacaccccatactatggcctccgtactggggagtcccatgggtagggcatgggggtgcagccatcagtctgtgtccccagccaagccttgagccctggcttgaagttgcatgaaggtacagtggctggcccagccctaacccgtggtggatgcagcccctgttgtgtcccccaacccctgacttatctggccgcctgatgagagtctgtcgccctacatctgtggcgctccctctgcctgacaaattaaatcccgcccagcttgcaggagggatgttgttaacctgatttcatttgctggtgggctggttgatttctttggggtttttttggagatgaccagcacctgtccagcaactagtaaggcagggaaggcctccaggaacccaagtccatgcagaagggcactgtgttggggaactttcagacaagtgggtaaaataccgacgtgtgctatgtgcaccttgaaatagcaaagtgtcctcaacagagctctctgggggatgtcccaaataaggtttactttaggagaatgtgagcggcatctgaggcgagattctcttgttgcatcctttggaagcttttgcttggtgttccttggccatagcaggaagatcagtgccagggatgggtgaggggaagaaaccttgcaggagcggtacctgggccagtctcagccctgcagaaaggggcgctgtctgctccacttggtcagtgcagggtctactgcaacagagtctcgggtggtcacagccctcttgtagggggaaggatgggttttgctcctgggatgctaggcttcgaaaagcagggcagtgtgccagcagtcccagacaaaccagagccgggcctttggtcatgccaggacagcagggtgtggtctggctaggcctgtgagcccctgtggggctcaggggtaggggcagcaggactgggggaggcagggaccaaccagacttcagaactgctgggtcccagctgcacccctgcaccacctcagctctaggaagggcagccccatgtagctttcttgagatgtagcagcagtgctctcccttctccctcgccatccttaaagcccggtgcccgctcccctgcatcccccactcccattgcctctgaaatccggtggtgtctgtgatcctggaggggaggcttagccagcaatcattccaactacctggggcacggcatatctgcccccatcagtgctgggagggtgggcccagatcctttaatttttctcaaaaccccagagaggcagagttccatcaaagagcaagacactgatagactaggacaggggatagggctggcagccatgcctcgtggcatcacctgactccgagagaagccagcccaacacttggggtctcagttttctcacctgtcaagcagggggaagaatattcattgtgtacacaagaggcttttgtaaaccctaaggtgctaggtaaattaggtaaatgtaactttttttttgagactgaatctcactgtgttgcccaggctggagtgcaatggcgccatctcagctcactgcaacctccgcctctcaggctcaagtgattctcctgcctcagcctcccgtgtagctgggattacaggcatccaccaccatgcccggctaattttttgtatttttagtagagacagggtttcaccatgttggccaggctagtctcaaactcctgacctcaactgatctgtctgccttggcctcccaaagtactgggattacaggcgtgagccactgtgcccagctggtaaatgtaacttttatcatcagtgtcttccttgccatcatcatattgttatttctcgataatttatttccagaaagttctggaactggacttaccatgcaggctccggaacctcctctgggaggtggacagggatttaagggctatggatctggcttctgtcttctggatgatataaggaactaaatagagaaaatatacctaaccttaaattttattaattgaagtagaagcagttgtagtttggtgtcttctttaagagaagacttatgacatgtacttggggcattttctatgttgtagtaacagattggctaatttgcatttattctcatccaagaatttaggttttttaaaaatatggcttttaactttttgggcactcttggtgggaacgtaaatagtactactgctgtggaaaacagtatggaaggtccttaaaaactgaaaaatagagttatcctatgatccagtgatttcacctccaggtatgtacgtaaaggaagtggaagtgaagactcaagagatatttgcacacccacgttcatagcagcaccattcacaatagctaagaattggaagcaacccaagtgtccatcaatagatgactggataaacaagaggtggcatgtacacacagtagaatgtgattcagcccttaaaggaaggaaattctgccatgtgcttcaatgtggacgacccttcaggacattttgctgagtgcaataagccagttccaaaagggcacatactgactgcttaatcactccacttacatgaggggcatagagctgcccaattcacagaaacagaaagtagaatggtggttggcaggggctcaggttggggttggggttgggcatattgaggagtttgtttaatgggtacagagttttagttttgggaagaggaagacattctgaaggtggatggtgaccatggttgtacgacagtgtgaatgtacttagtgccactgaactgtacacttaaaaatggtcaaatggtgaactttatgttatgtgcattttactgcaatcaaaagataacaaatttcaaaatgatttaaaataacttttttagaagtatgaaaatagaatattaagtgcatagcagtttaagtataattaaatagacgtctgcacacacacctatacacatacagacatacacatgcattttacaaaattgtatcacattgcatattcaggttttgcatcttgcatttctctaacatataaaatcacgatctttaacttccccgtttccaggtttgcaatggtctggagcagccaaggaagcagcagcgctctgatctcaatggacctgttgacaataacaacattccagaggtaatttttttcaaggatgagagttctgggctggaacactcatctaatgatggagtggcccaccgagttgtggtctgctcactttgtccatgatgttctcatcccacccggtgcctgggggagagggagtccaggtcaggccaagttggtgtcaccatatggtgaggaggtgagggcacactggcctgggaggagggaggagagggcctccctgatgttaggaccatgccatggagtgctcttgtgttgcagatggtgtgtgtgtgggggtgggggaccattggtactacttaattttataaaaagccattctattcattgtctgataaccatgttctaaactagggtttctcaacaatgacaccattaacattgaggcctaggtaatactttgttttggggactgtcctgtgtattgtagttgagcagcatccgtggcctcaacccactagatccttgtacctaccccatccccatccctgatttgtggtaaccaaaaatgtctccagacattgcctaatgatgtccctttgggaacaaaaatcatcccagttgagaaccactgttctaaatcaacaacaggttttaacaaacaatttcctataagctaacagtgctatgatggaagttatttcccctttctggtaacatagtttagatgagattatttaactttgatgaaataacgatggccaccgatggagtggtatccagtctcctttatcttgcttttaaagatgggcctggatggctctcatgccccctggttggagcgtcattgtgttggatggtccctaggctcccttctagtcaagatatgctagtctgagggcccctaagttttagatgatgggcttttgggccactccccaacatcatgttgcctgcagcagactggtttcctgtatggagctgacatcttcagaacaccatcactcatggggggtttgcttttctcattatggctcatatcacagccctgcttagccttcaccttgtgggctacctacttaacaattgttatgtgttttatttttccatatttcctaacagacaaagaaggtggcatcatttccaagttttgtggctggtaagtgactttgaattttatttctcaaggggcagttgcattttacatcaaaataaatggtgcttttagtttgggcattcacctgcaaagcttgtttacaaagcgtgcctacctaccagcaaggtgcttggccattgtctgtttgaacactgtgtagccccacttagtggggaggggaggtccagctgatctgcccgctttgatgcaaggaacagtagacgatctcctttaattataccctcactaattgcatcacagacgacactgatgactgaatagattgagatgtgtctttataagcagctggttatagctaacacttctgatcagggtggatataatgcattcaaattcaggctttttttttttttttagatcctttgtttttctttaccgttccaccctttttgaggaggttaatagtgcatttcaacattcagtaaagaatgaaactggtcgatatgttctgtgtcactcttggggatggggagcacacttgcctggctttgacggagctgagcatctggagaccttgcagggcccctgtaggagatccactgggtttgcttctagtgctccaacctcagagtaaagagcttgttcggcaggatttctgtctttgccaggaggatgtttcctgcccctgctaatgtgttataataaacaatgtgaatttcattaattctttcaataagctggtaattaattcttataaatatttatgggagcaaggtaaattagttttcagaaataaatgactttcagcccttcccatgctgcttttctttttttagcaaacaactaaagcctggggaactgaagcccccaaattcgcctttagagaactagtttgaaccaggctaatccagttccaattggttgaaactggattaactggctcaaatcaattttgactgttataactggcttaatgctgctcagattgggtgagaatctgttttaaaccatcagaattaatatcatgcaattgagatagacttggttccattttgaccaattcagataggctaaaatgggttttgcccagcagtttacatgtggttttaggtacattttatctggttcaaattggttttcttcaggccacagcaggttatgatgattcctggaagagaccacactccccacattcccgcttgtagtgtttgattgggttcctggtttataggagctggcacctcgtgagcagggcgaatgcagtacgtcactgtgccattttccttggcaggcagaagccagggtggggttgccagtcacactgctccagtgaggcagggtctcctggatccaagaagctcacttgtcagtgtatcatagtgtcatctggacagaactctcacactaggaggtgatttagacattaaattccccgacccttgaaccaatctcatatctgcagggagtgggatcgtgagggatcgggaagcagtgtcagtgcctggggtacctcggactctagctcctggcatcccagaagacttggttccctgcaccactcagactgttccaaagcaaatccaaacaaggccggtggcttaaaacaattcagacaggctaaaactgctgtgaccagctagaaccaatgtggaaaacctgaatttatagtttcttctgtaggagagaagccctttgattgttatgaaaacatagaaaactgaagcaaaacaacatcctttactattacagcatttatatgcagcgaggccttcatggaccaaaatcttactcagcaacaggaagagatcatcataatggtgatgccaaaccctagaatataatggatatgggaaaagtttctccaaattaaacaccgttatcagtttgaatgcctttgggtacaagtatcaaaatccccacctaacgttacacaaataggtgtgtgtcttacataaagaagtccagggttggacgtggtggctcacgcctgtaatcccagcactttgggaggccgaggcgggtggatcatgaggtcagcagatcaagaccatcctggccaacatggtgaaaccccgtctgtactaaaatacaaaaaattagccaggcgtgatgctgagcacctatagtcatgctatttgggaggctgaggcaggggaatcgcttgaacccaggaggcggagattgcaatgagccaagatcacaccagtatacgccagcctggcaacagagcgaaactccgtatcaaaaaaaatataaaaaaaatattaaaaagtctagaggtggccaggcacggtggctcatgcctgtaatcccagcactttgggaggccaaggtgggtggatcacaaggtcaggagttcaagaccagcttgaccaatatggtgaaaccctgtctctactaaaaatacaaaaattagccaggcatggtggcgtgtgcctgtagtcccagctacttgggaggctgaggcaggagaatcacttgaacccgggaggcggagcttgcagtgagtcaagatcatgccactgtactccagcctgggcggcagagcaagactccatctcaaaaaaaaaaaaaacaaaacaaaaaacaaaaaaaaaaagtccagaggcaagaggccgccggttcgatggctctgtgatgtcaggattggcgctgttgtgtctcttggcctcctcttcaggcttgtcacctcatcgtcacacagtgtgtgggcagccccagccattgcttctcgttctaggcaggaagaaaaaaggagaagggctgaagtccacaccagctggacgtcctccccttgacattaggaaagcaaaggttttctgtggattaagaggtgatgacttctctgcatgagaatcggaccctctgttacctttcatagtgtgctccctgggtaacctgaaaggcagcgtgtcagctgtgtctccaggcaacattgcttatggtgagatgctctttttgataaactgtatctagatgggaaaattctaatgcttgcggggcagggcatccagggctttgagcttctcacagtggtgactttcgtgactggcatgtctcttgaaggtgaccctggaagctatgccccacccatggggtgattgtgagagatactggctgctgggagcatgaggctcttagaccagatgggttccacatgcccttcttggtgggagttttgtacccttgcagctgacccatccagggagttctgtaccattgcagctgacccatccaggggcccatgagactagctgtgtgggtgcagtgtggactcccatcagagagtccaggaggcaaactggcgtctgtcttgttcccttggagtagacggccccatgtctagctgagccttaggacactgcatgcttctgaatatctagttgaaccttacttagaagacccagaagcctcttcgacacactgcttatttctttgtggccagagctgtgtcacatgaccagcctctcagatgttagtgttggccagacaatcaaaccctgggctttttatgaaggcagggcaggtctggaatcagccctgggtgcctgccgccacttcccatcccactgcgggcccttccagcctcctggcgtgtccagtgctgaggctgagtatgtgagttcctgggaagcccctgtgtaagggaggagcagctcctccaccctatttgtgtctgagaagttgccctgaagggaaatgttcctggagtattcatgagtatttggtctcagcttatgccttatttcatatcagataattgttgataataatgaaaaaaataatagtaacaatgcacatgataccgtctgaaccctcgttggggcctggtgtccactccctgtgccatgcagcatctctctatttcatgtcgcctggtcaaccaccacgtgaggagtaagtactttcccccgtctgataggttagaaaactgatgcacagtgaggctaaagtcacttgtgtgcagtcccatggctgtgcgggggacagagcctggacttggacccatgtcttggtgcttgacacataaactcgtagccgaggtcattcctccctacccagcatgccttcatataccaggaataggtaagacctgtcaggtgctttctttgagccaggcccagatctaagtgttttaagtatatcaacttaacaatcactatatccacagctcagggagagtgaatcccgggccgaaggtcaccaggtagcaagtggcagagttaggattcgaaccagtctggaatctgagctcatcaccacactgcactgcctggcgaccctcacgcagtgggtgaggaagaaccttcacttagagaagacctaccatgcaggtgccagagagttcagtggaggggagcgttccagatgccagagctcctggccttgtcaggcgcaggatcacagccttctctcagcagaggcattgtgaggaagggcctgccacaatcactgtctgtggaaagttctcggggtctagcgaccctctcagactgggaaggttaacgctgcagagaaaacctccttatgaaagtgcggattgcacagaggatgcactgcctgtcctgcggggaggaatccgaaagcagccaccctcaagatgtcccctcctacaggacgtggtgtctggcagcagcttgagcccaagctgcttagagggtcactgcctctggatgagtatatgtgaatgaccagcttttctatacaggtaaacacgtgctcattaaaaccaaaaggctgatgttagtcccaagcaatggggcctaacagtggcagcttcagtacaaaataacaaagactggtaaatcttactctgctttttgtactttgttctcctcatccaaagctcatacaggatgttttgaaacccaccaccccaccagcagcttgaggcttatgccaaaatgctgccaggccttagggtcctggggtcctttacagcctgtctatagctcatcaacttgcccagctccgtgtggatcatgtggaaggcatggagattacatgccccagacctggagctgagctcacctatcaccccttccttctctcaggggtcctcacagtggtaaagctgctttgttggtttcatacagtgggcacatgggatctgagacttagtttgctcttaaaataggcagttggggtgaacctgttcagataagactcttaaagtgaagacatctcccacctcctcctctttggtgtatttgggtgggggatggacgggaggaaggtcaccctgtgggaccagaggggatgtggcgcattccaaagaggagttatggaaacccagatgactttcctttttctacaaacaagatcatgtttctcctgtactacatgcagtcagcaggaatagggattcgtcgttttaaaatctgaacttttattcactaagtagaagttgttaaagatttctcagaatagtgcttgtatcagaccaagagctgcaagagttaaaaatgagaaatccccacagtacctcttgttctgcctatacatcccagatccctagtccttctgtatagtggaagccacttacatttcttgtgaatttctccaggaatttctcagctcatccataggcccttttccttaaatagacattgcactggccacatggctctgtacttagctttttcctttcttgctagatcttggaaacagcaataggtccacctgattatttaagcggcagcacaggatcggttgagtggatgtgggatggggtattaaccagcccccttggactgattgttgggagatttccagtcagtgcagcagtgaacagccttgtggctacgcctttgtgtttgggtgtgggttcttttatggaggcggttcctggctatggcaggggtacaggccaggagcacagcaactctgatagacacgggcagaatgccttcccaaggggggacagcgtacgctgctgttggtcatgtatgagagttggttacgtatgaggttcccacactgttaccaacactgcatgaccggctgtttgatataagctccaggccgatgggtgcaaagaggtgtcttgttgatttcacgtgtctttcataataagtgaagccaaacactatttcgtatgttcataggtggtttttcttttcagtgcactgccagtttgtttcctgtgctcattcctctgttagattttcacccccagctttattggcgtataactgacaaataaaagttttgtatattaagtcatacaatgtaatgtattgatataagtttacatggtgaaatgactaccacagccaagcgcattaacatagccatcacttcacatagctacctttttgtgtgtgtggtgagaacacttcagatcgattgtcttagcagattactagtatacaatacaggattattaactacagacatttactcatctcataactaaaggtttgtaccatttgaccaatatctccccatttcccccacccctcagcccctggcaattgggaatttgggtgtttcttattgatttgtattattctttacatataaaggaaatgaaccctttggtttgtactgtaaaagtttaccccagcttaccattcttttcttcttcttctttttttggtatgctttttactttgctaaacatgtcatttagtcaaatatatcagtctttttcctttgagcttactgagtttttgaggttagtgtgaccatcacactcctaagattatttttgaaaataaagttgttggccaggcacagtggctcatgcctgtaatcccagcactttgggaggccaaggtgggcaggtcacctgaggtcaggagttcaagaccaggttgggcaacatggtgaaactccgtctctactaacagtacaaaaaataaactgagcgcagcagcacgtgcctgtaatcccagctactagagaggctggggcaggagaattgcttgaatctgggagttagaggttgcagtgagccgagatcgtgccacagtgctccagcctgggcaacagagtgagacaccgtctcaaaaaaaaaaattaattgattaattagttaaataaaaagctgtcttccaggactttggtattattttaaattatttaaataattgatttatctggaatttatcttggtgtatttatacaggaaaagttacattttaggcattttgtcccaatagctagccagttatgccagaactatccaaggaatctttcccttgcaagtttgaaatgctgcctttaccgtacccaaatcgtcatgtgggtctcggtctgtttctggatctgttacagggacggtccattcaggttccagatccaggctgctttatttactggggatttatggtgcattttattacctggtagggctactttcagaccttgccaccatcattccatttcagatttttttcctaggtatttttgcacttttatttttccatagtaactttaaaactagcttgtctggttattcactgcaaactcttttgtttgttttgttttgttttgagacagagtctcactctgtcgcccaggctggagtgcaatggcgcaatcttggctcactgcaaccttcgccttctgggttcaagcgattctcctgtctcatcctcccgagtagctggaattacaggggtgcaccaccatggccggctaatttttgtatttttagtagagatggggttttgccatgttggtcaagctggtcttgaactcctgacctcaggtaacccatccacctcagcctcccaaagtgctgggattacaggcatgagccaccgcgcccgggccactacaaactcttactggtatttttattaggcatgcttaaagtctgtccatttaggggaaaaaatgtcagctttacaacatagtctttctagccaacaaaggatttatctgtccacttgttcaagctcatttatcttcatcggtaaagttttttcataaaaattcaacacatatcttgtttgtctgtttcttgttgttttatcccttttattgtttttgtaaatgctgactttcattatttttcaacatgttgctgtttgtaggtacaaagaaagctatcgatttttatatattaaatttgaaaccattgccttagtgaattctcttattttttaaaaatagatttttagttgttttcttgagtttttcctggcatgcaatcataccatctgcaaacaagaatgatttttgctgcttcctttcttgttttctattacttcttcttgcttaatcagattgggtagaacagaaggaacaattttacataatagtagaatatggcttcctaaaaataacacctttttgaaagatctatgcttttaattttgtcataaaaacttcaagcatatgaaaaaatagcttcagtatttacccattcatggctagtggtatttaatctacaccctgaccctttcccagattattctaaagcaaatctcagatcttacatcatagcctctttaaatatttcatattgtatctctaaaatataggagttctgtttttaaaaataatttcaatgctgttatcacaactaaagttaatatttgtttatgccattaaatatttgtttttgtttgcattttcccagtttacagggcgctgtttgaatggggatccaaacaaaacccgtctattgagattggtcaatgcatttcataattcttttatgtctcttttaggttgtccatccgtctcttttttctgtcttacaaatttttgttggtgttattgtggaagaatctgtcatttatcctgtagattttcctgcagtgtggattttgctgattgcatcttcatggtgttgtttaatgtgttcctctattctctgtgtcctgtaaaatagtggttgtttttagacatagaggcttgatcagattcagtttgattgggcaaaaactttcgtacatatttttgtgttgttctattgaggcacataatatctggtcatctcttttttggtgatattagcaaccattaatgatcattgtctagatctagtaattgattagaagttgccaaatggtggtgttctaatttcatcatttcttcttcattagttagctggaattcttctatgtagagaaactttccctcaagtatttggttaccctgaatattgttcatataagaaaagcagattaaatgcttgatttcttctcttttttgaaaaatttaaaaattaatgagttggctgggcgcagtggctcatgcctgtaatcccagcactttgggaggctaagacgggtggatcacaaggtcaggagatcaagaccatcctggctaacacagtgaaaccccgtctctactaaaaatacaaaaaattagccaggcgtggtggcgggcgcctatagtcccagctactcaggaggctgagacaggagaatggcgtgaacccgggaggcggagcttgcagtgagccgagattgcaccactgcactccagcctgggcgacagagtaagactccatctcaaaaaaaaaaaaaaaaaaaaaattaatgagtttccccgacagcctttaaaagataaccggtgaggttgtgtatgttgttgttagcacagttgatgtgttttgtgtgtgttaccatgattattggtgctcaagttttctatggccaataagagcttctttaggttgttttctgagtcccgtcaatgtgaacccagtagtctttgattgtttcctttctttctggtatattccaggatcatcttaaatatttcttgccccaggtctggaaccagttggttctttctccatggagccctgtgaaataacatttagagactgtaatctgggtagtgtggttgctcgttgttgtagatttggtgagagtgtatatgtctatgtggaaggcgcctcctaaatggcccccaaggacccctgcctcttggtattcatggctgtgagtccttccctccccctgtgtgggggatggacttactgagctgcttctattgaatagaatatggtagaagagatgggatatggcttccaagatcaggttacaaagagatgtggcttctgtctcagcttgtcctttcttgttctctcttacttgttccctctgaaggaaccaagctagcctggtgtggttggcagttgccccatccagaggcccacgtggcacaggactgatgtttctggccagcggcctggtgagagaacttggaagtggatgctcccctcttcaggcattcagatggctgcagcatcactgagtaccttgctgcctgtgacagacgagaggtcctgagccaaagtcacccagctaagccacacccagattcccgatccacagaaactctcagataatccacggttgttgttttgagccactaaattcccgagtaatttgttatgcagccaacaataactaatacacaacatattttttaagatcaaataacgtcatgattcctaatgatactttgtcaggtttataggttctaacatttgtagtttctttttcctgtgccccaaattcctgttctcaaggacaccagcataattttgcattggttttattccattaagcttacagcagtctcagaataacaataccaaacactgccaaggacacatgattgtagatacagattatgatttatttgcatttacttttgtgtttagaatacatcccacaagggatgtacagtcagacaactgtgttttaaaatattttggaatagatcacaactggatacacttttagattcattggtttcatttttctcttagttatttggactttgctttttccatttaattttgttttataattatataaaataattacatggtatgaaattcaaataaacaacacaggatgtatgcaaagaggtcagtttcttcccctatttatccccccacctcccaatttcttcccttccactataggtaaccattttgagcattttacatatttttattgtaagcatgtcttcccctttcttaggtaaatggtagtggattagactcccatatctccatcttgccttcttcacttcacactaaaccctggcggtgatgccacagctctgtgctgttcacaggagcatggagaggatgttctgcagaactccactgtgtggatagatgtctcctgttcaggagtgtttgggtggtttccaggtttttgctattacaaatagtgctgctgcagtgaaccgcctatgcatatgctttttcccatttttgccatttttttttaaaaaaaattatttattatgctttttctgggaagtcattctccccactgcaagggttaggatctgtcttgggcaactctgtgcgttttcttgagcttggctttgaccttccttccctgactctctgttgtggcttctcttcctcccagcatccagtgacttaatcttgctcattgggtgtctaaagttcaacactgtggaacccccaaatcccttttatcagtgacaaagcctgtgctgcaggcccaggtgtggccactccctggtgaatgtcccataggtgtgattttcagatggtgtcttctctttcgtatcagccatattatagggtcaccttcagtgggggcatctcaaggcacaggccctggcagtactggagagtcgggcctggaggccacgccttagctctgcagcagaaggtctcacttgagacgccagttacacgactctgatactcacccactcctgcctcctttccccactccagacctagggggcacttcagggggcaggctctcctgctgatctggtggctcgcctcctcccagtcctgtcctgccccattagagctgcagcccctcctcccagttgaggccaggtcccgtctgcactttggaacctcacacgatctgatgtcgtttgtctcctgtcccttttgctcgcccctccactggcttttgaccacgtctgtcccaccctgcatctatccacaccaccccgctctacctgccccttttctttcacagccggaatctgggagtggcagcctcattgtctgcacctcccctgcacctctcagccccctctctggctcctgccccggttcctctgaaacagctctttgaggtcacgactgacttccttgacactgtgcccaatacacgaggtctccttgtagttggcctcctgctagcatgggtgtagatgggcaggcctccctttctaagccccttcttttcttggtacttagcagagcagagtcctggggcttcatcctgcccccttgcccatgaccttccttgcagactcatccatgcctgcagcttcacttggcacctgcagatggttcattcccaaatctgtttttctaaccgggactcccgagtccagccgcctactgagcatccaggctcctgccactaaacttgcctggaatccccaacccaagctcagtcctcttccaggcaccctttctcagtgaggggcaggtctgtccatcgagctctgcaaccattgtctagcgtcctcatcttctctcagactccagtccacctttccgtcctgttgatggacccctaaatccccatctgttgctgtctctccatttccgttgtcaccctgtccgtaccatcatcaccactcatgtgctgggatggctacagtagcctctcagctgctctcccttcttcctctctgctgcctgcccctctgccagagttcatttctaatgaaggagtggttgggccacttccctgatggataccctggagtgacagtccttatggcctgtcacccgtggccccagggtcctcacatctggccagcgcttcctccccaccctcgacttgtctcagctgctggcccatgccctaggcctcggcagtccagacatcctatagatcttctaaggtgtcattgtctctgcaccctagggcctttgcacctgctcccgcctcagcctgggaggctttctcctccttttgccttatggcttgttgattccttctcctcctccagacctcagcttaaacagcagccacccccaaattcctcaccagagcagcctccctgtcccttccttcccagggccatagcctcccttttgagcattcaccatggcccatcctgatgcatttgttctgtggctgtgggactgatgtcagcctcactgtgtagcctgtgagctccatgtttctgtcttaacaccggtctttatacagtgggttcagaaatgctgagcacctgaactcatgacagtgaacttgggcaaagccacgtgacccacttagatggtccttatttgtaaaattgggaccctgagattgcttcatggcgtggttgaggactgggtggaactgtaccattgttgcacagaggtctggtgtgttgggcatgagggctgcactccaagactccgtgcctttgcagagagcagcgggccttgtggatgcacccccacactcccacatacacctgtgctccagctccacccagccacctcctcccagacccccaggatatacagggacaggtcttggagctaatgagaccccctggggccacactggcaccttagaagcctctgtccaccacccatgttcaggataattttcttcaaaggtggcaggagtggagaccctcaggcttgaagctgtgggactcccctccccttccctctccagagggcctagggttttcctaagcggtgtttcaaacagaggcttcctctggcaggggagaacctggagcgccttattcttctccagactgtgcagatacactgtgcatatgcctatgtgagtaagatatacggtgtgaaaaggataaatcactctctggggagacaagatctttaaacctgtatcttgattatcttgtcattttgtctccctctggtggtctcagcttagggtcagtgcaagacttgagcaaaataacagcaatttctacccaaacatgtagggctagctgctttcattttctaacgaagctgttagatttgggttctgcgtttcctgcggaagttgagagctgtgcccatgaatctgatatactccccacaccatgccgcccccactggactcttctctgggtctgggttctcctcccgtggtgcgtgtgagtgggaggcaggatgctggggccaccttggactcgattgtttctcgctgaacaaaagagcaaggcaggcatggaaggcccccaggcagaggtgggtggtggctggagttgcagcaaggcccttgagtgcttcactggcctcatcccggaagcaggcatccgtgggtgccagtggtgaccccctgcctgggatggggcatccttcacacacagcagtctgtgcccagatgggccccagagctactgacgctcacttcagggggagacgaggccagtctttcccaaatctactcaaggacatgggtcaacatggaaatgtgaacctcagaagggtctggtgcactgaccagggccaccctgggggctggcgagggagaagccaaggggcagtgcctagaaaggtaggagtcagattccaaagggagggctggcctcccagcctccccagggcctggggctgacagggtgccaggcagcccctgccacagaggggacataaggacactcgcccaaggccctgctcacctgctggggctgtgaggctggggtacctggggcgcctggaagaaccagagctttcctgcagaacaaagtgacgccatctagtggtcaatgagagccactgcattgggccccactgggtgactggggcttcactggggggtgcctgttgagccatgctcactggggacggcaaggtggtgtgaggtagtagaaacaggcctacctcaggcgctgggagccttcccagccccacagccagatgccataaaaggcagcacagggcatgtctggcgagcctgtggcagccagggctgtcatacacgctctccaagccccccagctaggcagatgtgcacacttcactctgaagaagcgccagggtatggtgggggtactgcattgggatagatgggtcctgttccctctgtggggctgcctctgattctcctggtgacaggagaatcccggtgtaccctctgagagacaggtggacaggggttcctcccctggtgccacccctgaatcccgcagtcccccacattggtgcctgcagccctgcccagctgggagaaggtttatcggctccagggcaaggggtgaatggaggatatttaaaagccgtgggaggaccccattgataggactcagttagatgcacaggggagggatgggggtccctgtggggagagacggctgggagcacaggtgatcctctgaccccaggggcacgcagacccactactgcccaggaaagcaggaaggagggccaagtgggctgagcaccaacgcgaagctccccacttggtctgtctgagcaggtgagggaggggcagccaggagtttgaggcagtggaggggtctgga

SEQ ID NO: 165 - DNA, 38746 bp, Homo sapiens
acatccaaaactgatattagccattctgaattggactgtcccatcaaatgtggtcttgcagctgtccacttgtttaggagtaaggagttttattggaatgaatgttctcagatattaatcaacacagtacctccctcccttctcagttccagctgatgctgagacaccaatggcaaatcttgatccatgcccaccccaggaggatgagcgacagtcaggattttgggccacaacacatgcagcttcctgcagtgtcctcttctccagggtgtgctgtgggaaggcctcaccagcttgggcaggggctcagctctcacgggacgaggcagctgagtagctgatggcagggcctggtggggggccggggacgacggcagagtcatccactgccactctggacaaaggccaaacctgtcctggatgccacctagttgctgccctcttaacctgaccctctggcctgcctcagaccttataatttcctaagcacgtctgcatagactgttatttagtcttgccaatgaccgcgagggagctgttatcactgccaggcatcatgtccagtcctcacggctggccataagaagatccgggcctcacctgggcctcccatccaagccccaagttctttcctcccccagtagccagccagagccaccaaccctccctcaagccatgagaggaagcagctgtgatgagcactgagccctcaaccaggagccgttgaatgaacaggtgtgaatctcaaacacaattttctgcaaggtcttctccactcccaggcccagctgtatctcttacggctgagggatcaggatgactttgctgcggcctcgctggaagcatctctctagattgccacggaccaggcagtctagagatgaggaagtcagaggctccacagacactcagatatcatcagatcccctcccaaagggagaagaatgctctgttttattttattctatttaactttgttaatttaatttttagaggcaggatcttgccctgttgcccaagctggagtgcaatggctcgaccgtgggtcaccgcagccttgagctcctgggcttaagagatcctcctgcctcagcctcccaaagagctgggactacaggtgcgaaccaccatgtctgctagttcaatttttttttaatttttttttttttttttttttgtgacagagtctcactctgtcacccaggctggactgcagtggcgtgatcttggctcactgcaacctccacctcctgggttcaagtgattctcctgcctcagcctcccaagtagctgagatgacaggtgtgcaccaccattccaggctaatttttgtatttctagtagagatggggtttaaccatgttggccaggctgctttcaaactcctgacctcaagggatccacctgcctcggcctcccaaagtgctgggattacaggtgtaagccaccatgcctggccaaaaaatttctttacttataattttttgtagagatggggtctctctatgctgcggaggctggtctcgaactcttggccttaagagatcctcccacctgggcctttctctgactgttcagtttgatacacgtggaaccaggtttgcttgcaccctcctcaccgcttctgctttctgctcctcccaaacacatgaacatattcagatatgcatcaacgtgcacatatgccaacacgtgtgggcacacacatgcaagtgcacagacacacacacacacacacacacacacacacacacacacacccctggacacacacacattgttttctcaaaatgacttttggcagcagcaaagccaaacctttccaaaggccgaagaaaggccttcatttgcatcacgttaacttggggggctgcatctcctcccctgtttttagtacaaaacatgagtcaacggttcaaccctcaccccagcaaactaattagggtcaatgtgattaaagggctcagctctggtgcaggaactaggatccccagatatcctgaagaacttcactcacagtctctttcctaaggtttgtgccctaaaacaaggcactgactcactgtgttcagctcttaataacctcaagaacctcccttcccagctgggcgcctcttccataaaggggttaccagaaaacaagaagcaacacacaaagctttcaaaagcgaaacggcgaggaatgtagtgcgtgtcagcgagtcaacgaaaataagaaagggacctgatgtcaagcttgacacgatcattttaatttccgcgtactttttgggtcttttcatgttggcttcatggaaatttatgtttgctgagaagactgtatttgctacaggatctcgctgtgttcatttagcctggtaataaaaaccatctgcctgaaatcctttttggaacaaggaggggtataagcaaataagcaaatggtcataaaagatctggagaagggtggggctgtgtcaggaaagtggggagcctggagtacatgcctcgggagtggcgactgtaggaggccggggactactgaaggtcatgtgtgaggctgtacagctttcccagtaaatatggtgcatgttgggaggacaggtgcatgtggacaggccgcctctcttcccaagcacccgctctgggctggggtctcaccactggagtaagaacagtatcatgatgcattaagtgaggagtccttgacgtgggttgaatagtgtccctgcaaaactcacgtccacccagaacctcagactatgaccttctttggaaatagagtctttatgggtgtgattaagttagtatgtggctgactgcggtggctcacgcctgtaatcccagcactttgggagcttgaggtgggaggattgcttgaggttggtagttcgagaccagcctgggcaacatggcgaaactctgtctctaaaaaaaatgcaagggccgggcgcggtggctcacgcctgtaatcccagcactttggaaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtcccaaaaaaaaaaaaaaaaaaaaaaaaaaaatgcaaaaattagctgcagggcatggtggcgagcacctgtaatcccagctacttgggaggctgaggtgggaggatctcttgagcccgggaggtggaggttgcagtgagcagtgattgtgccactgcactgcagcctaggtgacagagcaagaccctgtctcaaacaaaacaaaacgaaaaaaaggtaaagatgaagttatactggcttccaatggctgctgtccttacaaaaaaaggataggcatggaagaaggaagacagccacgtgacgacagaggcagaggtggggatgatgcgactacaagccagggaaggccaaggagacctggagccaccaggacctgggaccagcaaggaaggggcctcccctagagccttcagagggtcgtggccctgcaggcaccttgattttggatttccagcctctggagctgtgagagaatgatgttctctgtaggaggaagctctctgagtccccctctctgcctgggagctctgagccactgtgtctttgtggggagagacgagtcagacaagatcgcaaagaagcatctcaaactcttggcctttaaagcaggcattgaagaccatgagcaggacagaaccaaccctgagaggatactgttgagcacgtgttttgtttaccggtttgtttttctgcccgcccccggggaggaggtcgagcctcctggactcaaggaaataaaagggcagcctcctggagagcagctgtgaggggctgtgagaggggccttcgtcctgtcctggtctctgggtccaccccacagttgggggtgtcaccacaggagtcctgagctggggtctgtgagtagagagggctgctcttctgccttccctgggaggcagggcacggaggagaaatggcaagacacattaagctttcttaatgtgggttctagtaacataggtttttatgttctcagcaagacagggttcttgtaagccaggcattggtaagagataatcttcaaggttcctttagctctgattaccatataaagacctgggcctgcaggtctgatctttgaggttcttataatccagaaaactcaggacactgcatgccagtgtcagcttcaaggagcaagggaagctcagttcttccagtcctggggcacgaggaggaggagggaaggcgaggaagggaagcctagcggccgcacacttgtcatagtctctctcacagctaacattgtggagcgggagcctctgcaaaatgggctttttttctgccccctgcttggaatcattggaggaggccccatttcagaatgggagtgtgggtgggtactgaaggaacacatgtggctggaggaaggtgggatggatgagcacacgctgggattcctcacagccttcatctcctccatggtgtggaggggacccaggatcctcatgtgttcccaaagcaggtatagagtggctgggcaccaagtcctggctgggagccagtggatgccaagagcccacttttgccaggatgggttgggaatcccactagatcttggggggatcaccatggtggacttgctcacacatgagagcccccaagagcaggacctcaggatcttctgcggggacatcaactggattcgcaaagagcccacccgtgctgggtggacacctgctgggcagcagaggctgatgtcggactagcctctggcacagaccgggagaccatcttctctcccagcgggggactgtgagatttcctgcacactggtcgccatgtaggatatgatgccagggaagagagaaacaggactgacgagagtggtatctacaaacaaatatttatctaataaggcccatttcaatcaaagaagcttgtttcaaacagacagggctgagaggatattcctaacaaattaaagtcccctgggctggccgtgggagagggtctcacgaggaggagaactaaagaagctctgtggtccctgcacactggcatgttcgagagaatctgaactgttactgccttggcatgaaaagatgattgttaggggctgaactgtgtcccctcccaaatttatatgttgaagtcctggcccccagtgccttagaatgtggctgtacttggagatggagtgtacaaagaggcgattcagttaaaatgagttcgtacgggtgggccctgacccaatctgactggtgtcctcccaggaaggggagacgagttcacaggcacatgcagggggatgaccctgggatggcacagggacaagacagcatctataagccagggagggggcctcaggagaaacccaccctgtgggtgccttgatctcggacttccagcctccagaactgtgagacaataaatgcctgttgtttaagccgccctgtctgtggagctttgttacaacattcttggcagatgaatacaatgattctgctcaaggaccacaggtcttcctgtgcatccccgtagacatctgtatccagacgaggaccacacaggaggcctggatgttcccaaacttccctcagatgcctgctgttacctgagttccctgggtggaggaacaaatccccccacacagaaaggggaaccagaggcccagcacggtgcctcacgcctgtaatcccagcactttgggaggctgaggctggtggatcacctgaagtcaggagttcgagactagcctgaccaacattgtgaaaccccttctctactaaaaaatacaaaaattagctggacatggtggtggacacctgtaaccccagctactcaagaggctgaggcaggagaattgtttgaacccgggaggcggaggttgctgtgagccgagatcgtgccattgcactccagcctgggcaacaagcgtgaaactccatctcagaaaaataaataataaataaaggggaaccagaaagtctgattggatcaagtttatcctgaattgactgaattttgtttaattgtcaagtttaagaactccattatggggtgggatgaaggcttgggacagaaatcatattcagttatggaaaagggaatctgaaattttttgctacccatttgagttttgaagtctcaggaaatcacactgacttcatcaaaaaagcaggtgctgccatgcacattcgatcaatgcagatgctgatgtttacaatgagcagttgcagcttccctcctgacagcctggagcttggggctagagcccctggcccacaggctaagaagcaagggtgattttacaacccatgcactgagttagagagtgttcttaccccacgaagttcttgtccactcagaacctcagaacgtgaccttatttggaagtagggctgtaggtgtaatgagttaagatgaggtcacagtggattagggtggtccctacaccaatgccactggtgtccttataagagcagaggagacacagggggaagagggctatgtgaagactgaggcggagattgcagctgtagggcagggaatgctggggatggccaggccccactggaagttggaaggggcaaggaagccttcttttctagagcttcagagacagcatggtcctcttggcactttgatttcagaattctggcttccagaactgggagtaaatttcggttgttttaagccatcgaatttgaagtactttgttacagctgccctaggatgctaatatactgtgttataaaaatcagggtttctgccgggtgcagtggctcccaaaatgcctgtaattccagcactttgggaggctgaggaaggaggatcattggagtccaggagtttgagatcagcctgggcaacatagtgaaaccccatctctacaaaaaaatacaaaaattagctgggcatggtgatgcacacctgtggtccgaggtacttgggaggctgaggtggaaggatctcttgagcccaggaggctgaggccgcagtgagccatgatcacaccactacactccaactagggagacagagtgagaccttgtttcaaaaaaaaaaaaaaaaaaaaagtcagggtttctagagcctgtgctctatctgaaatgatttagaagcctttcttctagggacgaatccctccaaatttagaaccaggcaggagatttaggcacaagagcatcccctgctcccccttcctagtctaaatcagatgacatggacccctgagagcgaatgcttgcaaatcactcaggatacccgcccagccaatggagaagaaagcagaggaaggaaggaaagaagggtggaaggaaggaagggaggaggggaggaagggagggaggaagggagggaggaaggaagggagggagggagggagggaggaagggagggaggaaggcagggaggaaggaagggagggaggaaggaagggagggagggagggagggaggaagggagggaggaagggagggaggaagggaggaagggagggaggaaggaagggagggagggaggaagggagggagggaggaagggagggagggagggagggagggaggaagggagggagggaggaagggagggaggaagggagggagggagggagggagggaggaagggagggagggagggaggaagggagggaggaaggaagggagggagggaggaagggagggagggaggaagggagggagggagggaggaagggagggagggagggaggaagggagggaggaagggaggaagggagggaggaagggaggaagggagggagggagggaggaagggagggaggaagggagggaaggagggagggaggaagggagggaggaagggagggagggaggaaggaagggagggagggagggaggaagggagggaggaaggaagggagggagggagggagggagggagggagggaggaaggaagggagggagggagggagggaggaagggagggagggagggagggagcgagggagggagggagggagggagggaggaaggaagggagggagggagggaggaagggagggaggcaggcggcaggcacacgcacacaggctctctttgctttccaacaggaaggggctcagggtctgttttcttttcccttcctttcagatggatctttcatatctccaataactcttatctttcagcaaactccaacaggccccaaacgagctgagaaaatatccaacttcaaaggttttgcacaaatcatcttaaaggcctgacctaagcccggaaagccggaacgaagcccagaaatcagtcctcatttcatcgccgtttagccaagacacctttcccgtccacagatcacatctgcccccttctgcccccgcccaggtcccaaccaccttgagacacctgcgtgatccatcctcaaagcaatgagttaggagccgcactcctggtccttggccggtggcttcagtgttattccggggggctgggtgggggcacctgtggggactgccccgtgaggctgtggtttaatttcctttgctactttccttagctcttcagtctcagtctcagccactgaaatgtgtcttggccactggtggtacagcacagggtgacactgttgtcagcgagaggaagatgctttttttttttttgagatggagttttgctctgttgcccaggctggagtgcagtggtgcaatcttggctcactgcaacctccaccgcccggggttcaagcgattctcctgtctcagcctcatgagtagctgggattacaggcacccaccaccatgcccagctaatttttgtattcttagtagagatggggttttgccatattggccaggctggtgtcgaactcctgacctcaggcggtccacctgccttggcctcccaaagtgctgggattatagacatgagccactgcgcccagacaggaagatgcgtttgtgagccgggacaattgtgagtggaaagagaagaaaaaaagtaaaataataatactaataatgccttttctctggtcctggaagatctatatgaacttgtattttacatctcttgtctggatttagctgtgaaagaccagtagaccaactggtgggaaaaatacttgcacggcagcaggttgtttgaataaaataggagatttccagtctcagattggatacatgcacttaatatcagcagacttgttgtgagtataagcctctataaactgagcactgttgcaggcgatggggacgtggaactggtaggaccgatggctaagctctcttcccctccaccctggaaaaaatgaacataggatctggctgtggcagacagcagcctacagaaaggtgggggcacctctcagctggccttcagctccaatacagacacgggaaaaccagtctcagttcaggtctgggccccactggctgcgtctgcctggacaccatcagccctgcacgaaggtggccgctgaggggccctcatgggggctgaaattcaaccaaggcttgattcctgcctgaggtgccaggaacctgtccctttcttctaggtggttcgctcagcaagggtactttttgtaattcagccacccagatgggagtgtcctcttgcactccatccatctggatgaagcacctttattttctaatttggccagtttcagggcacatgacaatcaccgatatgacagaagggtaacctttctggggttgcatcttaggaaatttcattgaaggaggagtagagagatgatatcattgaccacaggactcaagaaataagcccagagcacacatcggttttgtgggggcaatgaaccccgcaactgcgggaaactgaccttcagcactttgatgtgaatggggccattgctttcagctttctccaaggtttttgtttgtttgtttgtcggtcttactctgtcgcccaggctggagtgcagtggtgtgatctcagctcgctgcaacctctgcctcctgggttcaagcgattctcctgcctcagcctcccaagtttttacttgaaacctgcatacacacagcctttttgttttatgggctgggttcctacagagagttatgaatggaggattgagtgcatttaggctattagtagaaagtgatcaagattagaatagagtggcttatctgtgtttagagtctctaaagttgttgcagggggcttgttgcaatgtccgtaccagggccccaacccagacctaccgaatcagaatttcaggaggggaggttaggaatctgtggttttatgtcagcccctgttccagtccacgtgactcttatgcatcatgatgttgagattcactgatttagacacgcagacaataaatactgattcttggactacagagccaaagacaaatcgagtgacgtattctagctcatggagccagctgggcaaagccagcagggatttattgctccttagatgatcaatgctgcccccagggctgctgtcatctcctgatgacgagcaacattttcacaacatcagggggctggtggagaaaatcggggggtctccggagcaaccccgggagcagtactgggcccagaagcctgccccagccgcgcacacagagtctacctgtcttccaatgcgagtcccgcgaggtgaagaattagagcatgttgttcatttataatgtttgctttgcttttggaaacaccctggggcaactcaggcaaggttttcaatgtggtgtttgacttggcttagctgcaaagttccccctttttggtctgtttatggcaagttagcacacggccccatatccaggagcctaacaccagccccagcagaaatcagggagcgggcaaggaagtgaaacattgggagggctgggttgggcttccctgtacccgccctctcagccgggagctcgcctgaggtcaggctgggcaccaggccacctcagactttgcagcctcggacctgttactgcagcccgaataacagtgacgcctcggacagtgacacgtcccgctgaccaaccacagggtctggaggataatttcccaggaaagagatacattccattcatttttttaaaattttattttaaatttagacagagtcttgttctgttgcccaggctggagtgcagtggtgcaatctcggttcaccgcaacctccacctcctgggttcaagcaattctcctgcttcaacctccctagtagctgggatcacaggtttgtgccaccatgcctggctaattttagtatttttagtagagatgaggtttcaccatgctggtcaggctgatcttgaactccttgcctcaagtgatccacccgcctcggcctcccaaagtgctgggattataggcgcacgtcaccgtgcccggctgatacattccattctttagctccctctttcttacatattttcttttctttttacaaagtcaacccactttcagtaggaagttgccgattctttctcatgtttacttttgagtttcaaatagacaccgccttatcttttaataagacttgctatcactgtgccagccactccatttacatcatttcatttcatctgcacagaactctacgcagggggtatgattagatcgcatttaatgatgagaaagcaaactcggagagcttaaatcagcggcccaaggtagcccagctaacacccggggggtgcggctcagccgcaggtcttctcagcgatgtggttgctgtctgcctggctaatggcctgccacatcctgaacccttcaatgtcaccctcatctttccttctctgccttagaagagaaaaggatgatggcttatctgagggctgaaagatttcatccacatcaagccccatttgcatgaaatgtatctgcccagtttatatcagcaacatgaagagcaaagaaaactgcctgtttatattgccacatctgcagggcattgaaatacattattaatgggagtttcagtcaatatctcacttttttttttttttttttttttttttttttttttttagaaaagtgaaaccatgattgggttacattagtgtgagttgtagaaaccaggttaaatctgacctttgggacatggagacggtcatctgacccagggcgggtcacattcaaagagcacagacaaggtccccctgaagtcagtgggacatttgggcctgagactatgaaactgaactagaacttatgggctttagggaacaagcccaaaagctcctaaatttcctccttgaagatctcctcgctactgtttttcttctagatattctgctgctttgacaggtacgccaccccctgtctccaaactcacacgttcaacccagtgatgggtggagactgggaggctctgttagtctctcttttcagtagcctggccctaaattaaagggcccatggttttctctagttgaacacaccccaggctcccagccagcccctggccctcgagaggggttgtttttgatggcaggagggagataaaagtgaatgtattttaggatcttgttactaggccacaaggaaacactggatggaaagtcttatgaatttgaaaagaccttttttttttttttaaatcaaatccaaggaacccaaaaggcgttaagctattgtttaaacatagacccagtgcccaaaccctgcacactagtttgtagaggttggaagaggcaggatggaaggggttaatggtgctattctttcttgaatattctgtaacacaccacaatgagccaaaagcagtcacagggaaccatcatgaggagtagcatgtttttacctatgttaactccaacatccgcaatagctgaaccttagaattattatccgaattgtgcataccaggaaacaacagatttgatgagtttaataacttgtccaacattacaaagttagcaagaggtagggtccagaaatgaacagcgtcctttcttctgcaggctggctcccatgaaatactattcttatgcctgttgaggtctgatgtggtatcacattatactactggaccagctagggggtcaagagcattatgccatctctgtagtatgcttaggggtcagtcctgaaatgagcagagttcactttcagccatgaaaaggatattccgaggaactgatatcttagattgctttcttttagtgcatagacatcacttgagaggcttcatgttactgagacatcttgtaaactttacagctactgttttacacttcatcagcattcctgatcttattatggtgttcacttcaaataatgttgggtgtgtaagaatcaaatgcaaattgtacagtatttgacacggatgtctttaggagccaatatttccttaaatatcatggtttcagtgttatccactaatgctttaatagatagggtttctttgcattcataaatggtaataaagatacgagttgtctactataaaaccaaacacttatatttcccaactactaaaacatctatgtaatcttgaatccatctgacctaaaggaaggaaaatgttctcaacccaggctacacattagaacacttgggaagctttgaaaaattcttaatgaatgggccccactcctagaccaattaattcagatctctgagaagtgtggtctgagaactgatggtttagaaaactgtacagacagttctaacatgcagccagcttgagaactactgggtttagacaagaatggatttttttgttttttgagatagagtctcactctttcgcccaggctggagtgcagtggcacaatcttggctcactgcaacctctgcctcctaggttcaagagattctcctgcctcagcctcccaagtagctgagatgacaggtgtgcaccaccattccgggctaatttttgtatttttagtagagacagggtttcaccatattggccaggctggtcttgagctcctgacctcaagtgatccacctgccttgccctcccaaagtgttaggattacaggcatgagccactatgcccagctaatatggtttggttctgtccccatccaaatctcatcttgaattcccatgcgttgtgggagggacctagtgggaggtaattgaatcatggggccagatctttctcacgttgttctcgtgacagagatctgatggttttaaaaatgggagtttccctcacaagctctctctttgcctgtcgccatccatgtaagacatgacttgctcctcttttctttccaccatgattgtgaagcttccccagccacatggaactatgagttttccatgaaatctctttcctttgtaaattgcccagtcttgggtatgtctttatcagcagcatgaaaatgaactaatacaccagccaagaatggatttttaaattaatggagttaggtctgattaatatcaatgcattaatgtataaatgtctacattatgcattacaataaacagttttgaatataacacaactaaaatatatgcaatgaatacaatacatacagtaagtcattagcttccaggtataagtagatgctcaataaatattactgagttactgaatgaatggcatcctacaaagttttatatgaaaaattatattttgatgaaattaagatgccatcaattgtaagatgtagtatcactgataaagaaaatagattcattaaattatgacatgctatctagtatgtcacaccctaacttcaaaaatgttaaaaaggccagatgtggtggctcatgcttgtaataccagcactttgggaggccaaagtgggaggatcacttgaagccaggagttcaagaccagcttgggcaacatagcaaaatcccatctatatgtaaaaataaaaaaattacctgggcatggtggtgcacgcctgtagtcccagctacttgtgaggctgaggtaaaaggatcacttaagcctagaagtttgaggctgaagagagttatgatcgtgccattgcactcaagcctgtctcagaaaaaagttaaaaacaagaaaaaaatacaatattttgaaattactgtattctctttttctgcttagtctaggccaactgttataccattaacttccactagatgccgctgtgacctgctacttcaggttccgaaaggcaatctgaaagccaattttctccaaggatttaaaattgaaataattcaccccctttaaagacaaaagatattttaaccacctcatattttagggggttgtggctcattctttctttgtgttaagacctatctgaagtatctcatgaagtgtacaattatttaaaaaggaaactgaaaagttttaatggcttgatagaaaacaattgcttcccttttatccacatccccaaatttcacattttgcgtgtaactcatgactagtctgcagtgggttatagagaagagatggtaacactgataggaaggctgatgttgacttcaatgaaataagaagtaaaacttgaaggaaagagtatgacatcttctgatttgaagacagcagatcatggtaccctgtacccatgagtcactgctcccagagataggaaaagctgggtggaaaagaaaatttgggctgataggactgggtcctgagcttgaagccaagcccagtgttaaccctgggcattgacccaggccctccctgactgaaaatctggaagattttccctgctgggtgagaatcactttttcagcaaaacaatacaagctttagggccaaaaggaagcccatgaagcttccagagacgtgcttagagcaatgctgctcaaattcttaccaatctccactatatgagaacagaaatggacagtaagtatctcaaaacttgtataacaaatttaaacaggtttacgtctgctaaatctaataaaaagaaatcaggattgtatttcatatgtctttgtttcatatttcatttttccagtaattcaattcttttagtattttacaaaagtattggtccataatagattggaattttttaaaaaatagcccttcagcccagatagcttttgaagcactgcagacagcccaccccaagctgctggaggaggcaattccaggacgatgaagccatcatactcctgaataatgttctagtagaccaaacagctaagaaagggctgaagaacaggagcacttagatgataaaggacaggatgactggagagctaaaaagaaatcctaagaacagaacacctcggggagtcccagcctctgaacccacagtcagcagctcaccagaacctaacatttctgcaaaggctcagagattccaccattgccactcccagcagttcgcctgcccaatgtagacaatcagcctagcactgactttgggacaagaggatctcaggtggttacagtgaaaagaaaatgcaaaaccactcaggattgcccaagtctgacatatttaggttcagaagagaaacacacagagaggtccattgttaaccccttcctggtttgatccacccaaagccagccggcttggatggaggggaggcgtaaggcactgtggacttccatttatgggtaactgtgagctggcttttgtcttctctgaaaaatgccctgttacactagcatactgtcagtgtcttttttggatagccatttggtaatatctatcaaaatgtaaacagtgaatactcttcaactcagctatttctctgctagaaattcatcccccagttatactcctaaagtaagcaaagacataaataatacaggattcaatactctctggctctttctgagagaataaaactggataaaatgtaaatgtcctttataagagattagttacataactacggtacatccacacagattagtatgcaccattaaaagattaaatgcttctgcagttactgatatgcaaagagttccaagacacaatgttaagtgaaggaagcaagttgaagtgcagtgtgtacagcatgatcctatttgtgtaaacaagaacaaatgcagtcaggtacggtggctcatgcctgtaatcccagcattttgggaggccaaggcaggtggatcacctgaggtcagaagttcaagaccagcctgaccagcatggcaaagccccatctgtactaaaaatacaaaaattagttgggtgtggtgatggatgtctgtaatcccagctatttgggaggctgaggcaggagaatcgtttgaaccgggggggcggaggttgcagtgagccgagatcgggccacttcactgcagcctgggtgaaagaccaagactctgtctcaaaaaaaaaaaaaaaagaaagaacaaatgcatttctgtcatgcagagagaccttctgagggctgcacaaaaagccgttcacagcgatcacctctggggggtggagccaagggtcaaggtcggggaggactttcatttttaacttcacactcttgtatgtggtctgacgttttaaaaagcaaaattgtatcaatttaatagggagcaaggtatctattgcagagcatcaagagttacaagaggccaggtgcagtgcttcccacctataatcccagtgttttgggaggccaaggcagaaggattccttgagtccaggagtttgagaccagcctgggcaacacagcaagaccctgtctctaaaaaaatgaaaataaaaaattacctgagcatggtggtgtgtacctgtagttctagctactcaggaggctgaggcagaagggctgcttgagcccaggagctcgaggctgcagtgagctatgatcacaccactgcactccagcctgggcaacagaatgagatgctccctcttaaaaaaaaaaaagcactacaggaaatggcagcaaatatcagtcagccaaagacacaacctgacacaagcggctgcacaaaatagtagttgcccttaagctcaagggacatcaacaaggaaaaaacacacaactcccagtgttctctcaacccatggctgtgtatatcttttagtgatgagccttggggaccccataaaacccagaggaacatgtggcagaggacccaaggcttccagggattgtggccatcaccaggtgagaaagcccagagacaaccgcttgagtgtttaattactatgtgaaaatggaatgagagggaaggaaattgggtttggttacttcaataaaaaaaggttgaccggacgtggtggctcacacctgtaatcccagcacttcgaaaggccaaggtgggtggatcacctaaggtcagaagtttgagaccagcctggccaatgtggtggagtcccgtctctactaaaaatacaaaaattagttgggtgtggtggcacgcacgtgtaatcccagctacttggcaggctgaggcgggagaatcacttgaaaccaggaggcagaggttgcaatgagctgagattgtgccactgcactccagcttgggtgacagagtgagactccatctcaaaaaaagaaaaaggttgcctggccctggttcataagtagagggagtgtcttgtgtcttgggaaccagtagcactgttaacatttacaaacgggacacacacatttcctgtttaattccaccctgcacagtgctgattcactatgataccattggtctcagaaatacttttcttaaaagttgtatataattaccacatatatacacataaataaaaatatacacacatatatgtgtatacatgcacacacacatacatatcacactctgtgctctcagccagggagagctggggaaggagattgtctttggagtccttagcacattacactatattacaaatgctcttggccgaagagtattctcagtgctgtcctgagttgtgttctgcaaaatgcactgtttattccactgtgatcttcctttctgccactcatttcatgttctagggaacagttttgactcacagttatgggtaaaaggtgtttgagtgattgttctagactcaccctaaagagaccaaggaagaatattatgccaagtgtcaaaaagctactttccaggcagctcaagttgccttcatggaaatgatgaaggaagcagagggtgaagtttaaggacaggtggaaatccttcacaatcctatcgggcatcattaacagcactgtaaggctgggagagatgaccaaggggatttgaaaacagcattagggtaggaagccggaattaagcttataaagacccatagagcacgcagtccttctatgtcatggcctatctgacagatgcgttggggggccccggagagccaggagtagtgggcagagggcaagcaagcacagagccatcctctacagtggtcagagggcaagcaagcacagagccaccctctacaaggacaccggagcactgaggccattgctcttgggaagaaaccaccgaggtttctgttagccagggtgggccagctgaatgtctgcaacatcactgaaaacagtcacaagttggagagacaatggtctttttagcactccccttgggggaagcagtgtgggagatggaaggttctggagtaaggggttatgcctcgaggggctggcttcaggacattgtcctgtgggttggtaggcgtccttaattgtggggcttttgttttgctgagaggaggctgcaagtttgaggcaaaaaatgaattctctggaggtaaagaagccgctgaggctgctccccgctggccctttcttcctgctgggcctttcctttatttatttagagtactcagcctttcctctaggtaaatattgaaagaatatataaaaaccaatagtttaaacagtgtcaaattattatcctgtctccacctggccctgggcatggctgcggtgtgtattgtgctaggttctgactctctttggttgagcaggaggcggccctagcgccacaggtggagatggctgcccacctgctgtgaaggcacttccggtgtccgccatcttgggagcagctcagaccggaaaccacaggctggagaacgcaactgggaatggaaagcaggagtggctctttgtgttgctttgggctgaattaggagaagggtagatgtttggaggtggtgttggctgcagggaagaaggagttagaatgggatgaaaatttttggcccagagaaggggagcagtggttgttggctgaggcatttattgaaggattcccatggagaagatacatatggttgggggcagagtccctgttgagagggagtgctgccagttccatacagaaattccttctccctgacaaccgcagatgtcttagcagcattgcttttattttttatttatttatttatttttgagactgggtctcactctgtcacaggctggagtgcagtggcgcaatctctgctcattgcaacctccgcctcccggcttcaagtgattctaatgcgtcagcctcccgagtagctgggactacaggcacacgccaccacacccagctaatttttgtatttttagtagagatggggtttcactgtgctgaccaggctagtctcgaactcctgacctcgtaatccgcccacctcagcctcccaaagtactgggattacagacgtgagccacccgcgcctggcccagcagcattgcttttagactgacagcttagaaaccaaaagtctgtttactggccacctacacaacctgtcaatccctaaacaacctgaaggtttagtgccctaccatagacaccctgtaacccattaagaggtccagcctttgctacagcaaatggtgtaaactcccacggcccagttatgtccagggctcagttgggtttttggcctctttatcctcaaatggggaaagcatagctctgggccagtcaagcgctgagctgatccaagacattcttccacccgccagactggaaataccggaaaagcggtggcagctgccctcagaggcagtgtcagtattttctttccttttggccagttccgttttgactagaaactggaatcataattataatgctacatgtttacagattttaagtaattgatcccttggagtcctcttttgggggaaaagcattctacccacctcatacatcaggaaaacaagaggccatatggtttggctgggctgggtggtctctggtgtcagtaggagagtggagactgcggcttcaacagttcttgacttcttggcttgtgtccagatctctgggccttgcagcccctagaaaggtgacacatgagaaaccgaagtggaccagaccataaactctcaggagcagttacctctagagaggagggcaggcctcgtggccctgcctgtgcctgtttctcttggagggacaggttggagaggaggaaaaccccttactacaggagtgtttcacctacctttaattaccagttaaaacaaaacattctgtaatgaaaattccccttgaaagaaactccaagttgctgtgaaggtttcatctttcccttttgaatcccaaggtctgcagccatgtaatccaatgttggtctggaaaaatatctggctacagaaaaacccacatggggtgttggggacgccagtaaagggcaggaggttggatcttgtacagtagcccttagcaaaatccttcaggtcaagccctggtctacttattaagaaccctcttaacccttttaataagaggtagatatgttttcttctgattctaccttctctattgccagcaatgtttgtcctcaataaattaatgtgagttggtggtggatgtagaaaaggggagaagggaaacctagttctccgatggtcatggctatttcaagataagggaagtggcagaaacacggagggaggcaggccggggagcctccaaccccaacaggtgaagacacacatagaggcatgcaagtcagcaaacaaattcaggctgggttcccagagggaaatgtttgtgtttttttctaagtgagcaggtgtagttaagcacacccttttcacggtgcgttgaagcagatttccagccctgtttggaagcacaacgttgccatctcaatgggttgtccttctgaacccataatagctgtttacttagaccagatcccgtattgccttgtgtcattgtccaattttcctatgtggattttaccaattcagttgtagatgtcttagtaacagggaccagaatttttccataatcaatagtagtttaaatgattgaacaaaaagtttcctcttgtgtgcaatcagctgaggaacgtaaactaatttcagtctcattcctagtgcctgatttttcttccatcattctaggtttcctgtctggcccacacttcgagagtcctccctgctgcagggagcacatctgtgagccatgtgtttcctttctttcctcctgtacaatggtaatttttttcttagctactacaggaagcccagcagattcagatgtacaagaagccacaccaagacctaagatgatattcactgatgttatcagcaggttgatgccaacatctgcctagagagtggttaccctgagaagtttaccccagttctaagtttggttggtctgttctgaggtgatagcctcgtactgaagtaatttctccccaccaaagggtctagaataggtttatttgtaatctattttatgtagctgtgactgcctcaagacacctcaaagggttattaagagtgtgtgtctaggcatgtgggtaactgttccagctcaacagcctgtgaataccattagtagcccttgaaatggatctccaggaagtgctgactgttaatgactctgccctgatgctcctatgtgagcagaacaaagagataatgtctaagtttgcaggtagctgagcgctctaaattgatgactagctcagggagagggaggtgctgtgccatcctaagcctagaagacatcgccaaaggaacagtgggagattaacaactctcccatgttaggaggttgacttgccaaactgatggaagagtgacaaactgatagactgtggtgctgtgtcccttctacgagctgagggagggcttcacctgaggcagtcagaagtgctaagagaagatttatgtggtaagggagagggaatctttccaacaatagctattaattgactttcattttgtagaagaatattgtattaagtgtttggagataggaaaagtatggcatgctctcaggatgtttataatttacttggggagataaggcacatgattgaaaagctagtaaaatacaagacaatagaatatccactctccggaataatattcagccattaacatggatgaattggatccgtatgtactcagacttgtgcaggaaaaggtcagtagcagaacaagacaccatctatgtaaaaattaaagcaaagcacacagatgtgtgtggacatatatgtgtatgcatgtgaacatatctgtgtatgcctgtgaacatatgtgtgtatgcacacggctgaagggggactggaggaaagcacgtggaaaaagagccagaggttcctcctggggagggaagtgagactggggaggacagagaagggcacctttcatatttttaccacacatacttttgtattgaatacattatttagaacaagaaagtctttctatatttcttatgtaaaaaaggaaaagaatgaaaaacatagcaacaaagcaagtacatgattgatgccaaggggtaaccctaaaggtaaaaatggtggcgtagtctgcccatcacctcacaaactctgctgccgctcctcttcctccttgtttacagaatcccatttttgctcaggaatctacctgcctgtgtctcacgagatatctggaaaaacataaaatcatggtggtcccatcccatcccatccctctgcagtgatttgtggcacttggtcatgtgatgccatcagggccaatgagattggaggaactgtccagggggctgctgagtaaagcttctttgctcttaaaaagaagaacaaagaagccaaaggaccactttttccttcaacaggatagcaccgtttctggatgtgatgactggcaatgcggcagccatttgagccttagggagctatcctggggaccaagccaaactctgaggatgttggtagaaagatggaaaagcctgaatccttgaagatattgttgagccactgaatcaacctaccctggagctgtcctagctcaggacttcagctccagtgacagaacacatttttctttttgttaaagccagctgaggtggggatatctattaccttccaactcacatgccagtcacaggaagccctgtttgtgaggcttcaagccccttgggtgcatttgaggggaagtttgagtcctcagggacatgccctctggggacaagaatgagaaggggtcataagccctctgtggctggggaggcagagaagtcatcctgagctagggtcactctttgccctggcacctcagtgggtgagaggaactgccagggtgaggtagggagatatatttaatacaagcagcccctcagtctggcccctgggataattgatacgagttctttctttctttcttttttaaaattgaaacagggtctaactttttcgctcaggctggggtgcagtggcacgacctccgctcgctgcagccttgacctcccgggctcaagcaatcgtcccatctcagcctccccaagtacctgggaccacaggttcacaccaccatgcctagcttatttttatttatttattatttattgatttatatttttttgtagagacagggtttctcacgttgcccaggctggtctcaaactcctgggctcaagtgatcctcctgcctcagcctcccaaagtgctgtgattacaggtatgagccactgcacccagtctacaagttcttaacagaatcagaaggtgtagctgggagacaaaagacccatcacagcttcgtgatatttggagggaagttttcttccttcagagcagaaaggatcactgctgtcatgggggaagaatattagcagcctcatgggagctggagtgaggctggagttgggacagtggccagccttacagagccatgggtaggttgcaagggctaggcaagcagagccccatggccgtgctgtggtggggaagaggcaggcagggggaaagcccactgcaggtatttccacagtgcgccagaagcaatgatggtttcaattggttggtagatgagtctccctgaattaaactccactcatcccaaactggtattgatttaaaatatcttaaactgggataatctcttgcagtatgttggagctgtgcacccgaagagagaaggggaaataaagtcttatcgtgagagaaagtgtgtgtgtgtgtgtgtgtgtgtgtgtgtgtgtgtgtgtagagagacaggagggagagaagaggaggacatgggaagagaggagaggagaagggggagaaggggagaatgagtcctcatttaacctggtcctgaggagggggtggctggtttctgcactgagatataggtgtttccttctcttgccttgcctccagcttgaaatcaaccacttccctcatttccttggaatgaagtcaaggaagacttgcttactcttacagtgcaaaacccagccccgggtcttcccactgttatctactgaaccctaaggtcactcagagcgacttgaaagtgtttcaggggccataaatgctcaactcaaatctcatttaaaaattttcccactttatacctgttaggatagcctgtatcaaaaaccaaaacccttgaaaacagcaagtgttggtgactgtgtggagaaattgaaacgcttttgcactattggggatgtaagatggtgcaccgactatggaaacagtagggaggttcttccaaaaatttagtacagaactattacatggcccagcaattccgctgctggatacatgcccaaaagagtgaacgcagagactcaaacagtctttgtaccccagtgctcatagcggcattattcacagtagccaaaaggttgaaacaactcaatgtccatcgatgggtgaatggataaatcaaatatgatgtatccatatcatgggacatgattcagccttaaaaaagtaatgaagtggccgggcctggtggctcacacctgtaatcccagcactttgggagcctgaggtgggtagatcacctgaggtcaggagttggagaccatcctggccaacctggtgaaaccctgtctctactaaaaatacaaaaatgatctgggcatggtggtgggcgcctgtaatcccagctacttaggaggctgaggcaggagaatcacttaaatctgggaggtggaggttgtagtgagccgagatcacaccattgcactccagcctgggtgacagagcaagtctccatctcaaaaaaaaaaaaaaaaatttctacttacaaaactgtagtaagaacaggacactcgggtactaaaaatacacacacggcccacctgtgtgctaagctgtgtttcccttttatcttctctttttttttttttttgagacagagtctcactctgtcacccaggctggagtgcattggcacgatcttggctcactgcaacctccgcctcccgggttcaagtgattctcctgtctcagccttctgagtagctgggattacaggtgtgcaccaccatgccaggctaatttttgtattttttagtagagacggggtttcaccatgttggccaggctggtctcgaactcctgacctcaggtgatccccctgcctcggcctcccaaagtgctgggattacaggtgtgagccactgggcccggccgttttcccttctctttgtgctcacctgggaatcaaagttctcccagcattttcaccagggagtttgcaattattgcaactataccagtggctaggaagtttgtatctcttgtatggatctattaaaaattcagacttgattttctccacttacataaagttgcgggaatacagctataacatgcccttatcacagccaaaagagccagttgtggataaacagcttgagacatgctgatattatctttgtcatttattgtaaagttttgatgcttcttgcctgacttttgttatgaataagaatacaagcgaccgttagatattgtccatggttctgcttcaaaacagaaacttccctctcgttctcctctctcaagcatctggatcagtttaagtaaagagcatcttgacacagccatctggaacttcctctcaatttctgtattcatcaaaaggtacaagtattataaatctgaacttgtgaaataaaattttaccaacaaagtactacatttgtttcagacattgaggtttccatcagatttgaattgcaaaaagattctgctgaaaacaaaaagtttgaaaagcactgtatttgcgcaattcccagtttggttcagttaaatgaatgctccttgaagattttgttcaattcttagctggacacacagtacattggtgagcgataagacataggaaagttaaattctgattgtccttgagctaagaatggttttacattttattttactttattttattttgcctttttgagatggagtctcactctgtcacccaggctggcttgcagtggtggaatctcagctcaccgcaacctccgcttcccgggttcaagcgattctcctgcctcgcctctgaagtagctggaattacaggcgtgccccaccacgcctggctaattttagtatttttagtagagacggggtttcgccaagttggccaggctggtctcgaactcctgacctcaagtgatccacccacctcagcctcccaaagttctgggattacaggcatgagccaccacgcctggcctggtctttacattttaaatggttaaaaaaaattaaaagaagaatatctgatgatgtgaaaattatatgaaattcaaatttcagtgtccattatataaagttttgttggaacacagccacattcgtttgtgtactctctctagctgttttcatcctaccactatagtgctgagtagttctaacaaaggccatagagtcccaaagcctaaaacatttattgtctggccctttacagtaaaagtttgccaacccttgcattagacaatgaccatatccatgtgaagtctgaacatcaaaacctgagaagttcaccttcttgatgctgccaatcttttggcaacattactgcagagttagacagactacatcagtggttctccagtctgggcaaacccagctcccaagagggtgtagagaaacgtgtgggcacagcttttgttgcaatgacaagactcgccatgcatatttagtaggcagggactaaaaatgttaaatttcaggcaatgttggatacagtcctgcacaatagagctcaaggtgtaccctgagaaacagggatccagagaattgctgtgattaattttacagggcaacttggctaggccatggtgctcagatatgtggtaagctgttattttggatgttttcatgagggtttttgggaggagatcaacatttaaatcagccaagttgaagtaaagcagatggcgctccctaatgtgggtggggctcacccaatcagttgaaggcaggaatagaacaacttctgacctctttgagcaagaaagacttctgcctgcagatggcctttgggcgtcaattgcaactcttccctgagcctctagactgttgcctaccccatcagatttgggactcactatggctccacaattacatgtcaattccgtaaaataaatctctctccacttacatacgtacacacacacacacacacacacacacacacacacgacctgttggttttgttactggggagaactctgactaatataattatcccaaagtttcagtttctggtctgaaagtgatcttcagtccacttattcctgtgctttgcaaattctacctctttttcaaatttcaaaattcagaacatttcaaaaataagttgacattgcaaatttcatctcatcaaatgctaaaaaaagttcatacttctggccgggcgtggtggctcatgcctgtaatcccagcattttgggaggctgaggcgggtggatcacctgaggtcaggagtttaagaccagcctgtccaacatggtgaaaccccatctctacaaaaatacaaaaattagccaggcatgatggcaggtgcctgtaatcccagctactcagaaggctgaggtggggagtcccttgaatctgggaggcggcggttgtagtgagccaagatcatgccactgaactccagcctgggtgacagagcaagactctgtctcaaacaaacaaacaaacaaacaacaacaacaaaatttacacttctgcatataggactctaattcaataaatgtggtgtttaattgaacaaatgtgtattgaactccagtgacccatttggaagatgctattggggagtgatataaagacaagatatagtctctgtcccaatttacccagaacagagaaagggcgactatcaggcacacaattaatgggaataccagggcatttctgagaggccgtattacagaggtacaaatcaggacctgtgggagtccttctcacaggagatcataactccaactaatgcaacctccccgctagtaaaacctatttttctttttccttctgaactatttctctcccagttattatcagtgaaaagccagaagcttctctggtttctcacccatgtccagagacagacaagccgtgggttcagaggctggtttttcacatcctccacttcacaccacgaggacctcacccactgcagctgcagaacaggaaggggtcatctacattggttacacgccccatttttagctggatgtagctaattattttctgtttaagactcttgtctttttaatcatacgaaggaactgcattattacgctctcattgtaaggatatgaaccatatggtagtgcagaaaataaaatgtgaaaatctgttctatctgttctcatttcctcatctcattcattactgcaacaaaaaccaattgtcctcactttgggaggccgaagtgggtggatcgcttgaggttaggagaccagactggccaacatggtgaaaccctgtctctactaaaaatacaaaaaattagccagacgtggtggctcttgcctgtaatcccagcacttgggaggctgaggcgggtggatcacctgaggtcaggagtttgagaacagcctggccaacagacgaaacctcatctctactaaaaatacaaaaattagcccggtgtggtggcacatgcctgtagtcccagctacttgggaggctgaggcaggagaatcttttgaacccggcaggtggaggttgcagtgagctgagatcgcgccactgcactccggcctgggcaacagagtgagaccctgtctaaaaaacaacaacaacaacaacaacaaaaccccaaaaacaaaaaaacccacaacctattgtccagtcaagtctttcttgctaccagagcaggggacatgccactgatgagagcgtcttctctgttccttccaaacactcagcccagcattcagatcattgctcacccagtgcagagtcacggtgccagggtatggagtacagatgccagagccacagccatcagagacagtgtttttgttttctagggccctgcaacaaatgaccacgagctatgtggtttgtagcaatagtaatgtattctctcacagctctggagtctggaagtcccaaatcaagatgttggcagggctgtgctccctctgaggcctcctccagggaggatccttccttgcccctccctggcttctaaacttttctggtcctcctcagcctgtcgctgcatctttctaatctctgcctctgccttcacatggccgtcttccctctgtgggtctgtgtgtccaaatttccctcttctcataaggacactgaccagtggattggggtctacactcctccagtgtgacctcatcttaacttgattacatctgcaaagacctttttctcagggaagctgatatggtttggctgtgtccccacccaaatctcatcttgaattgtagctcccataattcccatgtgttgtgggagggactcagtgggagataattgaatcatgggggtggtttccctcatactgttctcgtggtagtaaataagtctcaaaagatctgatggttttataagggggaacccctttcacttggttctcattctgtctcttgcctgccaccatggaagatgtgcctttcaccttctgccatgattgtgaggcctcccagccatgtggaactgtgagtccattaaacctctttttctttataaattacccagtcttgggtatgtgtttatcagcagcgtgaaaatggactaatacagaagctcacattcacacacaagggagttatgacttgaatagatcctctgaggggacacaattcaagtcacaacagatggagactccatacttctaagcaatccaccaggagccacaatggccccaagcaaaagatcatctctctcgaaggccagtcctgcttgactatggcacctgggcagataatgaaaacactaacccccttcaacgctccccatggactgggctcactgatctgcagaatgacccccgtggggacctagtccaaggtaacgtgctgcagcccaagcaactgcttgcttcaatttgcaagctgtgcagagcagacagcccaaaatggcagtggcttggggaaaagccagacgttcttgaaaagctgtcgtttcagaaagaaagaaaaaaaaatcacttattttttggataggcattgagtatcaaagatttaaaaatttggctctgaccacaatatatctgaaagtagaggtcattccgtaaagatcagcctcttcctaaatcaccaggctttccaaccagctcctggcagggtccgagggtcccgtcaaagtggccagtggactgccccaagggaagcatgaggaaagcacgtgaccccttctggtaacttggagaggagtggcaatggacagagagtaaagctagggcatgaatggggacattttataaaggcagcttccctcctctcctgggctcactggtacacaggagaggagagttggtggcttgctgaatagccattgagttaagaaatatagcttcagacataccatcttgtaactggagccatccaaacctctacttctgaatgttcccatggcaaaaacacagattttcacaacattccaggaaaatcctgaaattgagtcctgtagagggcttgggattgttttgccaaggaaataatattccacacattggaggtccatctgtgtgggcagatgtctgtcttgggaatgacagagtgaggccccaagctggtggtcactgctgggagtaggggccgggacatagactggagaaggcaaatggtaccacctgatgcagagataacattggcctggggtccttgtgtcagctgatggggacggaggtcagcaatagaaagaggactcaggaatgcatctatccttcctgttccctgtcccttcactctcaaggaaaatggcagcatcgtcacgattccccaaatgaaaatcacattggaaaatatctagtgttttatacaagaaggccagaggctgatatcatgaccttaggttttagaattttctatcagcagcaacatgtcagctaaaaaattccctatcaagttattacctgaagttttttatgccttaactttaaaaataaaggtctgcaactccaagcaaaaatcttggactcctctttatgaatcaaactgattcccaaactgagatcatagcccactccctggcccctgtgcttattataaaacccatcttcttttcacgtccaatataatcaaggcagccacaccccacacgcagcactccagccttactttccccaaatccaggccccacttcatgtgaaaatgcatattattacccctgtgggctcagagcctgttttgaaataaagcaaataagaaccacaggggagtgactcaagtccaaattgtgtgtcctgacttggcgcaaatgttcttccttgtccttgcttattaactttgggagacactgagcattccccaggatgcgctgggggtttgcacacaatcctgcccaaagctgggcaaagcctgcgtgcccagcagccaggaattccctcccctccatccccatttggggcctgttcagccgccctcgttttcatgaaccccacacaacccactgcgtttggaggaccctgtgatatatggcgccttccagagaacaggatgcagatgcgcgggggaggtaaccggagaacagcgcaagaagatgcggctgtccccggagcccaacacataaattacaaaaacaatttcgaattcaagggcaagcattgccattcctctcttttccaaactttggcttttttgtgctgaaggtaagtttgagaggagtgtagattttatcccaagatgacttcttcccattccattttaattatccgctgggtctcggtgactaagtcatgagtagggaggacccttgtcttcaatgccctgccattggccagccaagatccagtgttcactgtagccatggtcttttctgggagcagaggaatttgttcaggggaaaggggagaagaggtggcccacacggaggcaggcagaacttcatgtcactgcggaggctgaacccaagaccaaccaggcacttggcagtgaccacccctccccacctccccagggacactcactgtcctggctggacccttcctgatccccccagtgtcagggagcaagcttgattgtctgcgcccaggagtcccagacttgagggctacatttctcccgattgcctttgtgcagagcacacagatggcttcaaataacaggctggtttcatgcacctgtgctctggctgtcccaggttttagaaaggactgatccatctcctcttgaaacttccatctgaatacacatcaatagggtgtatatgtgtgatgaaagaaacactcttcagctacatgattagatgatctgtgttcccccaaacttttgcaaacaagagactgcactctggacttaaactttcttttcaataaaagcaatctaggaagtttcccagtttaggtagaaagtggattaggccaggtgcagtggctcatgcctgtaatcacagcactttgggaggcggaggtgggtggaccacttgaagccaggagtttgagaccaacctggtcgacatggcaaaaccccattcctactaaaaatacaaaaaattagccatgcgtggtggtgtgcacttgtaaccccagctactcgggaggctaaggcaggagaatcgcttggacccgggaggtggaggttgcagtgagccgagacttttccactgcactccagcctgggtgacagagtgagactccatctaaaaaaaaaaaaaaaagaaagaaagagagaaagagagaaagaaagaaagaaagaaagaaagaaagaaagaaagaaagaaagaaagaaagaaagaaagtggattcggcaccatccctaataacaggtgggaagggactgcccttactgcccactccgagatgctccagccctgccggctcctggagtgtgacctgagggacacaaagcagcactcttaccaccctgaatgccagttccaaacactgaatggggacacaggtgacctcaacagcaggacctgactgctctctccaagcacaaggaaacttgttttttagatctatacccatcagcagtgtgagctgcagggaaaatgcatctggctaagatttttttttttttttaatgagacggggtctcacttgctctgtcgcccaggctggagtgcagtggcatgatcacaactcactgcagagccttgacctcccgggctccagcgagcctcctgctcagcctcccaagtagctggggtcacacgtgtgtgccgccatgcctggctcatttattttaattttttaaagagacagggtctccctatgttacccaggctggtcacaaactccagggctcaagagatcctcctgtcttggactcccaaagtgcagggataacaggcatgagccacggcgcctggcctgcctcagactttaacctgcacaagggaatggggaactcagttatggcaagaaatgagacagataccgaccgtatgccactgacagaaaattctaaaacccaaagtcatgatatcaagtgaggcagataccgaccctgagctccacgtgaccgtgctgtgggcctagaaatgagggggatggggagtgtggctgccacatgacaggcaggatcgtatacctacagcctcctggacctgggcccagtagagcaagtgctgccacctgatattccaatgtcacattcagagacagccactggccacttcccagcagggctggtgggcacttgtgagaatgggaaactggacccatgtggaggtgtcctgcctggtatgctctgccgggctgtgactcacggagggacgggccctgcacccaggtgacatcagagcccagggtgccatcttttctcagctccttctagcccatgttgtggatgcaaggcatgggtgccaggtactttccccttccacccacccttggctgctgggccaccttgactgcccttggagttctgggccctcaagagccttctccatcacctgcttctcatgggcgctgctccgacacccaccccaggtgctctgtggaatgtgccagtcagggctccctcacggagggtgaacaccaaggcccacctcagcaagcatggccaaaccactcaacaagcagccagacactgatgtcctacccagcccagccctgtgacctcgagagaaggataagacggacaccctgacatcaagaatgcgtggtctcgtgtgcagcccaacgcaagtgcacagaatgagggggtgtcaggctgatgacatgcactaggggactctggggcaggagggatcagtgagcttcaaggagaaggtgaacgccatgctgagtcttgaaggatgaagaggatggaaggtgagtttcaagtcaaagctaaatgaaaaaaaaaagaaataaagacttgaagctggcagcgaggagaaagaaaaggttctgaggccagggtaatagggcagtggtcagagaggggatgatgatgggggttggaggatggcaaggagcccctcagccacaacaggggacaccaaagatgacagaagagccggcatgaggtcaaagggaggccagacaaaggaacttttggaaacctggcagaggtgtgaatggtgacttccaagctggtgagcagcaggatggaaagggcgggtgatgggtgtggcagccacatgtgtggtgtgctgggcagatgccctcatggtgaagccgaggctctgccattgaccacgaggcaccaccaaccacactctgactcctccagcgatacagctgccctctcatcaggaacggtaccaaggagccttggtaccatcaactatctgctgccaaccggttacatggagtctttaaaactggggctgggttttaaagacttgagaggctgagcgggaggattgcttggaacgtatggtccctgcccacaaaaagcctggcccctggaccagagggaagcggcacgatgaaggtatgagagtgtttctgttggcgggtccagcctctgcgctctgactttctccagctcagagatatcccttcacccaggttcctacagagccccatgctctttccttatctgagaaccacagattggaatccacaaggagtctagctgaagatcatttagtccagagggtgcaaaacttttcctggaaagggtcagacggtaaatattttcagtgttgccggccacagtgtctctgttgcacctgctcgactctgctattgtagtcccaaagcagccatagacaatacataagtgaaatgggcatggctgtgttccaataaaactttatttgcaaaaacaggcagcagggcaggtttggcccaccagtcatagatctagcgctcaacactcccatcctacagatgctgaagtgtagcctcaggaagatggaactgacttgaccaaggctgcatggctcccaggaccagaccagaactcagaacatctgctcctcaatcttcaaatctctttttaaatgctattcaaccagctgcttcctcctggcaaagtggggtcctggaaaagaccatgaatcttattgactcaagagatcggaaagtccagtagaacctgctgggatgtttgtgttttcaatggagtagagaaaacaaaaacagatgaaggacttcagcaatttttaaaaatggagtgttcattcaaataaactttaaatcccaccaggcaaccacgggcacttcacactcctgaggtaggcccagcaatacctgagacaaatctcacccctatttaattatcattaatcttccctccaggcttttccatacctgctaaatagctcaatccatctcattactgaaggcagctgctaggtatggttgtgagaaatctcattagcacaaatgtacttctgtatggtgggcctgataggcccacctcccgagacggggatgttgaatggcaaaatctcagctctgaggaccatcaaagcactgggttccccaaagttttggccacactcagtagtaagagccttttattattgtcattttcaactacagagatcatgccccccaaataagaagaaagcaaacaccttaaaagggcaaacttgaagattcacaataaataggtaacacgtgaggggtccaacactgtgaagctcaactgttcctcctctcggacgtgataatttcacatgttcagaccaccctgtcagcatgtcagatttaaaatattacacgtagaataatgaaaaattgccaacttctcaccaccgtcttttgattaatgaggagttccttagagattgattggtttatttgattttgttgccgggagtgactgatggctattttaaaaaatacttagcttagcgctaccctccatgagataattttcatatgccttgtgtagctgcgtccagaataattggactttattgccttccttccatgcatgaactgaagttccctggagaagcaaaacagcttcagactttgttgctttaatatttccatgtagatcagctgctgtgttcatggagatgcttccaccagatggccagcccgccttgaagtgacatttcccatttcccgtcgattactcaccaatggaaaataatgtgatacgaatccctcatttggggtaatatgtggccatatccttgttgtacctgcactaaagataaatcatgcaataatttctcaactgtccagggagaaaataggagaaacaacaggtcaccagtgtttggcaggaaaagggaatcgttattggtaaggcattcactgggacattgaaatctaatgtcctaatttctttcttttttttttcttgttgcttgttcttctgtatctcagggggaagaaacttattttggttgtttaaaacatttaagctctggtttttaggaagaatcctggttttggtcaagtccctagatgtctcttcccaaaagcacccattttgatgctgaggcgaggacaaaagtattagttttcaaa

SEQ ID NO: 166 - DNA, 139657 bp, Homo sapiens
aataggaaaccaatagagttgataaggacctaagttcaagtcagtagaggaacatgtggaggagagaatctatttgaaggagaatttggacagggcttattgacaggttggaggaaggggaagacaggatggagagtaaatgaggacagcctcccagcagggttgtagagagggtgggggtacagggcctgtggtgatagatgatgctttgaaacacagcatggcaccagaaagtcctgacaatgctcatggttcctggacaccacttcacattttattcataatctttagtttgcttttaaaacctgaaattggaacttgaaagatggaatttgagagttaagttggatgttcgaagtctcttagtccatcccataatttgacaggtgaagaccctgagtcccaaggaagtggagtagcttgcttcaagctgcatatttagcaacaataagataaattcttgcttagttaaggtgggaggtaggaaaaggtttcattgaaagcctacaacaaaatcatcacagaacaggtcagcaccccctttggctatgaatgtcaccaacagggccctgcccagggtggctgttagccaccctggacatgggccacagcacagagaagaagagggaggtgcgtagggccgtggctctgccctggctttcctggccccatatctggaggtggagggccacagagccacagtgaatagggcagaaaacctgcaagaggctagagttacacttacaaggcagcccaggcccactaatgcaggtttctttgccaactttatccaaaagttgaaatcacatcactgaaaataatacgaattgggtagtagccctagttagctcatgctgatcagaaaccgatgggcgattgttgtcattccaaaaatggatgaggaaattcttaccaacttcagagttctagtctgggaatgactgtcttagggtctgttgatgggaaagtaagaaaagcagtcacaggttattagaagactgggaacacattgactgcgctggcagagcgttgcatgctagttgaattgcagtgccttttttttcctccacggcatgatgtgaagtagttctggcctacgttacatttctcagatctgttctccctcttagatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcaggtaactgaagatgtgctggttgcatgaagaccagaggcccagccctgctctcttaacgtgctgcgtggcctgagctccctcagtgacagtgccctgttgtttgtttcagtgcacctgggttcaagtgcggctctgactggaccagagttgtcttcaggttagtagtgacccaccccccgccaatttggttcatcacaaagagtcctgcatgggcattttcccactggggatatagagctaaattttgttcagtgcccaacctatgtttccaggagtgtgcctgtaagttcataattgcaggccaccattattgtctcttcctttccagtgttccttttgtgattacatgaacctaacgtgttgtaccaaaaaataacagttggctggttgctttgttgtgggtgagcccattaggttcacttctcatcactcattcacgcaagagctgttggagagcctttagaaaagggcaggagtggccgtgggcctggggcgggactgaaaaggctttttggagaagggtgtgcaggtggtctgcagttttctgctccttgttcccttcttccatgtatcctgcttcttccaaatacctttccaggctcagttgctaagatgtttcttttcttccctcctctctttgaggcatgtaacaaggcagtccatgggctgaaacccttagctatgtggaggttggctttgatctccctatatgttgttttgttgaagtctgtagatggttaaggacttggagccccaagaagcaatgtgatgccactgttcattagccggacggggctgaaatactggggaaaagcagatttggctggaagggccatgactagcacacattctgaggtctgggtacacaggagtggtcatcagtgaagaacaaacattccttcttgggaaaaaggccacagagatgctgaattgggggtggggaattgacaacctttcttttcttactgtcttctgtagccctgatggcagttacgtggcggcaggctctgctgagggctctctgtatatctggagtgtgctcacagggaaagtggaaaaggttctttcaaagcagcacaggtaagatgaaccctgtctcagccccccgttgcgttgtgagcaaggcctttgacttcatctcaggggtcatccggtttagacctcagtcggcgctgtgagggcactgtccgcccacctgctcggctggctgagctaggtcagtggagagaagctggggccactcacacagcacagcaggccacagtctacagagtacgccaggtagagcggttagagtggcagccgctggagaaagggttatagaaacacatccctgactctttggttatgtccacgtcctctgtgtctccttccccttccctactctccttcctttccgcctccctgtctcccttggaagtccctgttgtcagtgcatttcagtgcattgacgtgtcctaaacactgatctccacacaccttcttttatcttccacctgataggcaggccccagacccccttttttcctagctttgttctgcccacacaagcccacctgctagttggaacccagataccattttccttcagaacctctctccctgtccttgggcagcagcaactgctcccagacctaaccagtgctgaccaccactgcccggctcttcagaggcatgtgtactgtctttccagctcactcagagctcctctcttagggagagtgtgataaggcctgactgccagaggggccaaactcccttcatcccagcatgacttaattaagtacaccactggattttttctgaggtcttttgcatgttagtgagctcctgccttgtcgcgggcacagtgccagagagtaaaatggaagttggaaaaattaggactccctgaatgcacaagcttctggtgtttggtttaccaagatctcatcccaaatgttctgaaacttggtgcttttctgatctctcctttgaagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactccatgcctcttggtgattattttattctcccttatccttagaaaggggaaagaaagtgatttctttgtttacctggtagttatttgtaaacaacggctagtactttttaacggtcttttttcattcatcatgtaagctccattccacaaagtatctctctctgtaaacaccagtgttccagtttcatgtcgcgcaaatcttaacggacattggaaagatgtttcttcagaacattaccagctgcagtagaagagcccagcacggattgctcttcagccctctgcacggagcctctctccagtgaactgccgcagcagagaggcattcacttgtggtggctcagattcctgacacacagcctgagctgtagcaaatgatgaccacccttatcaggaaactcagccagtcgtccacttagcctagcacctggagtcaagctgccatcagagtctgaagtctgaggcagccaatgcttgcacaaagctggatgaaagcgagatgtgttggctcacacctgtaatcccaacactttgggaggctgaggcagaaggatcactggaggccaggagttggaggctacagtgagctatgattgcactccagcctgggtgatacagtaagaccctgtctcaaaaaaaaaaaaagttagacgagccctttgcaatcaccttcaaaaaggtgattctccaaatagtccccaaataagtgttcgagtagtctcagatcatcctgtttttgcatttggagggaagcatggctgttctctgtgctcagcctgagctccattccagtcccttaactgccaatgctgagctaaaggtaagggggtctcacagcaccggggaatgtgacttccgtttaactccctgcctagcgcatggactagggcctttccagctgctagttttgttggtcagagcaggaggcatgcataggggtgtgtgtgtgtgtgtgtgtgtgtgtgtgtgtgtgtgtgtatgtatgtatgtatgtatgtatatgtatgtatgtatgtatgtatttgagacagggtcttactctgctgcccaggctggagtacagtggtgtgatcactgctcactgcagcctcgacctcccaggcccaagtgatctactccctaaaccggagcacaccaccatgcctggttaattttatttttaatagagatggggtctcaatatgttacaggctggtctccaacggcagtgccaaaagcagtcctcctgcctcagcctctcaaagtgccaggagtacaggagtggagccacttttgtttggccctattttttttatttatttttattttttgagacaaggtctctgtcacccaggctggagtggagtggcgcaatcttggctcactgcagctttcgcctcccaggcacaagtgatccccccacctctgtctcccgagtagctgggacaataggttcgtgccaccacacccagctaattttttatattttgtagagacggtttcaccatgttgcccaaagccttattgttcaagcacatactgttcatatgctgcctcttatagatgtcccaaagccccacctgctttcacagcatggcacaggacgttttgtgtggacacgggtgaatggatgaagaaggtgctcttaggctccaggagcaagttggctgggaagtcccaggttgctgagtgtaccaaatcctgcagaactacctgagtgtctgtagcagaacagcaattttaattgattagacctttttctttttctttttttttttttttttttttgaggcagggtctcattccggttgcccaagtcgagtgcagtgacagaatctcagttcactgccactttgacctgggctcaggtgatcctcccgcctcagcctcccgagtagctgggactgcagccacgtgccaccacgcttggcacatttctttgtatttttagtagagatggggttttgccatattggccagggttgtctcgaactctggactcaatccacccacctgccttctcaaagtgctgggatcataggcatgagccgctgcacctggcctgagtagatgttgtaaaatgtggactttccactcatacctgtttccagcaccaggagacaagaatgacagtgataatactgtcttgtaccaagtctggttactttgatacagaaaccacaagcatttttgtttttataagatggcttgggtagtaataaaataagtctgtggctctcaaattctgtaatctggattgtaccccatttcgcaaatggggaaatgtttaacagctcagcaagaagttatcctcgtcctagagtcctgggcccatctgcttcagcactgcctgccacaccaggcccacagggacaggcgtgacactaaggtgtgccttcaaaagtgaatgggctgtactcctccgcatggctttttctctcgtgtcctgctttaataagtcctgcttacgttagaaattcctatttttcatctaaaaaactttggaaatcccggcactttgggaggctgaggcaggcggatcacgaggtcaggagattgagaccatcctggctaacacggtgtaaccccatctctactaaaaatacaaacaattagctgggcatggtgtgtgcctgtagtcccagctagtcaggaggttgaggcaggagaatcacttgaacctgggaggtggaggttgcagtgagccgagatcgcgccattgcagtccagcctgggcgacagagcaacactctgtctcaaaaaaaaaaaaaaaaaaaaaaaacaacctttggcaatcttgagtaaaatgaggtatgcctgtatctgcatagattctgtaaaagtgcatgaggtatgtgatgcctgccagtgaaagataggactaatcacaaaatgattcttagctgcctcacttaagcaaaatttgacttctctggcctccaggaactctggctttcctaacaggtctcaacccttcctggcctgtttgttccagatcctccctctctgtgcatgctccaactgttcctgtcctcttaaccttccccgctccttagtgaagcttccccggcaccatgttgccttcatattctaacctgcaattggcgagcacagtgagaacatccaaaccaggacaaatgcagaacccaagagagtagacagtattgtctctaatgagtccagtgttcccaccacttaacagccctgtcagtctcagtcagccctctttgatgcttccccccagggtattttaacgcaaatttcaagcatgttgtcttacccataaattaccatgcatcccaacccaaaccggcaaaggtacctggctgtgattaacctactggaattaacagtgacagtatcacgcaccctccagtccaatgttcctaattgttgcagcactgtttcttatgatgggtttgaaacaaaatccagttagcttttgctgcgtaacacactacctcaaacttcatggcttaagactgattatttactaagattctgtgaggcagctggcctggcctagtgggaacggatggtggaggtggctttgttcacatgtctgctggggggactgctggcacagcaagcaagcaagcaagcatctgtgtgtaagcaagcccttgtcactctgcttgggtcactttttttttttgagatagagtcttgctctgttgcccaggctggagtgcagtggcacgatcttggctcactgcaagttctgcctcctgggttcacgccattctcctgcctcagcctcccgagcagcaggaactacaggcgcccgccaccacacccggctaatttttttgtatttttagtagagacggggtttcaccgtgttagccaggatggtctcgatctcctgacctcatgattcgcccgcctcagcctcccaaagtgctggggttacaggcgtgagccactgtgcccggcgttgggtcacctttttaacgttccatcgtctaacgtggatggcacaggcagcgccactgcagtgagagcacagcaaggggaacggggcggccatctcggcggctggctgcagcagggtctacatgctgttcccccatcacctgagtatttattctagaacagtaattcttgcggacctttttttgaatgccctacactggatgtggttgacttctctgtaagcatacacttacgtctcaagtggggacattagtcttgcacatgactgtgggcccagcccccactgtggattgctctgaccccaggcacaggaagatgacggcaggcaaattctgactttgggcttcatttttgtcagagaactagtgaggagaggataggtaggcatgcttgtgagccaggcagtaagaggatcaactgtaaacagcctggcttctagttaggaagccataagtcctgttgcccccagaagtacacccggatggtcataagagactaaagagatctcagggccatcatatgctttacatccgatagagtgcttagcacatggtgggtctatagtagtagaattagtggaaaacaaaccaaaacagccccaagattgtcccaagatataactagctgaaaggaagagaaaatcgtttaaaaatgtaatagtaggccaggcgtggtggctctcgcctgtaatcccaacactttgggaggctgaggtgggcggatcacttgagaccaggagttcgagacatgcctgggcaacatcatgaaaccctgtctctactaaaaatgcaaaaattagccgggtgtggtggcacatccctgtaatcccagctactcaagaggctgaggcaggaggatcacctgagccccaaaggtcaaggctgcagtgagccgtgatgatgccactgcactccaacctgggcaacagagcaagaccgtgtctcaaaagaaaaaaaaaatttgagattcacataacataaaccattttaaagtaaacaattcagcggcatttaataaatccacagtgttgtgcaaccaccccttctaattccaacaagaaagaggatcagtgcttttcagacttttctgatcagtagcagtggatctgtctgaagaaaacttgcaagccctctccccagaaaaaggcatatgtacataattctgcatgcaacttaggttcacagatcccgaagcccatccagggatcccagggtaagccctcggtttgtggttggctctcaactcttctgtagaagcaacctcatcgtcatcagaaccccctttagtgttggggcccaggtggcatgaccagagggtgaagaagcacacaagatagacatcagcctcaccgctggagaggacgagaaaatcttgatcaggatcctcctgcacaagacttgaccttctgaaggccatctgcacattccataaatctttccaccttgcaagacaaggcaggctggggggtcccctcagacagacggataaaggaaataggccaggctactccctcaaggtcacaatggattcagcagtaggccaagaacccaggactccatctggggctgtttgtacatcatgctcctattacatgggaacctgcaacattaagtaccatttttagcacgatgcctccagacagacattggaaatctgtctggggtgggacctccagggtggtgagagggtttcagtgcctacaaggctaatcatggaaggattcacgtgtggaagagagattaacttcgagcaatggagagaagcagaagggaagccaattccatcctaacataatttttcactctttatactaataatttggtattagtaaatcataatttactaattctaatagtaaataatactagtaaatactaataatagtaaatactaataattagtaaataatagttttgtcactctttatgctatttgaaaaaaagatggatatacaacaaagtagtgatttccccatccttggaagcattcagtaacttattggggatgttaacagaggagatcaaagtaagggatggaatgggaacaaagtgattttttttaaaggtctctcattaccttgtgcacccacaggattgcgtttatgatttcagatattattagccagcccaacccaaaacagccctctattgtttaaactgattgactaagtctaggagatacatgttggaaataaggtgacttttaaaagctccgattccctggcactctttatagatacctcaaacctcccaggtgttctctgcttcagtaaaatcaaggcaatgaggacacaagattttcattttgtagctgatgtttagcagagtgtacccattttcctcgtgcatgtgccccagtaaacccttaagacgacaaccccaccccaaagcccataagcctcttagctggatgtctccaccccgcccccacctcccctgccccgcaagccggctgctgtgtttagtgtttggagatgaaacacagggttcatagcattgtctcactggaagccaaccccagagaaacaagcatgctatagccactggttcccagactttgagaattcatagaccagtaattcgcaaaaataaatctaggggaagattgccagcttttaatgtttgccaagtaaggacttttttctaaactaccatatactcttggttattatttcataaaaagaaaggacatttttctccttatgcttaggagctgcattttgaaatacgggtaaaatgtcgtgatgtctgcatgtacgttcaaatagttaaaaaggaaaaaaacagagatagacacagaggattgcaggcagcaaagtgttaagtgtcaagtcttgaagttgactgtgtgggtgtctattgtattgttcttctaacttttctgtgctttaaaatttcataataaaattgtagaaaatgcagagctaatgacagaaggcagatctgtgattgcctggggcaggagcgtgaatggaggagttgatggaaatgggtacagggaactttggggagtggtggaattgatcacagtgatggttacacaatgtatatgatgaccaaaactcatcaagctgtacactcaaaatgggtgaattttgttggttattaaatagatatattttacctctctatatgtatctgcctgcactcatctatgtctgtcactatttcaaaattcacccgtttcatatatatatatctcaataaagatagagggcaagaagaagaacaatgcctttttttttttttttttttttgagatagagtataactctgttacccaggctggaatgcagtctcggctcaccgcaacctccacctcccaggttcaagtgattctttgcctcagcctcccaagtagctgggattataggcgcctaccaccacacccagctgatttttgtatttttcgtagagaaggggtttcaccatgttggccaggctgctctcgaactacttacctcaagtgatctgcccgcctcggcctcccaaagtgctgggattacaggcgtgagccaccatgcctggctgaagaaggatattttaataccaaaaaattaaaaagctcataatctcaaaaggacagtcctttatattgaataagtttggctcccagaaaaactacaagagtgtccttatttttctcatttctccaccaagaagagaaaaaatcatcacagaccaagagttgggaataacatttccaaaaagagtgagatctgtcatccagtccacccaaatttccccacctgcacggcattggcagagcagtgactaagatctgcagatctgtgccttccagcagccgggaacgatgaagcagcaggagaatgggggaatctggaagcactcacagctgcaaactgggcctgggtcctgcagcctcagctcagggcagccctctgatggggacactgaaagaagcaccctagtcattttttcccctttgtttttttttttttgagttggagtctggttctgttgcctaggctggagtgcagtggcacaatcttggctcacttcaacctccatctcctgggttcaagtgattcttctgcctcaaccttccaagtagctgggattacacacatcaccatgcccagcttttttttttttttttttttgtatttttagtagagacagggtttcaccatgttggcctggcctcaagctcctgaccttcaggtgatccgcccacctcggcctcccagagtgctgggattacaggtgtaagccaccgtgcccggccacagcaattttttttttgcccacgctggaatacagtgacatgctcacggttcactataacctcaacatcccaggcccaaacaatcctctggcataagccaagtagctgggaccacaggcacacaccaccaggcctggctaattttgtttactttttatagagatagggtctcactatgttgcccaggctgttctcaaactcctgtgctcaagtgatccacctgcctctgcctctcagagtgctcagattacaggtgtgtgccactgtgcctggccctatttattgttttttgtttgtttgtttttttgttgtttgtttttgagacaaggactcgctctgttgcccaggctggaatacagtggtgtgatcatggctcactccagcctcaacctcccaggctcaagccgtcctccagcctcagccttccagagtgctgggattacaggcgtgagccaccacacctcacttatataacacagttttgtattttaacctttctattataggagcagtaaatggtcataggagaaaatgtgaaaaattatagacaagaaaattgaaacaaagcctaccatttcattacaaggtaatgagagacctttaactaccaatgttagcttaaggtgtattcttgcaaagtatgcataggtatagcatgcatatgaacctgcatgtatgtgtgtaaatatgcttgtgtgtatatgcatgtgtgtgtaaatgtacatatatgtatgtatacacaaatacatagtctctgtgtgtttgcaaaacgtggacatgctaagcacaccattctgcagtcttgttggttctgtcacaatctctcacctttctactccaggcattttaccatagtcagattttcccaatgaacccaaaatgtcctacacatcctttttgaccagttgtgtattcagtctggggctgcacatgacatctgggtctcgagtgtcttagcgtcttttaatctagtaaaccccatgtcttttttcttttttttttttttttgagacagagtctcgctctgtcacccaggctggagtgcagtggcacgatcttgactcactgcaacctcccctcccgggttcaagcagttcttctgcctcagcctcccgagtagctggaactacaggcgcccaccaccacgcctggctaatttttgtatttttagtagagacggagtttcactatgttggccaggctggtctcgaactcctgaccttgtgatccgtccgcttcggcctcccaaagtgctgggattacaggcgtgagccactgcacctggcctacccatttctatggcattgtttgttggatttgtctggctgctcacttgcgtcacgtagctcgttccttgtatttccgataaactagaaatgatgtctgaaggctcatggattcaagttaacccaaggggacacatcccatgtggctgacaccaccagcaatgctaagattgaccatggcatctgccgtgcaccttgtgatgacaccatgatccgtgtggcatcacttcactcctacagtcattttcccagcaactcttcacctaatggttttagcaccaatgaataatctttgtgttttaaaatagggggtttgcagttcaggtatggtgaggccaaccatagagtatgctaaggatagggtgacattgaagtaaagactcaaagccattgaaggagtgagccatgtggctggctgtgggaagactgttccaggagaggaaatagcaagtggaaaggcctagacggaggtttaaagaaaagcaggccagtggtggtggctcacgtctgtaaccccaacactttagaaggttgaggtgagaggatcagttgaggttgggagttcgagaccagcctgagcaacatagcaagaccccatctctacaaaaaggttaaagaattagctgggtgtggtggcatgtgcctgtagtcctagctactcgggaggcttaagtgggaggagcgcttgagcccaggagttcaaagctgcagtgagctatgattgcaccactgcactccagcctgggtgacagagcgagaccctgtctctaaaagaaaagaaaacaggctcagtactctggagtgaagtgggcaagggagagggtggtgagaaataaagtcagaggtaaaggggggccagagcatgccggacctggcaagcattgtccagacttaaatgggaagccattggaatgtttgggtggatgctgataccccaaacgtcagaacaggctttctgcatatacttgtttcattcccaagtcagtcccccatgtaagtgtgttagtggtcgcagagtcccctccatccattccctgagtgttcttgggagcaggcattgttctgggcactgtgaagacaaaagtgaaggaaacaaaatggcctaggccctgccctcatggagcctggactccagtgagggaagagagactgtagaataattcccaagcaagagtgaaatgtggccaggcacggtagctcatgcctataatcccagcacttcaggaggccaggagtttgacaccaacctggccaacatgacgaaaccccatctctattaaaaatacaaaaattagctgggcatgctggtgcacaactgtaatcccagctactcgggaggctgagacaggagaatcgcttgcacccaggaggtggaggctgcagtgagccgagatcgcgccactgcactccagcccaggcaacagagtgagactctatctcgaaagcaaaaaaaaaaaagagtgaaatgcaagcgtgcctccaatctggtcctggaggttggggatagctcccctgaggaagtgactcctggtcaaaaatctgaaaggccaagaagagtcaacaaagtggagagaggagaggcttgttccaggcagaaataatagtgggaaggaggaagcgtggcagacggcgtggaaggaaaggcaggcagaggttccagaggctgcaagctttttgcctgcattctaagagcaatgggtgattgtaagcgagggatgacagggctcagaaggtctctctgcctctgtgtggaaaagggcttggagggtagaaataaatgtggtcggctgggtgcggtgactcattcctggaatcccagcactttgggaggccgaggcaggtggatcacctgaggtcaggagttcgagaccagcctggccaacatagtaaaaccctgtctctactaaaaatacaaaattagctcagtgtggtggtaggcgcctgtagtcccagctactctggaggctgaggcaagagaatcacttgaacctgggaggcagaagtttcagcaagctgagactgcaccactgcacttcagcctgggaggcagaagtttcagcaagctgagactgcaccactgcacttcagcctgggagacagagcaagactccatctcaaaacaaaaaacaaaacaaaaaaaagaaaagaaatagatgtagtcagacagtggggaatcactccggtcctgagaagcaaaggcggtgctggggatgggaggatgcagacaggttccagagacactgaggggatcaacaggactcctgaagccatcaatcagtaggaccgggtggaggagagggacagatccagcttggcttgcataacaccaggttcatcttgaggttgacatttctccttgacctttttgtttagtccccacccgcaaggtcgcattagctgcctgctgagtttaatcaaatctcttcctgtcctggcaatgcccgggaatgaagagataatcagtctatttccagaatccaaagaggtttagaagaaaaagtagctttcatttagctgttggccctcccaccaaccttccccaagtcagctgggtgactcatacatctgtgagaccctccgtatggagaccggggcggggggtgttgcttaatgcttagaactgctgaaactaccagttcactgtctcagcactaatccaactctgctccttaagtgggatttggcttttagacattgagacctggatgctgggcatcctcgctagatcccctacaaattccccacatacgtaggccaggagcctcagcggtgccccttcaggctcatctggcaagacggtaccagcttgctcagaacaggggctggctattcatcatctcagagcatagagaccctctccttgccacccggcccttcccacctggttggtgacaaatcacaaggtatgtgaccaccacaggccaaaaccttatcagaaacctggggcaggtgtggggaagagcaaggatgggcgttttcctgcagacagtatgtcccgccttcaccttttctgtgtggtttccataagacttggttgctatttaaggagacttggagtgagcgggtgcaatggctcatgcctatagtcccagtgactcaggaggctgaggctggaggatcacttgaagccaggaattcgagaccaacttgagcaatacagtcagacccagtctctacaaaaaaacaaaaataaaaataaattagctaggcatggtgtcacacacctgtagtcctggctactcagctggctgaggcaggaggatcacgagcccaggagttcgaggctgcggtgagctatgattgtggcactgccctccagcctgggcaacagaacgagctcctatatcttaaaaaaaaaaaaaacctcagagtatgcttaattctagaccgctaagatggcctcttaattgtaaaacagagtggctatctcttagtaggaattgccaaatagaacttttgggattttaatatattctttttttttaaaaaaagtgataggatcttgctatgttgcccaggccagtctccaactcctggtttcaaatgatcctctcgcttcagcctcccagaatgttgagatgacaggtgtgagccacagtgcccggccattaatatcttcttgaaaacagtctttgcgaagtggttatgttgtggttttcaggaacttttctgatttattcgccattagacacagtcacgatagaactttaaattcaacctggctaagtgtgataacaccaaaggttagtcagaaagtaaaacctcattggaatctagctagactccctggcaaggtgtactgagaaatgtttgaagcttaccaagaaaaataaaatattgaaaacaccccaaagcatgctgcagtaaaatacaaactaagcaaagactcaccgatgaaactcggatgttgaagccggtacaagggcatggtgaggacgcacaggatctcgtgagtaggtttcataactaggatgttcttgacttgatatttaggattgtcttacctttctccaaccctctaacacctgaccaacaccccaaggtggtagaagttgccagggacagataacatggcagccagcgggaagaccagcaagtccgaaccgaaccatgttatcttcaagaagatctcccgggacaaatcggtgagtggtgcacaagtgagtgatttgatagaaattattgtttaaaaaaaatggagctttttcaagtacagtgtagtcatgatcaacatcaaaactctttgagggccagggcgcggtggctcatgcctgtaatcccagcactttgggaggcggaggcgggataacttgaggccaggagttcgagaccagcctggccaacatggcaaaacccatctctactaaaaatacaaaaattagctgggtatggtggcaggcacctgtaatcccagacttgggaggctgaggcacaagaatcacttgaacccaggaggtacaggttgcagtgagcccagatggtgccactgcactctagcctgggtagcagagggagactctgtctcaaataaaaaacaaacaaacactgtgagggccagggaagctttgtgtctatttttgtctctgtctaagatggatgatcactgagctataaatgagtgaatgaactgcagaaatagagcttctcttcagtctcatcaagactttagtcctgtgtccctcagttttctccgaatccctcaatccccacactgtcacccccacctctgcatcttttcctagccagccttgaacccttgacttactatttaaacacagttttgtcagtacctgtgatgcccttggccttttgtctatctattgtgtcacctgcctgggtaaaacccagacagtgatcaatgtgactccttcttctccgtgcacctaccccacccggggggtctcaagcctcagctgggcccgcagggccattggataagggaaaatgccccagtctgccccctttccaccactctccaggggcacgttagatgctccaggtgtgcccatgaacttcctcgcatgggagagggtccaccgtccagcctctgtggatagctccactcgaaagcttcttgtgggccaaaaatctagctcagcaacatctagtgcaagccacatatgtaattttaaattttctagtagccacatttaaaaagtaagaagaaacaggtgaaattcattttgatgttatattttatttcagcccactatatccaaaaaactatcagttcaacttgtaaataataatataagaattattgaaatctgatgtgtattttatgtttacagaacatgtcaatttggaatggccatatttcaggtgtccgggagccaccttaagcagtggctaccctactggacagggtagctcgccatcattctggctttttttttttttttttttttgagacagagtctcactctgtcaccgaggctggagtgcagtggcgtgatctcagctcactgcaacctctgcctcccaggttcaagcaattctgcctcggcctccctagtagctgggactacaggcatgtgccaccgcgcccagctaatttttgtatttttagtagagacagggtttcaccatgttggccaagctggtctcgaactcctgacctcaggtgatccgcccatcttggcctccccaagtgctgagattacaggtgtgagccaccgcacctggcccattgtggctgacttctgaacccggtatggggtccaaagaacctccccatccttaccgtgccacccaggagatccggctttgcctgtgtgctttctgccttctcctctcctagttaaggaactcggtcattttaatcaagtactctgattctttcgttctccaagccctttcccaagttgtatctttccagtccattttatctcaacttctggctgaagaggaaaccactcgtgttggtttcccacgttgttttccccttgctcctagattttccaccaagaaatgtagatggtttttgtagataagtcctcacaggtgggaaaagagaattcaattcctgtctcatgtattcagatcattttgccagcgatgtctgtgtggccccaggcatggtgtgccagggctctgagcccatttctctgtgattctcccgacgctgccctcttctttgaccttcatcctccagcaggtggctaaatgactgcccctgctcctggcgtctcacccacacttgacaacatccagaaggaagaggctgtggtttcctggggtctcttgtaagggtcaggaaatctttcccaagactcttctctcatatctcattggccaaaactgggtcacatgtccactgtaaaccaatcccaagccagaagaattagatgatcgtagtgaatcaggccaatcaagaatcgtaccctggagccggcctcctctgagcataccgcctggtggaagatggtggtccctgaacaatagttggcggcttttatccaggaagaaggggtgtgtggctgttggatgggcccccgaaggctggctacagtctcacatcacccacttctctacctgcccccatcctgcccctgtccttcctgttgcagtggaaggggtagtttgctcccatctgaggttcaccacctcttacaccctgggtttcatggttggccaccttctcaggggcctcagtcattggtctggctgtgtgtgcagcctctcctctctgctagtactttgtctgagcataaaaataagtaccagccaggcgcggtggtttatgcctgtaatcccagcactttgggaggccaaggcaggtggatcacctgaggtcaggagttcgagaccagcctggccaacatggagaaaccctgtctctactaaaaatacaaaaattagccgggcgtggtggtgcatgcctgtaatcccagctactcgggaggctgaggcaggagaatcgcttgaacctgggaggtggagtttgcagtgagccgagatcgcgccattgcactccagcctgggcaacaagagcgaaactctgtctcaaataaataaacaaataagtaccgacctcatgcaccttaagaacaaccaccaactaccctcgaccctatatcctttctagttcttcttcccttgcagccaaaccttttgaaagagaagaaacatgccctctcttcacctgcccttgtctctcccgtccactctgcagtccccctcatcagctccacagtcaggctgcctaactggttctccccttgccgatccattctccagtttgctgctggcatgagctaaatctcagtgctcccttctataaaatgggctgcattcctgtctcattgagttgctgtgaggattaagtgaaaccatgtggtcaaagtgcttagcttggcccctgatacatgataagcactcgaaatgctatttaattcttccaaaagctatttctctatttagctttcctaaatactgtttaattcaagtctttcatcctgcttaaaacgcttcaacgtcttctgaggttctttagggccacgtcctatgagaccatttcagcagcagcagcctgcatccccattcagtggcatggtgaagccattggcagttccagaagcattctcggggccccgggcttcgtatacattttgctcagagagcatgccctcaaccgtcccctgtcctctggctatgccatttgtccaccaggtagagcctcctctgaaagcaagagccttccctctctccttccctcctcagtgccctcccctcaggcttcctccccaccagcctttgccctggcatttattccaggggcacaattgccagttcacttgctgggctcccaaccaaagagcagggaccttggggaccaaggggatgtcttcttcggtttttattttcagtagccagcagctgctggggcctctgtaaccgtgtgtgggatagatgaaagcagtatttgcctaattgacaggcgaagtctagcaaaggagacaggctcctgcaagagcacccagaacacagtgtgctgcacactgaggtgtggtcgcaggccacatgctcccggggcaccaaaagccagggggtgctgggcaaagggagagatggggaccgtgaggtgtcccctgaagcgtgggtaggatttcccccaggtgaaagtgcagcagaagggccttccttaccgtggaaacaataggaacagaggcacaaatctgtggtgtttgggggagctgtggcagagccgctgtggccagagcccagggaagagtggagctgttagagaggatgctctcagggtggccacgcacaaggcgctggggtttattccacagagaaggagtgagcagccagtagacactgagcagcagaatagcgaggtcatagttaccattcctgcaaggcagcctccaaattggttgatttggggagaatttttttttttttgagacagggtcttactctggagaccagtgaagatctctttaccccctttgtgggagagcagggttggagtacaatggtacgatcgtagctcactgcagcctcaacctcctaggctcaagtgatcctccttcctcagcttcccaagtagttgagactacaagcaggcaccaccttgcccgggctaatctttttttttttttttttttttttgagagatggcaggggacagaggagggggtatcactttgttgccctggcttgaactcctgacttcaggtgatccttcccaccttggtctctcagtgttgggattacaggcatgagccactgtacctggccagaggagagtttttaaaaggggctgtttgctagggtgtaggcaggtgtgaaagaaatcacaagaaatagccaggtacagtggtggctcatgcctgtaatcccagcactctggaaggccgaggtgggtggattgcttgagcccaggagtttgagaccagcctgggcaacatggcgagaccctgtctctacaaaaaaatataaaaaattagctgggcatggtggcgtgcatctgtagtcccagctacctgggaggctgaggtgagaggatcacttgatcctgggaagcaggggttgcagtgagctgagatagtgccactgcactccagcctgggcgacagaatgagaccttgtctcaaaaaaaaaaaaaaattacaagaaagagctccatgcgccacacggcagtgacgagcagctgggtgctggcacctccctggggttaagggatgagggatcgcacaattctcagaaccccgaggccctcagggctacctcccaggaactgtgatccccactagagggctgtgccagccgcaggcccagccaccatgcaggcaaggtggggacaaacatctggcccaccttgcccagaagccagaagaccagggaatctactagggcaacacgccctggtcagccccgcagggtggatcttgagggcaaggccaagacacccacagtgtttaggaagctgggactcgctgcagcaaccagcaggtagcagtgtgtgtcccggtcagcccgctgctcacaggtgccaggcttccacaccacccaggctagtgaggcctcccaaacatgcttagcgctgggagtataaggtttcctacggaatcttctctgtaaaccagggttctagtggtatttgctggaagtcacttcagcatcattcatgcgagtaacctagagggcacagggctacgcttcgggacatctgatatgggtgaaaggggagcgtataggagaggacttaatgccaacaaaaatgatttaggccgttcctggaattcaaaatattcattcgaagaagggggccagccaagggggccacactcaatgaaagagtgtactctcattcattggtgcacttggcaaacactgaatccctgtgtgtcctagactctgcagtagatgcttaaagatgtgcagagactccagattactaccaccaagccacagtcctatggattaaagtgctgagggctgggaaacccaaccctgctctcccataagtgggtagagaccttcgttgccaggggcaggacagggccagggcctgtgggcccagatgatggccatccccttcccacccagctccctcagtgcgtggctttaggtctacctgtgcagtagttcacctggtgggatttcaggggcttctccagaactcacacctctttgcgttgtccagaagttctttttttttttttttttttttttttttttgagacagagtcttgctctgtcacccaggctggagtgcagtggaacgatctctgctcactgcaacctccacctcctaggctcaagcaactctcctgcctcaatctctcgagtagctggaattacaggcgtataccatcatgcccagctaatttttgtgtttttagtagagacagggtttcgtcatgttggccaggctggtctcaaactcccgacctcaggtgatccgcccgcctcagcctcccaaagtgctgggattacaggggtgagccaccacacccagcctgtccagaagttcttgtgacaaagaggggctacctttcattccacagctggaaataaaagatttaacatgcaaatggatggcaaaagtctcatttacataattttctttctttcttttttttttttttgagacggagtctcactctgttgcccaggctggagtgcagtggcgtgctcttggctcactgcaacctccgcctcccaggtttaactgattctcctgcctcagcctcttgagtagctgggactacaggcgcgtgccaccacgcccagctaatttttatatttttttttagtagagacagggtttcaccatattggccaggctcaaactcctgacctcgtgatccgcccgccttggcctcccaaagtgctaagattacaggtgtgagccaccgcgcccgggctgctgctggtttttatcatggatgccttagcttagcattctttggcccttagacccacacctgttcttcttgcaggtgaccatctacctggggaacagagactacatagaccatgtcagccaagtccagcctgtgggtaagttgcttggagaaaactgtaatgctggttttcctttaagtcacagataaccgctcactttgtgtttttaaaaactggccttgctaataatctaaataaagacatgcaaattaaaacatcagtgaggcgccactggctgattggaaacaattttatttatttttatttttatttttatttttatttttttgagatggagtttcattcttgttggccgggctggagtgcagtggcatgatcttggctcactgcaacctctgcctcctgggttcaagtgattcttctgcctcagcctcccaaatagctgggattacaggaatgcatcaccacgcccagctaattttgtatttttagtagagatggggtttcaccatgttggccaggctggtctcaaactcctgacctcaggtgatccgcccgcctcggcctcccaaagtgctgggattacaggcatgagccactgtgtccggctggaaagaattttaaagagtgtgaagagacaaaggactcatgtctggaatgtatgaagaacgctcagaactcagcagtacaaaaagcaagatcctatgagaaaatgggggaaagacaggaagatacatttcatcaaagaagatacatgaagacaagcaagcacatgaaaacatctttggtatcattagccactagggaaatacagattaaagctacagtgagagcatattatacacctaccaaaatggctaaaatattttaggttggtgcaaaagtaattgcagttttttgccattactttcaatgtagtggcgagatcttggctcactgcaacctccacctcctgggcccaagcgatcctccgacctcagcctcccaagtagctgagactacaggcatgtgccaccacgcctggctaatttttgtattttttgcagagatggagttttgccatgttacccaggctggtcttgaactcctgagctcaagtgatctgcctgccttagcctcccaaagtgctgagattacaggcgtgagccactgcacccagcagcagcttcttaaaacatgaaacacatacttaccatatgacccaacagttgcatcccgggcacttatctcagagaaatgaaaacttgtgtcctcacaaaaacctatacatgattgttcacagcagctttatttgtggtagctccaaaccggaaagaaccaaaatgtttctcagaatgtcccacgtcagcttcctagttttgatattgtactgtaattatggcagatggaaccattgggagaaactggatgaaggatactagggacgtctctgtactatctttgcaacttcctgtgaatctataatcatttcaacacaaaacgtcttttaaagagtgtagaaaaactggcagtttcagacactggatatgcaaatgtgccttggcaaaacactttctggaaggttatttggcagcatgttatcaaaagccaaatccaattctataatttatttttaaaaagtcatggagagatataaagacatatgtataaggatgttcatcacaatattaattacaatgggaaaaattggaaacaacctagatgccctaacaataggaagtgattaaataatttatggtacatccattcaatggagtaatacatagctattaaaatgattagcacgttttctctatatgtgtgtgtgtgtatatatatacgtgtgtgtatagatgtatgtatgtgagtatgaatagatgtttgcaatgtataattgagtgaggaaagcagttagctgaacagtatgtacaataggatctttttctttacttagtaaaagcattcgtataattaagttatatatgtctggaaaaaaattttttttgtcgggggtgtgggacagtgtctctatcacccaggctggagtgcagtggcacagtcacagctcactgcagcctcaacctcccaggtttaggaattccccctacctcagcctctcacatagctgggaccacaggcatgcaccaccgcacctggcccatgccctgctaactttttttcttttttcttttttgtatgttttgagaaaaggtctggctctattacccaggctggagtgcagtggcatgatcatggctcactgcagccttgacttcccgggctcaagggatcctcctgcctcagcctcctgagtagttgggactacaggcatgtaccaccacacccagctaattttttttttttgtttttttatagagacaggctctcattttgttacccaggctgctggctaattttttttaaaaactttttgtagagacaaggatctcactatgttgctcaggctgctctcgaactcctaggctcgagcagtcctcctgccttggcctcccaaagtactgggattacaggcatgggccaccacacctgacctggaaaaataaaataaaaatctgcaccaagatcttcacaataggtattttcaggcagtaggaatttggatgacttttttccctttgcctgacttttctttctttcttataatgaacatggattacatgtgtaattaaaaacatgcgcagtttttaaagtaggtgtctggtttctttcatcttctccaccctcactgctctctccctcttttgccttagatggtgtcgtgttggttgatcctgatcttgtgaagggaaagaaaggtgagatgaagccccttgtctcaggctggtttctgggcggagtggactgctctctgggcggctctgggaaggggcatttacatggaaggagagacaggaaggcagaggcagcgctcttgcacatggaaccagtgccaggcccactgacccacactcctgtacctaattcacgtgacataggtcctgttgacaccagagctcactcgctcagcaaagtcattgtccagggtggcagataagtagatggtagacggagcccaggtctgtggcccccattcctgtttgctcgcccctgtttcatgtacttctgtgctaggggcaaactcaggagggtgcctggggtgcctaggactcaggaggacacaagaccttgaatgaatgaggggcgagtgagtgggcagtgtttcttctgagtcagtggcgaggggcagttaccgttggggctgacaggcaaaattctcaaccaacaccaaaaagggggaaatgatgcctgctgggggcagggggagtaagacccagaatttattatggtgcttacttcgatggttctgaaccagtgtcacggcgcccttgaagatttctggcagttttgatgtgtgtggtaagtaatttgttactaataacagttgcataaaccaaattagaacagattccagctatccttgtgataatgtcactgactcagttccattctaaatatgcctttttgagtgttgctactggcaacatcaaggaattgttcagaaccctggatgtgccactggaatacgtcagctatggggccatcagcattgagggggcatggctgaaatggggccccaaacggccccctctgtcctctccaccttcctcctgggtgccctgctcctctctggaccaggaggcatctggtttgagccccgaaagcccaagtccttgaccagagaagggcgcctgttctcagggaaagccactgcacaggacagctgtcaaaccacgtggtctctgggcaccttcttagtcctgagcttgaatgaggggcgagtgagtggccactgtttcttctgagtcagcagcgaagggcagttacctttggggcttgcaggcaaaattctcaaccaacagctaccacgcacttggcggggccgcctctcgtgctttatatttgagaaatatgtgcttcgtgtcttttttagaaggtgtagtgaacttcatacaattcttctggtctactgggcgcacacttcaggtctgttcaacaagtagaattttcagaagtgggggtttagagaatgctcagtatgtttcagagcagcgtgaaaaggaggctggaacttgagccttctcaagttggatttcacctccccatgtggcctgtgagccttcaggctcctcactcagcccacgattgaccctggcccacatctgctttgctgcccagcgctgtttccctctgcatcttaccttcttccttcattcgtccagacatcctgccctctagaacctgagcagccagcactgtctcaaagcctctgaggccacagagctagggaatgaagggggcgggcaggatggaggggactgggtcctctgtcttcagatttctaccattctggcaacatgatacaattgggaggaagatgccaggatctccctttagagcggtgaaccctcatgaaggggctgattctccagagtggtgtggagtagctgggtggcagggttctctccaatcccagcccctatcccctccagatgctaaaggttgaaaacccgtgttcgctgcccattccgtcagtggtggtgggtgccaggccgagggccaagtccgaccctgccttcatctcccttgcagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacggtgggtgactcctccggccagccctgcttccttcacccgcagcaccttatcatgtggatgggggcaaaggaaaggggatagaggaagaacttcacatctgcaggcctggaaattgcacccttgaaagaaattctagattgcatggtctgtgattgtctttttttaagtccttgaaaatagcctcttagcctttgaagacaccctttcaacctaccgtttacatatttcccttgacccgaccccctaattacatgagcacgtgttattcctttgcttgctaagctcgaaaaagaaagctcacagaaatgcccctcggccctggggagttctaagtaggaaagggttccctacaggacaggagagcttagcgaagtaagatgtcatctttttccttgcccacagcttgggggatcacaggagatattttcatctctctgggggcccgtctgtcatccattgagacctggctaccaacggtgccagcgtgcaaactctctgaagtcttgggcgtgagctcaattgggggaagctaccatctgctttacgagcatgtttatttgtcttaagagaatatacacttccaaagttacatggttcagccttaaaaaggaatgaaattctgttctgtgctacaccatggatgaatcctgaatacattatactaaatgaaaggacccagacacaaaaagacaaatactctatggtttcacttacaggagatacctggagtaatcagattcatacagacagagacagaatagagcttcccacaggctggggggttggaggatggggagttggggtttaatgggaacagagcttcagattgggaagatgaaaaatgttctggtgatagatagtggtgattactgcagaatggtgtgaatgtacttcatgccaatgaaccgtacagttaaaagagcttaaatggtaaatttgatgttattctatgtttatcacaactgttttacaaaatcacatttacaaaaaagttataaggtcctgggtgctcccatgtacctgtgctgggagtttgaagtgacataaccttttagagacaatatgtcaacacgtattgaaagccttaaaacgtgtgcttctccgaggtcaggagattgagaccatcttggctaacatggtgaaaccccgtctctactaaaaatacacacacacacacacacacacacacacacacacacacacacacacacacattagtcaggcgtggtggcgggtgcctatagttccagctacttgagaggctgaggcaggagaatggtgtgaacccggaaggcagagcttgcagtgagctagatcgcgccactgcactccagcctgggtgacagagcgagactctgtctcaaaaaaaaaaaaaaaaaaaaaaaagtgcttctctttctagcagttcagcttatggaattaattgtctaaaactgatttattacagcattgtttgtaatggcaaaaaagtaaagaccacttcagtagccagcaaaggggactggctacgttaagtgtacattatagagccctaaaaaggatgattcagaactgtattttatgatgtgggaaaatggtcacaatgctttctgaaaagggctagaattaatgaagtgagtaaacagactacagaacgtgatcatcactttgtcccatttctgtaaaacgtcttctcacatatacatatttgggcgtggccagttgcagtggctcacacctataatcccagcactttgagaggccaaggtgggtggattacttaagatcagaagtttgacaccagcctgggcaacatggtgaaaccccatctctagcaaaaatacaaaaattagctgggcatggtggtgtgtgcctgtaatcccagctactccactgcactccagcctgggcgacagagcaagactccatctcaaaacaaaacatacatatttatgtgtacaggcaggaaattttgggaaggttatgttagcaatatgtatttgggtgtcaggagtataggtgaatgtgatttttcttttttcttgcttatcatctttattttctaatttttacatgattatatattacttaatggaacagccccttctgaaataaatgattttttatttgtttctttccacagtttcctgactacttgccctgttcagtgatgttgcagccagctccacaagattcagggaaggttagttcaagaagaaatgccatggttttatggatttgttcattccttcaatagacttttttattgtttttgaaacagggttttactctgtcaccaatgctggggtgcagtggcgtgatcttggctcactgcaacctgtggtttctgggctcaagtgattctctagcctcagcatcctgagtagctgggactacaggtgtgtgccaccatgcccagctaatttttgtattttgtgtggaggcggggtttcaccacactgaccaggctggtctcaaactcctgaccacaggtgatctgcctgccttggcctcccaaagtgctgggattacaggtgtgagccactgcactggctccttcaatagacttttttttttttagatggagtttcactcttgttgcccaggctggagtgcaatggcatgatctcggctcaccacaacctctgcctgacaggttcaagcgattcttctgcctcagcctcccgagtagctgggattacaggcgtgggtcaccatgcctggctaattttgtaattttaatagagatgggttttctccacattggtcaggctggtctcgaactcccgacctcaggtgatctgcctgctttggcctcccaaagtcctgggattacaggcgtgagccaccgcgctcggcccattagacttttaaagatagctttttttcatggaaaatttcaaacgtacccaaaagtagagagaccagtataaagatcctctatgaacccatcactcatcttcagcagttattaaccatgaacatccttgtgaacaaaatcacagagtcccaacccccatgagtctcacacattaaccgagagcaccaggtaaacccaaataacaaggaactacacggcatgccaggtggccacagatgctgtggagaacaagaggcttgtgagagacaaggggagtatctggtgggatgtgtgttgaggatgtttaaagccagtctctaatgaggcaaaggagaaagccacactctcccaggggagagccttccaggtagagggcgcacctcgcctggtgtgttccgggggcagtgaggaggttgcctgctgagtgagaggagcaagggatgaaagggggaggccaagtgcagtggctcaggcctgtcatcccagcactttgggaggctgaggtgggcggatcaacccaggagttcaagactagcccgggcaacgtggcgagaccccatctctacaaaaaatacaaatattagccaggattggtggcacatgcctgtagtaccagctacttgggaggctgaggtaggaggatcacttaagccctggaagcagaggctgcagtgagctgtgatcatgccactgcactgcgctctagcctgagcgatagagtgagaccctgtctcaaaaacaaacaacaaacaaaaaaagtgggaagctgaggttagagtggaaggggaggtgtggccagatcatgaagggccttgtcgatgttgtagagacttgagtttttgcctgaatgagatgggagccattggcaggctgtgaatgacaggcgctgactttccaaatggtcactatggccacagagttgagaacagagttgagatggccaagcatgtgctgtggggactgagggtgtgtgagagaggagtgagtcaggtggacggggctccagcatggaaggaggcggtggggacaggaggagaaggaggtgccaggacccgtgggttcaggccctctaagccactgggtctgggattcatgaggaagggagctacacagagaggcagtttctgtaactggattatgggatgggcagtgataggtgatgacaagggcagtgtttttgtcgcagggcatctgcgacatctgacccgttagtggttcgtgaaatcaatgtagtggatccaaaatggaagggaacagaatggaatggaatagaatagaacagacagggtgcggtggctcatgcctgtaatcccagcactttgggaggccgaggcgggcagatcacctgtggtcacgagtttgagaccagcctggccaacatggcaaaaccccgtctctactaaaaatagaaaaattagccaggcatggtggcgcgtgcctgtaatcccagccaattgcttgaacctgggaggcggagattgcagtgagccgagattgtgccactgcattccagcctgggcattagagcaaggctccatctcaaaaaaaaaaaaaaaaaattagctgggcatggtagtgtgctacttgggaggctgaggtaggagaatcactcaaacttgggaggcggaggttgcagtgaactgaaattgtgccactacactccagcctgagcaacagagcaagactccatctaaaaaaaaaaaaaaatagaacagaacaaaatggaatggattggaaaatctcagagtatgtcacacatggtgaagctgaatatggtgtcaggagagttgttgcacgtttgtgtctgtttactgggctgtgttacaaatccaactttcagaacatctcgaagctagtggtccaggacaatggggtggggtgtgcgcagccaagatgggggaagatgaggtgattacagaagaagggggcacagaacaatggggaatggaattggttgtgttagatcttatagtgctctataagagagaccccaaattcagatttttaggtgacctttcttgatttttacaacactgtataggcccaacaaagcaccacctattttctgttctaggagaggagcaggtcttagcacagctgcagggcttcaggaaagtgggtgcgccctgagcccagggagcttgagagaagtgcctgaatgcctgggggcctgggggcttgacagctgagaagcccaggtgggcgagcagaacaggcgttggtgtggctcaacaacggccggctgatggcagggaaggatgcatatttattttccacttagagtttaggactgctatgattccctggttgcagaaccaataaatccgtgcctcatatgtcaccatggacagagctggcttcctgtaatttttgccagctctactttcccctccaggcagtggtggagggcaggccggtgccctcctctggctccccaacgcatgtgaacgtgcagagatgagggaggttacaaagggcttgcactgggggccaggggcttcacacactgggaatcgggggaaggtcactggcagatccgttcattcagcccacacaatgcttaaaagtctttttatttaatttaaaaactaggagatttcactccaaattccacgtgaagtttcttttttaaaaatcaagctggctgggcgcgatggctcacacctataatcccagcactttgggaggccaaggcaggcggatcatgaggtcaagagtttaagaccagcctggccaacctagtgaaaccccaactctactaaaaatacaaaaatcagccgggcatggtggtgcacacctgtaatcccagctactcaggaggctgaggcaagagaattgcttgaactcgggaggcggaggttgtggtgagccgagatcatgccacttgcactccagcctgggcaacagagcaagactccatctccaaaaaaaaaaaaaaaaaatcgtgctgcccgcactgggtgccttgctgcctggccacatgaggctgccgctgaacagcaggtgaccatgggggtcagggtttccataccctatcagggcattcctggaccccagcgctggccctgtgagtgcctgtacctctggcccctgctgtaggcagtggaagtcagtaagatgcatgggatcacagttggggacacctaagtgtgcaaggtggcaggaggcaaggatagccaggatgtgaatgactctccacggcagcaggagggctcatggggcaggtggatcccctccctctgggggctttgggcccatggcacactccttgcgctactgtaattgtttcactgtcagtatgcttccaaatccctaaatggtgcaaccccgaataggacatggccaagacaaaaagagatagtgccacatcatgtgccctgtgtgaggtgtggccctctggcccggcacccagggagggagtcgctgatcgctgcctgtctgctctctctccccaacagtcctgtggggttgactttgaggtcaaagcattcgccacagacagcaccgatgccgaagaggacaaaatccccaagaagtaagagtatggttgcggaataggtgaggggtctgcggtgggggtggagagaagagacgacctccaccttgtctctgtgggacagacctcttcccatagggctggcacggctggggtaccatctgcatgtgggatggaggtcaaaggttgatcatttttggggaaaaaaaagaaaacaagaaaatgacagggaagttagcaacctccagggctcacgtaagccccgaaaagctcccgggtttcccctttgttgaagttttgttgttgttgtttgtttgtttgtttgtttgttttttgtggtaaaatgtacacaacatgaagtttgccattttaaccacttttttttctttttttcttttattttttgaaatggagcctcgctctgtcccccaggctggagtgcaatgtgacctcggctcactgcaacctccgcctcccaggttcaagcgattctcctgcctcaatctcccgagtagctgggattacaggcgtgcgccaccacgcctggctaatttttttttttttgtatttttagtagagatgggtttcaccatgttggccaggctggtcttgaactcctgacctcaagtgatccgcccgccttggcctcccaaagtgctgggattacaggcgtgagccactgtgcccggcccattttaaccacttttaaatgtaccattcagtggcttaagtacattccgaatgttgtgtagccttcaccgctgtctatacccaaaactttcccattgcctgagcaggaactctacaaccattgagcctaccgctccatccttcccattctcccaccccctgtgctgttttttttttacctaaacaagatttccgcctggcccttcgcactgtctccttgtgccccatgtacacatctctggaggcgcaggatagtgagctgcagtaatggagctcgcatgtatatggcagctattccatgaggcccttgacgccctcacaccttagccttgctgacaggaggcagagctgggaatccacggagcctaaggggctaagcttggccctcgggatgttgcctggccccacagcttcccccacagggaagggaccaggacccagacccccaggctcttccaccgtcagggctgcctcaggctctgaccagtgtcgttgccctcttcccgtccaccctgtctccatggggagcattcctggagaatctccatgtgacagtggggagagaacagaagcctccctaaagcggcctgggtgccaatccctggcttgtctgtggctgtttcccacaggagctccgtgcgattactgatccgcaaagtacagcatgccccacttgagatgggtccccagccccgagctgaggcggcctggcagttcttcatgtctgacaagcccctgcaccttgcggtctctctcaacaaagaggtaaccacctaccatcgctactacccgcagggcagcaggcctaggggcaggccccacacccctctcttcaccagccccagcccttaactacatgggtgccttgcaaggaagcttgtttctaggataaagcaccaacatgcgtaagtgactggcctgttttcacagcctggagctggtcagcatggtccttagaggaggacggaactggcttgcgttccacccactggctgtcccgagggactggggaaggaaggggcgctgcttttcacatacctgccccccagctgtccttgtcctgtccacctccatgggccttgttcactcatggagcatcaatagctgtggtatcccaaattcttcacttcctgggaaatttaagttttgcagaaaccatgtgggatggcagtgtcacctgtgatgtcatctcttaggggtgtcatggtgggaaaaggtgagagctgctggccaaggctggctctggttcctctggtcagcagtcagccatttgtgcactgtgtgtatacacgtgtgtgggtgtgccaggggctgtgttacacgggctctgctgggtgggatgccagcacttggctttcccagtggtttcctttcacttcactcatcctgcccccataacctcctgacccctggcctcctccgatgtgatgatcggaactctgttcccctccccagcttcccacagatgggtggaatgtgtttcaggcccttccttagaagaaatgtattgctatcacttcatcttccttaaattctgccgcttttattccagtgaaagggattgagatgaatctagaaagcagtaagattaaagacaccgccacatctgttctcttcttctgacctatctgctgacttttctagatctatttccatggggagcccatccctgtgaccgtgactgtcaccaataacacagagaagaccgtgaagaagattaaagcattcggtaggaccttcttctcagaagtagagggcatagtcttctagaatttctgatcctgtttcctgagaggtcacttctctggtctgataaggcccttctgggtccttggaactggctacttgtctctgctgtcataggcagcaggactgcggagggagaaaggccttacaagttatctcattcaacttcctgcccacttacggctggtttttgtcttggaacaaaattcctggcaagtgatctctttccatggttatgccttcctggagggccccacagtgctcattgtggttgacagatgcagcacattgttgtgggtgaggcctaatttgtggactcatgctgtgggctctgtgatcccagctggcatccacagcaggggctccttgtctaccttcccaggctttgtgtggcttgaaggaggtcccacatggaagcgctttgtaaatggtgaagtgtgactgtctcggctcaaatggccatcatgtcatggctgaccttcccatatcctacaggggaggtgccttctgcctgttgttcccacacattaactaagctcaaaaagcatcaaagcacagggggtcttatataatggtcttatttggctctttcatgaggaagacatgatggaatgacctgtgagggtaacctctaagttcactttttaactcaaacattcaatgaccaagacaaagttagacttatgcatcttggggtgactgtcccagggcccaggactgaggatgtggaacttccagtcctaaaatgggctctcccgggcaagccagggtgagcagtggccctaggtgtcatataccacttttccctgtgagtcatcacagatgagggtcagaaatcctgatgcgtgcagactaaggaattctagacttttccctccctcccttccttccttccttccttccttccttccttccttccttccttccttccttccttccttccttcctccctttctttcacagtctccctctgtcacccaggctggagtgcagtggtgtgatctcggctcactgcaacctccagctcctgggttcaagccattctcctgcctcagcctcccaagtagctgggattacaggcgtgcaccaattttgcctggctaattttgtattttcagtagagatggggatttcgccatgttggccaggctggtttcaaacccctgacctcaggtgatccatccgcctcagcctcccaaagtgctgggattaccggtgtgagccactgcacccggatagctgttaactttttaaaaacaaaatattaattgctttctataggctgggcactgtactgcatgccttgcacaaattgtttctttatcctcaaactttggctgagtgcagtggttcacgcctgtaatcccagtactttgggaggccaaggtgggaggatcccttgagcccaggagttcaagaccagcctgggcaatatagggagaccctgcctttattttttaaaaaaatcctcaagcttaattttaaaggtgattaaaagtcatctttttaatcatcacaacgtccctatgagttagatgcaattattacccccattttactgatggggaaactgaggcttagaatagataaataattcaccccacagttagtggctaagccaagattggcacccaaacagcctggctccaggcccaccttcctatccaccacgttccacccaccaaccagtcctgtactgcctctagctagtctcttggaggacaggaaggacaatgttcatgaagtaagatggaggatgttagaaagggctgagcaggggaaaggaggggtctcccaggagctgcagccttaggggacatgggtgggagttgatacagagcaggttatgggtgaccagaaatggcctggagacaggacttcaaaaccccagccttgaagctgagggctgagaaagcctagccttggaagtggagggaaaccatcatcagagaggagagaccagcgtgtaccctgggaggccgcagggaaagtgcacgtgttgggggaccagtgctgaccaccggactcccgtcttccccttgcagtggaacaggtggccaatgtggttctctactcgagtgattattacgtcaagcccgtggctatggaggaagcgcagtgagtagctgttggggtttccgtttcctgggcgtctcagccttctgtgtcaagtttctcgccgtttattgctgaagaaggaactagaatgttcagctagctcgccagccttccacttccttcctctttctcccttcgagggctgcacagaaagttagcatcttagctctgcatctaccacacccctctgtgcccatcttacaggagttctgaggattaatgcaagccaaagaatgacgcagaggagagaaataaagacagaaatgtcaccatgggatcagctggctttttctatttatccttggaatgaattgttaggaatttggtactatttccacctcccagaagatggtcaaatgaactgtcagcccaggctaggattccctatcttttgatctcaaattgaaatcttataccagtgacaactggattagaatatatctgttcttagcctgttgttgtgaatgacttttcccctttgttagaatcaaaaacaaatgagaatcctgccatggttcctttatgctggcctgagagacctgcccagctttgctgtgtgccacaaagtcaaatagattcatttaatacatggcttggagtggggggcgatgatctcccacctccagccccccgagaggatagctcgaccaggtcttaactctttgccttgctggcatgttctaagcaccgttgtatgtaaaaaatattatcagggttagaggaaggttagggtaggggaatgatgaaagacaactgattccttaagataatataaggtaatagatagatttttttgagatggagtctcactctgttgcccaggctggagtgcagtggtgagatctcagctcactgcaacctccaccacccaggttcgagccattctcctgactcagtctcccaagtagctggaattacaggagcccgccaccaagcccagctaattttgtatttttttttttttttgagacggagttttgctcttgttgcccaagcaggagtgcaatggcgcgatcttgactcactgcaacctttgcctcctgggttcaagtgattctcctgcctcagcctcctgagtagctgggattacaggcacacgccaccacccctggctaattttttgtatttttattagaaatggggtttcaccatgttagccaggctggtctcgaactcctgacctcaggtgatctgcccacctcggcctcccaaagtgctgggattacaggagtgagccaccgtgcctggctgattttgtatttttagtagagacagggtttcacctgttggccaggctggtctcaaactcctgacctcaggtgatctgcttgcctcagcctcccaaagtgctgaaattacaggcgtgagccaccgcacctggcctatatgggaatatttaaaaggcaactttaggagaaactattactgttattcaaaacagattcaaactgtaggtctacaagggagggagacaggaaagaaccaccactcactgcctcctttctgccaagattgggctctgttctgcctttaggggatcctcgcacatccctgtgccctggaggggtcttggccctggttcacctttcctcatgtgctcagcaacatgggagcaaaggatcctggctgagttttcccctaatatgtattccatcacctggtcctctttcaaagtgttgggtgcattttgggtcaaagattcccaggaaactggaaagcattccaaagtcccccaaaggctggaggagcctgggagctggactggaccatgctgacaagtctgaagctagaggccactcagaaagctgcagagcaggagccatcgtcccagagccctgtggcttctggggctttagtgggcaggcttccacggaaccaggacagacctgactcccaagctgctccccaccatccaaacccacatcctgaagctctggggagtggccccagagccttggcatagtcctttggcaagctctgcacaaacacaaaaagtccatcctctgagcccaaccccaagggccctcttcctattccagccatctttacaatgctgtttctgcttttttcaatgctcaaattacgctcattaagagaggttccaccaggacccagatggtaggatgtgggccaccttgggctctggcagatttctgtaaagagcttcctgtagacactggaggcaggataggggacagctgcttttacctatccagggaaacttgattagggaaaggaagtcctttcccagagaggcagttcagacttccagctgtctcaggacagccttagaatggtcctgatgctggccacaccccaccttgttctggctaggcacaggatggagggtgtgcttccggcacgaatgggctctgctgtcagagagtgtgcagccacgtgactgtgggcacacttcccgtctggaaaatggggatcttggagcacctgcttggtatggggttgatgagggtaaggtgagagttttgaggacaggccttagcacttggcctggcacacagcatgcacgtgagtggaggagccaactctccagccgcagaggctgcttcatgatcctggccatgctgccgtgtgtctgcctggagaaacacacattgctgtgtccccagctggatcccagacccgcctgttggcacagggtctccgccatctgtcagatgttgagaaatctataccccgactgatgatgaagaagatccagtagagaaagagcatgtgctgctttggacccaagctattcggtctgtgtgatccacaaattgtgggtccctgcgttgcccctctagacaacttaccacacagtcacactgtgacccccttatagtgacagtttttggtgacaagaggctttctggcctggactcgttgctgacaccaaccagaaggttctgcaggccaccgtgtggttcacaaagtctcaggaggaggctgtggtctctgactcttgagccagtttgtctcattaactccatagaacattctagaaattcagcaattcagaataggctgagttgcttgaagaaatatcctcctgttgctgccagcccaccctgagatttcacaagcactgttctgcttctcgtaagtcaagttcccaggctcttgaacccaccttcccaggaggtccatcaggggatgtggatcctggaaaatgcctaatgtcaaataggggctcatggggtccatggcagctttgatggttataaatctcctctgttcttcttcctctagagaaaaagtgccaccaaacagcactttgaccaagacgctgacgctgctgcccttgctggctaacaatcgagaaaggagaggcattgccctggatgggaaaatcaagcacgaggacacaaaccttgcctccagcaccatgtgagtcctcgaggctcagggaataagccctggcagggcgggctggtgctggtctgcttcccttcacatcaccctgctgggctcgcaggcacgcacgtgcagcatggtggtctggcgtgtgtagtgtggagtgcatatctacgggcccacacaaggatcccactctcacccctggtgtgatgtgggggttacacccatgggccttggagacagctgtgcgctaaccccagctctgctgctgaccctgggaaaacaccttgagttctctgagaacctcagttttcctgtttgtaaagtgggggcggtaatagttcaagtctcatagagtgattataaggattcagtgagacaatccatgtgaagcgtggggcctgacacacagagagtgctccaggaatgtcagctactgtttttagaagtatcactagctagtgtggtgccctaagcatgtaaactgagtaatgctcttggctgtgttcattcattcattcattcattcgtccatttccatcaggaattgtaaagaacaggaggtcctaatgactttagatgtccattaaatttaaatgaaactaagtactgatctgctgaccctgactcaaaggacgactggctgaatttgggcagcagatctagcgaagactatacagtgaagttcccaagtcagcgtccactgtccttccaagccacgcttttgcgcttcccttcccgggagcatgtctgtgggctcaaggcccactcactgccacctccccatgtgatatgctgggggttccctctgtggccccagtagaccacctccgaggtgatgccaatggctgggagactggattgtttgaccccatgactccgatgctcagtagctcacactctctgagaccaagagtggggaacagtgaacaattggcagaaagcaggtggaagtcaaaggattttctgaggataattggccaagttactgtgttagattctaaagcacattcgtgaagctccgggagagagaatatcagggaaactgagagcctagatcaatgtattcaagggcgtagggatcgtaagatgaacaatgatggctcaccacactgtgggaatgtttcatggtgtgtggactagtttctaaacatgtacgactcggccggccatgatggctcacacctgtaatcccagtactttaggaggctgaggcgggtggatcacctaaggtcaggagttggaggccatcctggccaacatggtgaaaccctgtctctactgaaaatacaaaaattagccaggtgtggtggtgggtgcctgtaatctcagctactcgagaggctgagacaggagaatcgcttgaacccgggaggcggaggttgtggtgagtcgagatcgtgccattgcactccagcctggtgacagagcaagactccatctcagaaaaaaaaaaaaaccaaccaacaaaacaaaaaaatcatttatgactctccacacctccatgaggaaggtatatttatatgcattttatgggtaaggaaattgaggttgagccagaatgaaagacttatccaaggtcactgaatcagttaatagcagagcaaagtccactccacagcaaatctcccagcccaggaagatgccaggggttctgacttgcagggtgttctcaggcacgtggcagagcatgttcagttcagcagctgcttggccccattcagcgcaaggtagagttaatctcagctgggaggagtagctcacacctgtaatcccagcactttagaaggccagagtgggcgaatcgcttgagcccaggagtttgagaccagcctgggcaacatggcgaaaacccatatccacaaaaaattaaaacattagctgggcatggtggcacgtgcctgtagtcccagctatttgagaggctgagatgacaggatagcttgagcccaggaggtcgaggctacagtgacctatgatcatgccattgcattccagcctaggtgataaaatgagaccctgtctcaaaaaaaaaaaaaagtcaatcccagcaaagagggggatctcaagcttgtaccccttttttccctttggaggtatcctctcttcaccaggtacttggccatactccgcaagtccagataaagatattctgtcctcttttaaaaattatttttatttttttttgagataaggtctcagtctgtcacccaggctggagtgcagtagcgcgttcttggctcactgcaacctccacctcccaagttcaagggattctcctggctcagcctcctgagtagctgggattagaggctcccaccaccacgcctggctaattttgtactttcaatagagatggggtttcgccatgttgtccaggctggtcttgaatttcctgaactcaagcgatctgcccgcctccgtctcccaaagtgctgggattaaaggtgtgagccacgacgtctggctattctgtcctcttttaaatgagctccagacgccagtgagctgaaggagctctctggggagcactgtggtcctggaaacacgtgcttgagacacctcccctcagaggttcccgagctgacgtcttcttccaggcccagcacctgctggccgccgccccaactctttttccagagctgttccatccttccctgccttctgcctgtagccttcaggtttcttgggctttttttctatcattatttacatgatttttgttagcatttcatgatttttttcatatcttaattcctgttattggacatcctggagtactcatgtcctccgcgttggatcccacgcgataagcatctgtgatgaaatgcccggcacagtgcctgccagatagtagaacttcagtacgtattagtgggatctggaatgacatttctgtcaaggaacgtcacattgcactgtctttggggcacatctgagggtctcgcacatcctgctcattcacttaaacattgacagctctcacttggtgccaggtctgatgctgggtgctggggacacacagctggatatcttggaaggcaggagagaaggagggggcattctggtgcagggttgtgttggcaagactggcgcggggggcgctgggacacagctgggggtgaagtagcaaaggcaggccagggcagctcacaggctgcttctgaggctgaacctgcagatggccacagagctcagagaaggggcctggcacgtgggagatgagttactgagataatccaggcaggcaaagcctgctggaggacttggggacttgcagttttggcaagtggtaggagggagttgctgaggaggatgaccgggggatgtgcatctatagaggtcaagcacagagaagggggttgcatgctctgccctctgggaacttctagaggagaagacacaggaattcctccagtgcgtgcaaggagtccccatacccactccccaagtacatgaacttctaggactttggaagctcagtgagttcaccagtccctggagaacctccatgacggcatgcctgcctcgaatggaaaggctgcccatctgctcttcaccctcctctgctctccatcattctccttttcccttctgtttgggcagcattaaggagggcatagaccggaccgtcctgggaatcctggtgtcttaccagatcaaggtgaagctcacagtgtcagggtaagtgtcccggcaccaaccctcgggctgctctgtcctggtcttagatggtctgaacttttcctttcctgaatgactgggagacagaaagcaaggaaaggcccatagcttctaccaaggattaccaagtagagcttgggagagattctgtttgtctagtaccatgcttctgtctgataaaatgtcaggtgggaaagggtggagaagcagactctgaaatgtgtgcattcttagcgccactttgcaaaaatacgtgtgcatatgtgcatgtggtagaagctgatgtgcaagaatgaggattagtcaaatgttatccttcagaaaagaataactgctgtgaaagaactctcagtaaatcttcatgtttttgcatcttagaaggtatccatccataaagtggggactttcccctcccctctcacacatgtaatcacagggcacaggagtcttcttttcatacaagagtgccaatatctcagagttttaagggaacaggtttccactttcattttcatgtgaagccagtttcttccatttgtttaatcttaccaaaagggaaaaacttgaattctcattttcgtttcaaattccattgccaaaggctctggccttttacctggatgagccttgggtagttctgccatcaaaggcaagtctgtgcctaggtttcatacttctaagtagtaaagaattcccttgaggaaaataagcgtttaaaaagagtttcccaaatttctaacaaagtagaacatgggtctattttgcatttttcgttagcatagtgtttttttttttttttttttcactgtggatagtgcataaaaggatctaaaaacagggtggagtttcttttagcagtcaaggaaagcaaccagcaggtatttcacaatgacctcttgtgacttatcttgaatgttagggcttgactttttttttttgagatgtaatctctcactctggagtgcagtggcatgacctcggctcactgtaacctccacctcccaggttcaagtgattctcctgcctcagcttctgagtagctgggattacaggtgcccaccaccatgcctggctaatttttgtatttttagtagagacggggtttcaccatgttagccaggctggtctcgaacttctgacctcaagtgatctgcccacctcagcctcccaaagtgctggattacaggtgtgagccaccgtgcccagccaacttttttttttgagacggagtcttattctgtcacccaggctggagtacagtggcatgatctcagctcactgcaacctccacctcccaggttcaagcaattcccctgcctcagcctcccgagtagctaagattacaggcgcctgccaccatgcccggctaatttttgtatttttagtagagatggggttttaccacgttggtcaggctggtctggaactcatgacctcaagtgatccgcccacctcggcctcccaaagtgctgggattacaggcatgatcccccatgcccggcctttttaaactaatcatcttgagaaagagatgaagtcacaggtaatgaagttgaacattaagggatgggaagaccctggatgttgtgagttcgggtgcaagggccatgagagctgggctgtgtcctgcctctgaatcatgggaaagggtcgtgttaccactgtgacagttaacgacaggcgtttgtttgtgttttctagctttctgggagagctcacctccaggtaagcctgttcaccttccttgtttgattgtttctcaagatatcaaaggcagcaaacttggggctccaaaacggtttctgatgaaagctgctttctggacagttgtgctcagaggtgttaggaatgatgctttgccttcggatgcatcacagaaccgtggctcataggcgtttctttgggaccagatttctttgggaccacagctagacctatgcctgggtaaggacacacacatacacacccagaaaactggcacactccatgcagccagcttgtgtgtgtgtgtgtgtgtttgtgtgcggtaaaatacacataacataaattttaccattatattatttattttattttttgagatgtagtctcactctgtggcccagcctggagtgcagtgacgtgatctcggctcaccgtgacctccacttcctgggttcaggcaatcctcccgcctcagcctcctgagtagctgagattacaagcgtgtgccacaacacctggctaatttttgtatttttagtagagacggggtttccccatgttggccaggctggtctcgaactcctgacctccagtgatgatcctgccttggcctcccaaagtgctgggattatagatatgagccaccacacctggcaaattttaccattttaaccgttttgttttattttattttattttattttgagacagagtcttgctctgttgcccaggctcgagtgcagtggcatgatcttggctcagtgcaacctctgcctccttggttcaagcaattctcctgcctcagcatcctgagtagctgggattacaggtgcacgccactatgcccgactaagagctgagatgatgcagtacataacctcaatgcctgtctcaaatgtttcttaacttgctgctgcttcgtgcataatttaaaaggcagctgtcactatttgcaataccaaaaggtagaaacaacccaaatgtccaccaacagatgaatgggataaacaaaatgtggtatatccatgcaatggaatattactgagccataaaaaggaatggagtactagtacatgctacaacatggataaaccttatactaataacactacgctaagtgaaagaaaccaataacaaaaggccacatattgtatgaatccatttacacacaatatccagaacaggcaaatctatagagatagagaacagattagtggttatgccagggactatagggagggaaaatgagagtgactggttaagggggatgagattttctttttgggtaataaagatgttctagaactagatagtggtgatggttgcataacagcgtaaatgtatttaatgccaccgaattgtgcactttaaaatgatgaagctgggcagggtggctcatgcctataatcctagcactttgagaggctgaggcaggtggatcacttgagatcaggagttcaagaccagcctgggcaacatggtgaaaccccatctctactttttaaaaatacaaaaattagccaggccatggtggcatgcatttgtagtcccagctactcgggaggctgagataggagaattgcatgaacccaggaggtggaggttgcagtgagccgagattgcgccactgcactccagcctgggcgacagagcgagactccatctcaaaaaaaaaaaaaaaaagttcccactgcattgtctttcagcttgggcctggggatcttttgtgactctccgcagccataggtctttgctgtgttacttacaattgtgtgtatgggtgttcacaccaatcttcattctttttttctagtgaagtcgccactgaggtcccattccgcctcatgcaccctcagcctgaggacccaggtcagttatgtccttttttagctttctttaattatttgctacttgcagatttattgttgatgtatttctagtctttcttgaccgcatctcagagcatgggagtggccaggtgtaagagattccatgtgatctacaaggtgaatagtctggggggaagggagggcccatctgttcagcgctgagccgggtagattatccaccttcagctggagtctgcaagatgtagcatccttgctcttggacagggacaatctcgtgaggttttatcatgaatgatttaagagcagaagctctgctgtcaacagacctggatttagaattaaagatgatttaggtaaaaacttaattttagagcacgaggattttgcatttcatttggaaacaaaaggcctcatgtttcatttgaaagcattaacagacatttaaaagaagataatttttttttttttttgagacggagtctcactctgtcacccagtctggagtgcagtggtgtgatcaagcttactacagcctcaacctcctgggctcaacccaccctcctacctcagcttctgaagtagctggaactacaggcataccaccacccttagctaatgtttttgatttttagtagagatgaggtcttgccatgttgctcaggctagtcttgaactcctgagctcaagtgatctttctgcctcatcctcccaaagtgctggggttacaggcatgagccactgcacctggctgaagataactgtttttttttggggttttttttttttttttttttttctgagatggagtctctgtcacccagctggagtgcagtggcacaacctcggctcactgcaacctctgcctcccgggttcaagtgattctcgtgcctcagcctcctgaatagctgggattacaggcgcctgccaccccacctggctaatttttgtatttgtagtagagacggggtttcgccatgtcggccaggctagttttgaactcctgacctcaggtgatccacccgcctcagcgtcccaaagtgctgggattacaggcgtgagtcacggcgcccggcctgaagataactatttttgacagtggcagttatggtaagaatacagaaaatactagaaaagagggtcaggctgggttcctgacacctcagctcatttgaattataaatctactggctcttgtatggatgcgaaatgatgcaatagttgtatgactctgaaaacatataaaaaccactagactgtcgactgtgaaaaggtaaattgtatgatatatgaatttgatctcaatcattctctttctaaaaaggtaaatgaagcagcaaaaataatataggtgaaatctcagaaattctgaagaaacattctctgcatcgaggcagcttagttgacgggaaagaaaaacagatctgtctaaatgagaactctccgtaggtataggaataagggatattttaagtaaaagtggtataaacaagcagggtttatttttctcatactttacaaatagcttttctatattggtagtgaaatgccgtttaaacattagaatgagcccccactattcattttaggttttgtctcaacagtactttgtttcaaaatagctcttccaaatactttggattcagatcctcaatgaacttttccaaaactgtcccttggagaaaaatgtagtccagctatatgttttcagttcatttatgcttgtgtcattaaaatgttactttttcatggtgtgggattaagatgctttctggttcctttcaaggacattaaaaagatagtcacttgaggagatgtcatagtttatgttgggttgttttctggaactttgagtagactttatgccttaattttttttttttgagacatagtcttattctgtcacccaggctggagtgcagtggcatgatctcggttcactgcaacctccgcctcccgagttcaagtgattctcctgtctcaacctcccaagtagctgggattactggcacgcgccagcacgcctggctaatttttgtatttttagtagagatgggttttcaccatgttggccaggctggtctcaaactcctggcctcaggtgatctgcccgcctcagccctccaaagtgctgggattacaggcgtgagccaccgtgcccggcctgacttaatttttttaaattcttttccatatacaactttcacgttccagtcattatggccttaacagtgaacatatcacaatgtcaggatgaaacaatgatcttttgtactgtgagatttctgggagcaaaggttaagacaaatcaccccatggttacaaaattctgatttctagagatatgagatagatatgagatagatgagatttctagagataaatgtcatctctcctgtcttctctgcctagttctcggctccctgagtctaggctggtaggattctaagcagagaaagcataagctatatgtagttaagccctgctggagcctggggaccaagtaatttgtgtgtaataagtgctgtgacatgctaccaagtttttattgtcccctgtcaagggcatctttactgaatccgaagatgctgatttgattcttccttgttgtctacctctgcaaggctgatggtcccgcttagtgtaatttcttcgctgagcactgtgggccgcagggtatttcttgctcaggggatgttttgacaagctagcctctctagggcccctgtacgtagcgaccctcatagacactccctcccagtgctggcttccaggtgggcaccagaggcgagagtaggggctcaccatcaaatcgccgctgtgctccccaaaactaggtgggcagaaagctaaaaaagtacaaaaaccattcaaattaatagcagttagtctggggatacaacacatgtgaaaacataactcaacaacaacaaaatcaatatgttaacagaaattgaaaactttgcggctgggggttggtcctcaagctttaatgcacactctaaccctggggtgctggtgaacgtcaagtcccaggtctcaggcctctgaagcctgacagatggaggtgccagggtgcacatgctcacggcaccctggcgaccctgacctcaatggggtcccgaggacatggaaggagaaatactttgaaaggcgaagcaactggctgggcagggaggccaaggcgggcggaacacttgaggtcaggagttcgagaccagcctggccaacacggtgacaccccgtctctactaaaaatacaaaaattagccaggcatggtggtgggtgcctgtaatcccagctacttgggaggttaagccaggagaatcacttgaacctgggagacggaggttgcagtgagccgagattgtgccacttcactccagcctgggcaacagagcaagatgccatctcaaataaataaataagaaaggagaagcgacatcagagggggcaaggctgatcagggaaagcatcctagagttgagactgggggggtttcatgtgaggaggtgaaggctgtggcacattgtaaaggaagcagtgatttaaaatgcaaggagaggccgggcgcagtggctcacgcctgtaatcccagcacttgggaggctgaggctggcagatcacttgaggtcaggagtttgagaccagcctggccaacatagttgaaaccccttctctactacagatacaaaaattagccaggcataatggcgcatgcctgtaatcccagctacttgggagcctgagacacgagaaactcttgaaaccaggaggcaaaggttgcagtgagcagagattgtggcactgcattccagcctgggtgacagagagagacagtctcaaataaaataaaataataaaataaaatataaaataaataaaatgcaaggagaaaagctgttccagtgggaaaggcagggaggcaggaattacacgcagtgatcatgaactgcatgtatctaggccttatctctcaaattgtaaagtcacctaaaaggtagacattttctaggtacagctatgatatagaatttagactaacaaatgtctctctctccctcttccctgcctcccttttattccatgcttacagctaaggaaaggtgagtgagcctcttgaatgtggccctgatttgtcctatgctctgggaccttctcctccagcacaaaaccctctttgagtctttgcacatatcccaagctctcctgccggctcaggaggcacatccgctacttcccgtctgctccctagtgcttacggcacgcacgcaccattacactgggtgtgcttgctcactctgcgcgtgcctttgttttctcccattggtgctagttaaaggaattttaaacgaagccttgaggaaaatggcgtgcccccatgttctatcatggggaaaaccttgatcagttccttcgttgcaaaaagatcaaggatcttgtttcagtttcagcttcaaagggcgtgcaatgatcaaaatgttgtttgttttattttagttatcaggatgcaaatttagtttttgaggagtttgctcgccataatctgaaagatgcaggagaagctgaggaggggaagagagacaagaatgacgttgatgagtgaagatgtcggctcaggatgccggaaaatgacctgtagttaccagtgcaacgagcaaagccccacagtttagtcctttggagttatgctgcgtatgaaaggatgagtcttcttccgagaaataaagcttgtttgttctcccctgggtcatgagttggttgatttgttggggaggctgagttgatgacatgacacaagctgccaccattagggtccctggagtgggagggttggggagagggaggccagcctcccacggaagggctcaccactcccatgagggagagaaggcgtctggaaatcaatgtgctcaccaggtggggccctcggtgtgtccaggggctttcctaggagtcccagtctgagctgtttctctggaaacagtgccttcccgtctgtccgtctgtccttccttccttccttcctttattcctccctccctcccttccttccttcgtttcgctcttgttgcccaggctggagtgctgtggcgtgatctcagctcactgcaagctccgcctcccgggttcacgccattctcctgcctcggcctcctgagtagctgggattacaggcgtgtgccaccatgcccgcctaattttttgtatttttattagagacagggtttcaccatgttagccaggctggtctcaaactgctgacctcaggtgatccacccaccttagcctcccaaagtgctgggattacaggcgtgagccactgcgcctggccaccagtgtatgtttctaattacctgaccagtcccaacttccaggcccctaaagagcctcctaagttaaatagggcagagaacatctgtggacaaaaatactcttggttaatgattcaacttttgggtccaggtgtctgtttgagctttgggttgttggtaaagttctattcaatgcaagaagcaaaatcagatttggttaaattaaggtggggagaaggaatgtagtgggaggaccccggtgtgatcagagaactgaaggacaaacctgagctgccacacctggggtaagcaggaatcagagaagcttcaggggtcagggacccactctccagggcggctcttcatgcagctcagcaccatacgttcccagctctgcgtctcttggtcccagtgggcagttattgggaaggagaatccaactggctcagctttggctgggaggatcaacaccccgtggtcagcgatggcagagcccagccctggagatggagagtcccagaaaagggggttgattgtgagtcacatgggcttacttagagcgtgcttcactgagactgggcgtgagaggcataggggagagcactctgagtgtcagggaggaaggtgaactgcaggtggaggagggataatagaggtgataccagggcctttcctttgtggggtcccttcctgccctgaggtacccaccgggcctgctgctgatggcacagatactgaacaggctcatggcggccaaggagaggatggagatgcataggctctggtccatctctggtccatgctttaagggagcagggtaaaggggggttggagattcctccacagttcaacccactcacagaaggcagagggtgagtgggaggggttctagatggggagtacacgtggatcaggcttctgggatggaacatggcgacagagggctggccagggtatgggttccatacacatgaaggttcccagcatctggggttgttcagaaggattccagctgttcgggtcctggagattgggatttagatgaggaggctccacttgggaagcttggatgggatcccagacaaagcgaggtgtggacccgtgtgctggctcacgcatcctggcattgggaggaggatttataatacactagactacaggtggaagattggtccttcaggctgcgagttagcaggatcagacacagtccctcgttctttttctctctatgctaaggtaatggtgcacgaccatttcaacccatgctcccctcagggcacgcagacaagggatggccagggtggcacactcctctgaggattcccaaagctgttccccattgcactgagcccttcccctgtcctctgccacagcacacaggctgctgtgtttagctcctgctagagctcttgggctagcccagggcctgggattctgccctgtggtgcctggtgagaggaccagcccgttggttcctgcattgcttgaccccaggacatcctaagtcagggtggacgttaataagcccgacctttggaactacgtgggtgagagagctggagggaagggctggaagaccaatccctggagagcagaggtcagcacagcccttaccctcctagttattttggtgccaaaatgtctcgatacgccctccaggtgctggcttgtttatggcctgcagctggccacgctggggagggagttgggggaggaagcgagcagccagctgccctgagcagaaagtggaagcttggctcagctcagcctgcacatgtgtggggctgtctactggcatgtagtgtcccttggtatcaggaggcaggaagtctacgtgcaggttgaatgtgtggcccagagtttttgggacagatgcagtgcaagaaacggggtacagagcagttgaaggtgctgcatggagaaagttctgcaaccagcaatgaagggctggagaagggggatggatccctgctattgatggagtgcctaccttgtgccaagtacttcacatctgacatgtaaccatttcagtagtacttataaatcagtagcatcattcatatttcttagatgaggaaattgcggttcagaaaggttatgtaccttacacataggtcacacagctagtgagagtcaaggcttgaatgctggtgtccctgagtctataactagacctttgcccactgtatggtgctgaatggaagtaggagagtttggtggagtggggggagggagattagcatttaggattcaacaacaactgcccttggcccttgctattttttttttccattgaaattttcaggctgggcgaggtggctcatgcctgtaatcccaggactttgggaggccgaggcgggcggatcatgaggtcaggagttcaagaccagcctggccaacatggagaaaccccgtttctactaaaaatacaaaaaattagctgggcatagtgacaggtgcctgtaatcgcagctactcaggaggctgaggcaggagaatcgctggaacccaagaggtggaggttgtagtgagcccagactgtgccattgcattccagcctgggcaacagagcgagactccatctcaaaaagaaaaaaaaaaagaaattttcattgagagacttgcacattcacatgcagttgtaaggggtaatacggagagaccccaggaacgctttacccaacttcctccagtggcaacatcatgtaaagctacagtacaatatcccagcggggtatcgacgtgggtccagtctgctcatctgactgagatctccacaactggatttgtactagtgtgtgtattcagttctctgcaattttgtcacatgtgtggttaattcctttttagggtgtctgttttcctactcctttaacatttaaaaaacctttcttccttccagtttcatttcacaggactgagtcgcatttactgatctttgaggagtagggcaggtgcggggtgggagttggggacatttggaaatgtgtatggtggtttttggttttcacatgcttggggaccagaagctctatgtcacatgcagtggagaaatgtgctgctccaaatgacaatcatgaccctagttcagggtaaaaattggatgattcccatgttttcaagtttcccttttatattctccaatgtgaagtggttctttctgacaggagttgcgcctcttcactgacgtgtcacaaagaagaattaggttggacgtgaagtgtgttattactgccatcttgatatgccctcaaggtggggtagactcagggagcaggctgtcgttagagatgattcatagtgtgactcattcaataaagaggcaccggagggaatgtgctcttccaggccaccgctttgggggagttgatgtctcagcccttcctgagatctccaggggaacagcgctgtgcgctcaccaggagaacaaaaaagctgcttcatcatcaaagaacatttatgccagttttctttgctttaagaatataattcttaccaagcctaatcctctttttttaaaatacactttttattttgagtagttttagatctacagaaaagttgcaaagatgttatactgaggtcccccacacccaaaaccccctattattaacccttacatgagtagggtacatttgccacactgagtgactcaaatgttgtttccagtaaaatatacttatttctttccaacttttattttaggtccagggggtacatgtgcaggttttttacatgggtaaattgcatgtcatggcggtttggtgtacagatagatacttttgtcacccaagtaatcagcacaataatccccgataggtagttcttcaatcctcaccctcctcctacccgggaatcaatattgatgcattattattaaactaaagccccatacttaattctgatgtcctcagcttttacctaatgtcctttttctgttctgggatcccatctaggaacccacgtgacgtttagtcatcatgtctccttggctcctcttgtctgtgacaatctcagtactttctggtaattgcagatttcctcctctccagccacggtttctgcttcttaaccgtcacgttcatgcccttgcctccttgactctaaaatgatgagttctggggcctggatgtcccctgagctcctaacaggtgtaggcaacagcatttattattattattattattattattatttttgagacggagtctcgctctgttgcccaggctggagtgcagtgacacaatctcggctcactgcaacctctgtctccggggttcaagtgattctcctgcctcagcctcccgagtagctggaactacaagcgcccgccaccacgccaggctaattttttgtatttttagtagagacgtggtttcaccgtgttagccaggatggtctcgatctcctgacctcgtgatccgcctgcctcagcctcccaaagtgctgggattacaggcgtgagccaccgcgcccggccggcaacagcattttaatggcctccctatttctagtcttctctcctatggatcattctctgcccagacacatgagttcctctgctttcccaaacccccttgccagctccagtgcccacgggactgaagtccttgcctcagagcagggccgggaggctactctgcatcctggcgccgctgctcacctccctgcctcccgcacccgccttgctaccggcttcaccaaaatccctcgtcacccgctctgctcacctggtaggggtagtctccccgtttttgcgttttcctgggaaactcccttcatatctgacctctccattccaatcccaaaccctgctcaggtcacccggctcccccgcggaatgaaggaatgaactgtttcttcccctgtgcgtccccgcccctcctccgccttgcacactcctccagggttttgcctctgtgtatcactccacatgtagttaattgatagaaaagtcccaaccctgtggggaggctggagccctttgtgcctgcatgagttccctagggctgccagagcactgcaccataggccgggcggcttccaccacaggaattgacgctctcggttctggtggctggaagtgcgagatcacggtgtcggcagggggagttccatcggaggcctttctccttggcttgtagatgccatcttctccctgtgtcttcacatgggctgccctctgtgtgtgtctgtgtcctcatctcctctttttatgaggacgccagtcataccggattagggatcacccctgtgacctcattttaacttcattacctttttaaaaaccttaactccaaatgcagtcacatgctgaggtactgggggttaggacttcaacatatgaattacgggaggacacagttcagcatgcgactgtgctgcagaactttctggggggacgggggaagtgttttatatttgtgctatccagcgtggcagctgctaagccacatgcggctactgagtccctgaaatgtggctcctgtggctgaggaacggaatgctgaattctaactaattgaaatttaagtagccacatgtggctagtggctatagtaccctggggcaccatggggccttcggcctgtcccggactgttcctgccttaggccttgtcctcctctgtcctggccgtgagcccatgcccctggccgtgtccccatgccagatgccactctgcagccccaggtcactgcccagggcggcgcggccagcgaatgcctattggcaggcgaggtctctagcggcagccctttgacagggagagggcacacctgggcagtcccttactgatttgcccctcagagcagggcagacagatggacagcatttcctctgggtggcaccaagccctgctccacctggatggcaccaaaaacttagctgatctcatctccagcttcgcttcctcctcttctgcccagagcagcgctggaccccacccgcccaccatccagcagcccccctgggaaacatgggactcgttctggtcacctctgtctccctccagtcgctggtcactccccacctggatctcagtccacgtctctatctctcagcccctcggtaatccagggcgtccacctgccctgataacttcaaagcccggatcacaggccccagcgtggtgacccagccccgcccagggttaaatccctcaagggcttcctgctgccttccatccccttatctggtttccaaagcccgcttcgacctgcccgccccgaggctcatatcttaatgccattttccttgctctaagcaccagcttccctttcttcccccgtcttcgcccaacactcgttctttcttgcctccaggcctttgcacaaatctggtctctgcctagaacatggttccctctctagtcacaactcctgctcacattttccatctctccttaagaaccgttttctccaggaagccttcccagatggagcggtgcatcccagctctggcgtcccgaggcccgtcccagtaccggggtctctttccagcacgcgcgcgcgcattcgagctcgccccaaactcggccacacaaggctgggcaggacagacacagccccagcctgcctgaggttacctacattctgatgcggaagagtagagatgttttaagaagtgaatatagaaacaagaacacaaacggcgttccagaaataacacacagaagccacggcccggagaggtgggcggggggcccgggacgcttcaggtgggggcggggaggggccgcgcggcgccgtctgcagctgcgcgcatggccggcagggggcgcggcggggagaggcgggaggccgcccccaccgcccccggcccggcccgccctcggccccgcccctcccgccggccccgccccgcccccgcccgcggtgcgcgcgctggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaaggtgagcccgcggcgcggcggcccgggcgcgcgcccctcacgccgcggcagccccggccgaggcccgtggccctgcccgagcggccgcccaggcccggctcggcccggcccggggtcccgcgggcgtcaccgcccctgtcgagcgtgccccgccgctgtaacgggccggcgccccgggcggagcgcgcggcccccgacggacggcgggcggctgtggggccgggcggggggcgcgcaggtgggcgccccgggcgccgcgcgctgggcggggggcgcgcgccgagttgggccgcgaggacccggaggaaactgaggcctagatgcaggggactgcgctcgtgccaccgagcgggtcccacgcgggggctcccggctgcgccccgcgggcgtccgcggtccccaaaccccggttctgcacgtttctcaggagcggtcgggtggtgtcccgcgagtgccctgcagacttccctgtggtgccctcagaagtccgctcggacccgggtgcgagggatcaccccttcaccccttcatcccaaaagggaaggaagggatgcgcgttcagtgaccgtctctctcagcaaagccgggaccgcgcacccgcttggcacccaactctccacggagaactcctgacgctaaatgttagataaagacgcacgtcctttttgcaggaggaaagttgcaccgtttgttttcccattgtgcttcctattgaaaacagcttacggtttttgctccaggtgagcccgcccggttagaacactgcttcctcaggcaggtggctggacaggtggctgcgagcaggctgggtccctggggcagctctggcagatccggttggcacggactttctcctcctgctgcagtgcgcttttcctccggggcggattaggttcagccgttcccttcaccgtgggagccttctcttctgtcagcctttgatacctgcgatgggggaacctgaggtcctaacatgttacaaacaggtttgttgtgaagtgctccagttattcagcaaataggtaccgaacacctgctttgttccgggtataacagtagcagtagtgatgataatgatagcaatagcaaataacaattctttaataagccttctatgtgccaggcactttcttgggttagctttacagcacttgacatggttagtttattagtactggtgagaacccaataagttggatgctatcatctccgtcttttggaattggaatagaaatagaatcaaggttaaatgacttgcccagggtgtcacaggtcgtaaatgtggatgtgtgttggaaccatggtcaggaccgtaagatggaaggcagtttctacacctagggattctcagtctagttgggagatggacgcctgtgcacctgacatgacaacattgtaagtgccgcggaaactcggggcagagacctgccctggggaggcaggagtggtttcctttaaggtgagatcttgagggataaagaattcaccaggctaagtgggtaagaaatggccttctacatatttgaaccttgcgtctagagctttaggcacaactgcgaaatgatcagaagttgggccagaggtggatcacgttgattagacttattagttggaagggttggttagggctgaatttcgaaggggtggtcctttgaggggtttgctttttggccttgggcaagaggtggccacagaggattgttcaaagtatgggggtgatggatcagatgtgcttttgggaagatctccacatagccctaaatgatactgataggagttgctttctcctgttgcccaggcaaggtactgaccagtgtggggtagatcatgtgatttacaaggttgattaagatcaagattgtgttgagagagatttgattcctgggagattccagtgtttagaattttgttggttaggaggtgtttttgctttccttcttttttctcctaaaacaatagctgctataccagctgttctggttgaggaggagtgatgggtagactgttaaaaatacaccccgaggacttagagtttctgaatacagtcacatctgctgtacagatagcttaaggctgatttttcttctgagttgttaagagattgtcagaatgtgggaatgcgaggttgactgtatgtaatagctccattttttttttttccagcagataagccattcacaaaattcctctggtatctatggtacataatagaaacatcaaaaatggtatggggtagcagtctgagtctaaaaagaaaaacagaactcaccttaagtatttggaacagaaggaatgtaatctaggggagtggtcacacaggtgatgtgagaactgagaatgcaggctgcaatgaggcaagccggagatgaggcaacaagcaggaaactgctgccacccctaagttggagggtgaaggaaggagatggcatttcagactccagggacagctgtcacccaccaaaaactggggtcacaaggggtccatctggcagtggctggagccttgcaagggcacagctgctgctgcggatgtactgttcccctcctgcctgggaaccctggccttgctggggtcacctcctccacaacttggactggagcagaaggacaaagaatggatctgaggacaagctggcccaggaccagaactgtatgtatgtcaggcttttaaaatattagtctagtgcaagtcagagctgtcttaatgaagagaaaaacaaaagagaatgtcttagggcagtgctcctcaaattttaatgtgcagacacatctcctagggatcctgttaaaatgatgattatggttgagtaggtctagggtgggtggggccttagaatgtgcatttctttttctttctttctttcttttttttttttttttttgagacaaggtctcactttgtcacccaggctggagtgcagtggtgcgatctcagctacggcaacctttgcctcctgggcttaagtgattttcctgcctcagcctcccaagtagctgggactacaggcaaatgccaccatgctggctaatttttgtattttgttgtagagatggagtttccccatgttccccaggctggtctcaaactcctgagctcaagtaatacacccacctcagcctcccaaagtgctgggattataagcttgagccaatgcacctggcagaatatgcatttctaacaagctcccagaagatgctgatgctgctggtccatggaccagactttgaaaaacaagaccttatggcacacatgtaaagagaagcctctccaaacttcaaataattcttcaggttatagatctttagcatattgaaaatttgatgtgtgcagatttgtgatggccatttatcagtttagcatttcatgcatgtctgattttttaatatgttcgagctctttagagttgaagctgtccacagcaaagacattacttcatttgtatttcctgactacagtacacagtaatgactctgtagaactgcatagctagaatggaaagaaagaaaatggagctaacactccgaccagcacattcaccagcacattataaggtattttgaaatttcagtgaagaaccgtgtaattctgcaaagctatcagttaaaagagtttaatttatttaaaagtttctagaaagttaacattttttggatatgagcatgaaagtgcttggattcctgattttaaatttaaacaaagcattttttccattgtgaaatgaagactagtaaaaattaggtaaagggtttaagttgtaaaaaacttaaaaaaatgcaccgcagttttatgagatataattcacatgggatacagttcagtggttgttagtatattcgctgttttgcaaccatcaccacagtcaattttagaacattttcatcaccccgtttcctctcaactccctcaaccataggcaacaagaatctactttctgtctctgtgtttgctgattctggtcattttacataaatggaatcatacaatatgtggtctggcttctttaacttagcataatatttttaaggttcatccatgtcatggcatgtatcggtacttcatttctttctgttgctgggtaatattccattctacaggcacactgtattttatttatccatttatcagttgatggacatttgggttatttctactttttggctattctggataatgctgctgtgaacattcatgcacatgtttttgtgtggacataggttttcatttatcttggctatacacctaggagtggaagtgctgggccatatggtaatactaccggactattttccagctaaaaagctgccgtaacattttacattcccaccagctgtgtatgaggagggttccaatttttccacatccttgtcagtaactgttattatctctcttttgatactagccatcctagtagggatgaagtaatgtaaaaggtttttaatgccattttattgtcggatttcaaagtctaaactttggtgtcagatgaagtcacttcagaccctgcgcttctagttatgaagcatgcgattgtggacagggtgtctaaacctcccttaagacgtggtttcctcatctgtaaacatggaaaatattagttcttgggttggttgtagtgaaagtaaatgttaactctgtgttcctgagtctcagtttccatgtctgtaaaatagaaataacagttgttatatccataaaataggaatggggatgttaactcatagaattaaatgggataatttgtgtagaacacctaacatagtggctgatgtatagtaaatgatcactaaatggttgcttttggttattttttgtctttctgatttttttttttttttatcccagataggaatcatttccctgattccatttttctccagctcaggctggtctgagtctccatctctcggctccagaagagcaaatacaaacaaatctggctgaaaattaacaaagaccattttttaaagaaatcgttaatttattgagtactagtgggaataccatgggctaggtattacattttgtatttcactggttcagtttaacagcaaatatttgagatcttaacattgttaactgttgtgcgaggcaccaggggtatcttattgagtaacaacaaaaatttttagagatgatagtctagaagacattaataaaacaatcacacagttaatatgaagttgtgatggggacgggtgctgatgaggagagggccagaatactttgagaggacatcataggtgaatttgacctgatatcagggaggtctaggagggcttcttgaggcagtgactggctgggtctggaaggtgagtagggagcagtgccttctgcttctggcagtggtgagctgagtgactgcagcgccactcttccaagcacagtctgctaataagatgatgctgaatttctggactaggatctggggtggctgaagatctgtggaagtgagtgtggtatttggggctgcttttgaccttggaatctgtagtggcgtctgtagtggatttggcatctctaccaaatttggtccacctagaacttcaggatgcccacataataagatattagttaaatatctttaaaaaaattttttttctttttttctgagacagggtcttgctcggtcgtccaggctggagtgcagtggcatactgcagtctctggctgggctcaggcaatcctcctgcctcagccacctgagtagctgggactccagatgcattccatgatgcctggctaatttaaaaacacatttttatggagacgagggtctcactatgttgcccatgcttggggtctcaaactcctgggctcaagcgatcctccccctttggcttcccaaagtgctagaattacagacatgagctactgtgcctggccaaaattttttattttgagatagggtcttgctatattccccaggctggtctcaaactcctgggctcaagtgatcctcctgcttcaggcttctgagtagctgggagcgtaggctcaagccactgtgcctggctaattaaagattttgagagtaaatcatcgtgaacttaggagaaactctaaatccagtgttggtttctttataagaggaaggggagggagatttggacagaaagacatgttgggaaaaaggttatgggaaaatagagccggagattagagttcgttgatgcaaaccaaggaatgcctggggccaccagaagctggaagagataacagatggaatctcccctagagcctttagagggagtgcggccttctgatcccttgatctccgacttccagcccccagagcagtgagacagtcaagttttttttttttttttttttttccaagttttgttttaagccttgaagttttatggcagccctagggcagccctggggaaagaacactgggccctgaacaaaacatgggagccaagaggctgagccctgtgagactgtctgagtgccttagcagggctgaggtgccaggttctgccaaagggcaacagtcctgggtgacaccctcccctcacaatttggattgggatccaaagaagccacttccaaggaatgcgcaggagccagaagtattggaaggactgcagccctgcttcaaatcacctcagtcctctgaaattaaagtaatcccagtgtactagtgtctctagattcccaacagaagcaaactttaatcctctctagagggagatatctccctctaatcctcccagttatcaatggaggcctctaatgactttcacgagtctgtttgtacgttcatgattgtgcatacagtaaaaaaatagacatcaagggaggcgaggcacttgagctaaaaccagtcgaaactacaggctgtagacagacccacagggcttccagactccagacccagactttataacaactgtgctcgttgtgttggaggagacacgagatcagatggagagttttggcagagaactagaaactatggaaaagaaccagatgaaaattctagtccacactggccagatggctcacgcctataatctcagcacttttggactgaggcaggtggatcattggaggtcacgagtttgagaccagcctggccaacatggcaagatcccgcctctactaaagatactagacattttttttttcttttaagacggagtctcactcttgtcacccaggctgtagtgcagtggcatgatctcagctcactacaacctttgcctcctgggttcaagcaattctcctgcctcagccccccgagtagctaggattacaggtgcccatcaccacgcccagctaattttttggtatttttaatagagacggagtcttaccatgttagctaagctggtctcgaactcccaatctcaggtgatctgcccgcctcggcctcccaaagtgctgggattacatgcgtgagccacctcacccagccaataaaagaaaattataaaattgaaaaagcatagtgatcaaaattaactaaccaaaaaaagagcagattagacccaggctgaaaaaattgtgtgaaccagaagatagctcagaagaaaatacccacaaggaagcctggagacataaaaaatggaaaaatttggagagggtgggagacagatatagtaagaaggtcttacttgtgtttaattgtcacaagagaggagaagtgagagaaaattgaggagacacaatatttgaaaagataatgtggccaggtgcagtgactcacgactgtaatcccagcagttttggatgctgaggtgggcggatcacctgaggttaggagttcaagaccagcttggccaacatggtgaaaccctgtgtctactaaaagtacaaaaattagctgggtgtggtggcagatgcctgtaatcccagctactcgggaggctgaggcaggagcatcgcttgaacctgggaagtggaagttgcagtgagctgagaccacaccattacactacagcctgggcgacaagagcgaaactctgtattaaatagaaaaaaaagaaagaaaagtaatacctgagaattttctacaacaaataacaggtaccatgaacagattcgatagccgtatgaactgaaagaaccatatctaatcaattcctggtacacccttgtgctctgcataatgatgtttccggatgatgatccacatggacaaaggtggtcccataagattataatgaagctgaaaaattccaattgtctagtgacgtggtagctgttataatgttgtagggcaatgaattacctatgtgtttgtggtgatgctggtgtaaacagacctactgcactgcaagtggtagaaaagtatagcacatacaagtatatacagtacataatagttgatgatgataataaacaactatgttactggtttatgtatttactatctatactttttattattttagagtatattcttcctacttatagaaaaaagaaaaacaaattgtaaaacagcctcaagcaggtccttcaggaggtatccagaagaaggcattgttatcataggaggtgacagctccatgcacgtcattgtccctgaagaccttccagtgggataggatgtggaggcggaagataatgatactgatgatcctgactctgtgtaggtctaggctaatgtgtgtgtttgtttcttagtttttaacaaaaatatttaagaagtaaaataattaaaaaaattaaaaatagaaaaaaggttatagaataaggatataaagaaaatacttttgtacaagtgtacagtgtgtgtttcaagctaaatgttactacaaaagagtaaaaaattaaattaaaagtttataaagtaaaaatattacagtaagctaaggttaatttgttattgaagaaagaaagtctttcaaaaaataaatgtagtatagcctaagtgtacagtgtttacaaagcatagagtactggtcagtagtgtcctaggccatcacattcactcaccagtcattcactcactcatccagagcaacttccagccctgcaagctccagttacggtaagtaccctatacaggtgtaccattttaaaaatcttttatgacatatttttactgtactgtttctatgtttagttatatttagatacgcaaatacttgccgttgagttatagttgcctacagtgtcagcacagtgatgtgctctatgggtttgtagtccaagagcaataggtcatgccatacagatgaggtgtgtgccatctagatttgtgaaagtacactctgtgatgttcacataggatgaaatcacctcataacacatttctcagaatatatgctcattgttaagcaactgataactgtagcaccgttgaaaaccatagatgaagagaaagagagaaaggcggaggttgcagtgagtcgagatcacaccactgcactccagcctgggcaacagagcgagactttgcttctaaaaacaaaaaccaaacaaaaaaagaatgacagctgtgttcttaacagaaataatggaaaccaaaagtctattgaaatttaagtcctcaaagaaagttactgtgaacccagaattctgtatgcagcaaaaatgtccttcagaaaatacagttgaaataaagatactttcatataaacaaaaacaatgtttttgccagcagacccacactaaaggaaacattaagtgttttttgtttgttttggctaaaggaaaatgctcaagttaagcgttagagttacaggaaggaatagagacttaagggtttctacgtgggaaagaccaaatgattattaactataaaaattatgcctttgggtttaaattatatagaattaaaatacatgacaacaatgtcctgtaggttagaaaggaggcaaatagagtagaacttttctaaagtctttccatttccaggaagaagaacaaagatccaattatattagacaagtcagggatgcatgttgtgtgtaatctgtgtggtggccaccaaaattgtgatagtgtgtgatagctaagctaaacaagaaaaatagaatcagagattctaaatctgaaagaaggcaagaaaggagagaaaacactgaacaattgggacaaagagaaagcaaacagtaagttagtagactgaaatcccagtatgtcagtaatcacattaaatctaggtggacttaaatgctccagttaaaatacagagattgtgagatgggatacaaaagcaaatcctgactaggctatttgaaagagatacgtttaaaacataaggatattaaaagattgaaagtaaaagaataggaaaagatactatgcaaacactaaccaaaagaaacttggtgtagctattttagtatcaaagtagattttaagggcaaaattattaataaagatatgctgataaatgagaaaaagttcattttggatataataatttaaaatttggaagtaatgacttcaaaatatatagaagaaaaattaacacaattgtaagggaaacaaattcataatcatagtgagatgttttaacacacctgtcttacatgctgtatacatcaagtagacaaagaaatttgtaaaagtgtagaattgaacaacacaagaacggaacttttttttttttttgggagacggagtttcgctctgttgcccagactggagtgtaatggtgcaatctctgctcactgcaacctccacctcccaggttcaagtgattctcctgcctcagcctccagagtagctgcgactacaggtgtccatcaccatgccaccatgcttggctaatttttgtatttttaatagagatggagggggggtctcaccgtcttggttaggctggtcttgaactcctgacctcaggtgatccacctgcctcggcctcctgaagtgctgggattacaggcgtgagccactgcacctgccacaagtactaaacttgacctaatggaaatgtatggaacactgtacctaacaattgtagaatctaagtttttttccaatgcacaggcacatttgtcgaaattcactatatgctggccataacacaagtctcaacagctttcaaaagagttgaaattatagagtatgttctgacaacagaattaagccaggatcaataaaaagaaaatctcaatgtatttggaaattttagatgtctatttctaagtaatttatgagtcacagaaagcttaaatattttgagttgaacaatagcaaatatgtatatataaaatggggtacagctgaagtcatgtttagagggaaatttatagcttaaaatacgtatattagaaaagaagacatgctgaaaatcaggtagttagaagaatagcaacacattaaactcaaaggaaatagagtatttttttaaaggatttatagaagaatgaggaggaggaggttgctgatcaaagaggtatgcaaaggccctgtggcaagagggagcttggggaaatcttggggctgaaagaaggctgtggtggttagggctggtaagcatcgggagcctttggttgggatctgacactggagagggttggaggctgtgttagggagctctgcctattttcccccagattagtgggatactattgctttaagattttaggaaggaccatgacctaattggatcgtggttgaaaagatggctctagctgcgctgcggttgcctgagtggatgctggctgacccaatgcagtgaaagatgctggcagcctgggcctgtgctgtggctgtggcgatgggggaagtagctggatttgagagatgctgaggaggtgacattgtgagaactcagtgatggtttggtgtgggtgttgggggagaggaggtttgtgattcctgtgatgagctggataatggaactcttctctgatataaggagctgtggttgaggacagctttggggattttgctgttacctggctctgctgcatgctatcctggaacctcttattctccactaccccagttttgccaatgaacgacatagattcagcagttaggtggcttgctagtgtgccatgaagccatgtaggtctcactgaacccagatagggcctcctttgtcccttcctccccagcccccagtcatgcagcagcagtgaggatggttcatctgagcccgagagtgaggacagtgtgacggggtcagggcccgattggatgctggggccgttggcttttaggaggtgggcagaagaggaagaggaggactagtcaaagaaggaaggactggcaggggaggagaaagaaagggggctgcagagaagccccagaaccagcacagtttacctctaaatacctcagtgtatgtctccacaacatgaggatattttcttatataacaataccattatacctgaaaaaactttttaacatttaatatccagatcattttcaaatttccccagttgaaccagaaatgccatttatgaccttccttttgggaaccaggtacccatcaagttttacgcatcatctttggttgttgttatctctttagtttgttaaattagaacagcttccactgttctctcttcccgttccctacctgcctataacatcaactttttcaagagacaagggcagttgtctggtattaatgacttttttttttttttgttcagacagaatctcactctgtcgcccagactggagtgcagtggtgcgatctcggctcactgcaacctccgcctcccaggttcaaatgattctcctgcctcagcttcccaagcagctgggactacaggcgcccgccaccatgcccggctgatttttttatttttagtagagacggggtttcaccatgttggccaggctggtctcgaacccatgacctcaagtgatccgcccacctcggcctcccaaagtgttgggatgacaggcatgagccaccgcacccagctgtattaatgacttttaatggcaaaaacctccattacttttgtaccaacctaataatctttctggatttttctgattgttttcccatcattcttttacattgttgttttatctcctatatttcctataaagtagaagtaagcagtttcaaagactctcacttctatattttggttgacattttgggcatatccctaaatatggaatgctctgtgctctaccgcatcccacttggaggtgggtgtgtcctgtcaggctgtccccctctgctgtgtcatcgcttggtttacagatttctaggtcttttcttcctcttttttttttctttttttttttttttttttaatagaagtgggatctccctacgttaagccagtctggtcttgaactcctgacctaaagtgatcctcctgccttggcctcccaaagttctgggattacaggcatgagccaccttgcctgaccagatcttttcattggagatgtgatttcccctttacagttaggaagtaataggtgattcctgggcactgtgcaaatatcctttaccccaaatggtttccatattcatacacaatacaggacttgcctgaagcaattttattataagagtttttaaaatggagattcctgccacccccattgtgtcatttattccacatttatctgttggtgttattctgtaaagatattttcttggggccaggcgcggtggctcatgcctgtaatctcagcactttgggaggccaaggctcaggcgatcacttgaggtcaggagttcgagaccagcctggccgatatggtaaaaccccatctctactaaaaatacaaaaaaattagctgggcatcgtggtggacacctgtaatcccagctactccagaggccgaggcaggagaatcgcatgaacccaggaggaggaggttgcagtgagccaagatcacaccactgcactccaggctgggcgacagagcgagactccatcaaaaaagtgaaaataaaaggatatttgctcacttcaaccgagttaaggaccacagttcctcctaaaaaggcaggtcaattgctggattctttgtttaattaccaatgttcgaggtaaggatttggtaaatagtcatccccagtagaggcaaatgtttctctccccccaaccctaaacccccacacccaccctgagtatcactatatggattcatggcaatttttattcagtgttttacaatcagttacagtcattctttttgatgctaaaattatcctgattttcctggaaacacaccttcatctggctctttggtctttaaaggcttgcttgctatgttgcgatctgttttcatcttctggatagagtcctggagctggagtttcaggtagaagggacagtgtgcgtcctgtggccgaggctgccagcccacagcgtgcattgctgcccatttcctgccagtcctgggacgagagtgcctaggagtttcaagatttcaggctggcaggtctttgttttccttttttggattggcttaggtttagggttgtctcagcctcataaagtgagttgggtagctttctgtgaggaaggcttttgtctctgcctctcatattgcatctccatttattttattttttggggggaggttctcatctgtaggttagaccatctgtctccttaccactctgtccatctcagtatttttccctgtccactgtatccatcagcattctgggggcctcagttttgtctttttgccaccagtgacattttctgtaatgtacatttttccctttgactccttccagttggattttaatttttccgtagtgtgattgtttttgttttctaatcttggtcagcatcttagcttgttgtcttttaatttcaacctattctcattttggtgctccctgtcttttaaaaacattttaattttaactttttaaataaaggccacgtcttcctgcatcttaggacaagaatcacatcttttctaaaatggtcttccattttctgcaatcattcatttcaggtttgtgcatgtactttatggcatgtttttccatcagcctctcccctccccctttctgttctgatgtgatgttccttgaatggcgtttgccaggctgcgggtttgaattgctgtttcctggggacttggctgggcacaatctggggctggccgtggggtgatcggccacgggcccaggctgtgtctctgctgctctgggcgggctctcccctcaccttgaattcatgtgcaatggccccattttccgtgtccatgtgtgttcctgagtagtgggtgtttgctgatcacctgctgcccactctgctggctctgctcttctgtgtctgagggtaaagggtgtctgcctccctttcccctgcaggaagggctggactctcatcccctgatgaatggtgctttgtccttatagaatgatggaagagggacactctttttcttttaaacctgctattttaaccattttaaagtgcacagttaagtgccattaagtacattaatggtattgtgtaaccatcacctctatctagtttgggaacttctgtatcccctacatggaaatcccttccccatcgtgagtcactcctcatttccccctcctcccagctgctgacaaccactaatctgctttccatctctatggatttgcctattctggatatttcatttattatttatttattttttagatacagtcttgctctttctctcagggtggagtgcagtggctcaatctcagctcactgcaatctctgcctcccaggttcaagcgatcctctcacctcagcccccccagtagctggcattacaggtgcactccaccatgcctggctaatttttgtatttttagtacagagggggtttcaccatgttgtggccaggctggtctcccaattcctgacctcaagtgatctgaccgccctggcctcccaaagtcctgggattacatgcgtgagccaccgcacccggccactgagcactgtgttttcaaggcttatttacgttgtacgtttcagaacttcttctttttttttttttttttttgtttgagtgaataatactctgttctgtcaatgtaccacattttgtttgctcattcatcggttgacagatatttgggttgcttctaccttttgactattgtgaatagaactgctgtgaacattcatgtacaaattattatttaaatacctattttcatttattttgtatttttttttaaatttttgagacagggtctctgtcacccaggctggagtgcagtggtgcagtcatggctcactgcagcctccacatcttgggctcaagcagtcctcccacctcagcttcccaagcagctgtgactacagatgtgtgccaccatgcctggctaattttttaattttttgtagagatgaggtcttgctgtgttatccaggttggtctcgaacactcgggctcaagtgatcttcttgccttggcctcccagagtgctgggattacaggtgtgagccactgtgcccagctgacctgttttcatttcttttgggtacgtacatgtgagttaaattgctggataattctgtgtttatcttattgaggagctgctaaaccacaaaggctgcaccattgtatgttccctccagcagtgcatgagagttctgatgtttccacacttgccaactcttgttactttccacttattataatataaatgttataatatttaataatttaagaatattatattattcagttcctcaatgactaacaatgttgagcatcatttcatatgtttattgaccatttgtatatattttttgaagaaatacctattcaggtccattgcccattttccaatcgggttgtcttcttgttgttgaattgtaagagttttttatatattttgggtactagaactttatcagatacatgatttgcaaatatttcctctcattctgtgagttgtgttttcactctcttgatagtgtcctttgaggcacaaaagttttgaattttgatgaagtccaatttttttcttttgttgctcgtgcttttggtgttatgcttaagaaaccattgcctaatccaaagacaagatttatacctatgttcttccacgagttttgtagtttcagctattattaatatatttagtctttgatccattttgagttattttttgtatgtggtgtgaggtcaggttccaacttcattcttcctgtgtggatgtgcagttgctccagcaccagctgttgaagaggagcgctctccagttggagtctgcctccccagctgtgcagacagccctgcagtattgaaaaacagccacagagctcctcaggagtgcttggaaatctcaatggagttcataaagtgattcttaatagaatcattcttatgtatggttatgagacatttacatatttaaagagtttaaaaggaagtatctgcatttcagaatttttactgccatggaactcatctacattttattttgttttattttatttttttcagacaggatctcactgtcacccaggctggagtgcagtggtatgatctccgttcactgcagcctctacctcccgagctcaagtgatcctcccagtcagcctcctgagtagctgggaccacaagcatgcaccaccacacctgggtaatttttgtattttttgtagagacgggttcttgctatgttgcctaggctgtcctcgaattcctgggctcaagcaatccgcccgcctcagtctcccaaagtggctaggattacaggcgtgagctactgagcccagcctcttctacattttatgtttgagaatatggacttgattcagttctttttatagtttggtaaacttgaaataacactcatctcattaaatccagtctcatttgacattctcagtatttgaactctgataaaaatggactagtactcagaagctgggcagaagggaagtctgagaagttgttctctatctcctttctctctgtggttgctgaacatttttgtgtgcttcaagagggcaagtagaaccaggtttgtcaagaattaagacataagtcttttttttttaatttttattttttttcttacatttaagggagatctggccaatgtgtatttttattgtccattagtcacaattgtctgtgtttttatatctaactagtgttttgtattatttgctgtttgtagaaactccttggtagttaactgcagcttctttgtcctctggcagcagaaatgggtataaccatttgggaaagtgacttagtgagtgtctgaataactccaagagactcttggtccagaattctaacactgggactctatcctgagaaaataatcttaaatataaagctcatgaacaacatgtttattgtaccattaaatataaaaagttgcaagccaccccagtgtccaagtccagcttaggacaaaccccaccagaacactccagtgtaatgactcagtgagttaatgataatagctgataaaatgggtactgcgggcgggtcccgtgctgtgctctgtgcgcgtgctgtcccacttcaccttcacaacttcatggtggctgcaccaggtcacaaagctggaaagtggcaatgtgcatggctctcaatgcctgaagctgccagccaggtaattgaggaggtcagcaacagggacggtactatgtgatgttggagaaataaagaggcgaagctgtgtttacagaatgcgtttcagcagtgtgtaaaacactggaaataagatggaataggaaataacacggaggaagtttcttatgatattgtgggtcgggttaggtggtgagatttgtattatttttatgtttacatctgcttgcctgcattttctaaaatgagcatgtattattttataccaaaggaaacaaaaaggcataacatgcttcccgtcaatggaagactcctaatggtaagaggggctgtgttgtgacgtggagatgattcagattggagaagcagctgccctcagccttatctggaatgtcctaaaacagctgaaacgatactgttggatcaaaacagattgaatttcaggagtcaaatatacaaaagggcatgcttgtgaaaatacaggatttaagtttcataatatcctaataaatgggtacattatatggaacgacttaattatgttcccccttgtttgaactttcaactcctgtgttgaaattaaatctacacttacctaagaagtgagctcaaggtcttgatatgaataggatgtattttagcttgagatgtaaactgtttgatgcgtgcaatgttatcagttctttagataatgttcataatgacattagcatccctaaacatttgaataaatgaaaaagaaataacatatagaataataatacacaaagtaaaagcagatctagttgcagtatattgttgtttggaaaagcaagttattgaataatttgtacatcatgtaactcccctttatgtcttttagtttaattttttttttttacacagggttttttttgtttttgtttgtttgtttgtttttgagatgaagtctcgctctcacccaggctggagtgcagtggtgtgatctcggctcactgcaacctccacctcccgggttcaagtgattctcctgcctcagcctcctgagtagctgggattacaggtgcctgctacgatgcctggctagtttttgtattttcagcagagacagggtttcaccatgttggccaggctgattacgaactcctgacctcaagtgtgccttctgcctcagactcccaaagtgctgggattacaggcgtgagccactgcgcctggccttgacacggggtctcgccctgtcacccaggctggagtgcagtggtgccatcatcactcactgcagccttggactcttgggctcaggtgattttcctgtcttggcctccccagaggctaggactacaggtatgggccaccatgcccagctaatttttagattttttgtagagatggcatctcaccgtgttgcccaggctggtcttgaactcctgggcacaagtgatttgcccacctctttctcccaaagtgctgagattacaggtgtgagccatagcacctgacaattttatttttacatttttctttttagaggcacggtcttgttctgtcatccaggctgcagtgcagtggttcagtcatagctcactggagcctaaattcctgggttcaagcaacttttctgccccagtttccttagtagctaggactgcaggcgtatgccaccatacccagccaattttaaaagtttttatagagatagagtctctataaaagcagagggatactttactatgctatgttgcccaggctggtcttgaattcctgggctcaagtgatctgcctgcctcgtcctcccaaagtgctgagattacaggtgtgacataccatgcccagccccacttttctgttttatttacacacttgaaaacagatggagccgggcgtggtggctcatgcctgtaatcccagcactttgggcgcccaagtccggtggatcacccgatgtcaggagttcgagaccagcctggccaacatggtaaaatcctgtctctactaaaaataacaaaaattggccaggcgtgatggcacacgcccgtagtcccagccacttgggaggctgaggcaggagaatcgtttgaacctgggaggtggaggttgcagtgagccgagatcgtgccaccgcgctccagcctgggcgacagaatgagactctgtctcaaaaaaggaaaaaaaagaaaaaaaagaaagaaaacagatgggaaggatgttatctcggcatgtgaatagtaggtgttagcgtggctgggctcttggtggtcttaagtaaataaaaagtaacctccagcaaacaagtctgccatgagttgggccatttaacacaggactttattctccaaatgtcagaaaacaggtgaggaagcagctggttgagcacatgccaggggagaggaggttgaatgctgatagtggcagcactgccgcattgttctcaggtgcttttctgtttggtgccttgccctctgaggtgggatccataggtcaggaagctggggaggctgcctctagtccaggcagcaccagcttcaggcctctggtgtgtttcactgacttccaagtttccaaagcgccctgtctgcacccctcttatgacacttgaaaacaatttatggaaatttccaagcagacacggaagtagagaccgttgaattaatcacatcagcctgtgtctttcttgtttcatctgtctccaccccctacccacacccctacttttctcctgagcattttaaagcaaatacttctggttcttcctactgtcaagtatccctctgatggagcagtttcctgaaaggtcaagggtcgagtccctttcactgtagtattgcaagccacactcagcactcaagtgttcaataaacatttattgaaacagagtgatttcattccacagctcgatagggagatggattttgttctgtaggtttcgcagaagctgaatctttcctaccttaatgaaccacagagcgcatgtgtgtattttgggatgtcgcacctgctgctgggggttaaggtttgtttcgcctttggtgtgtagtggagatgggtttgtgcataaattcactttcagaaaaagtagggtgactggttatggctataatttagtctgaacttgtacagacaaaaataatgaaaagtaaatcttccccagacataaaaaatgtttttcatttgctgtctaagcatggagagagttgaaatcagacagatctgggtctgaagtccacatctgtcacttcactgtagatgtctatgtcctctctggaccccaatttcttcattagtaaaatggggctataactattgtatggggcagattaaatacagattctacataagctcctggcacatagtaggcactccataaatactgattatttcttctccttgcccatggttctgtgaaatgggaatgtttcctgggcctcccttaggaggtcattgtatggatttttttttaatatatatgttttttattatactttaagttctagggtcctttgtagggacatggatgaagctggaaaccatcattctcagcaaactatcacaaggacagaaaaaccaaacaccgcatgttctcactcataggtgggaattgaacaatgagaacacttggacacaggaaggggaacgttgtatggattaaatgagtaatctttggaaagtgcttacacctgagcctggagcaagtcagagctcagcctcctgggtgctgctgcgggtgctgcccctgtcctgggagtccttttaaaatcatgtgtgtgccttccctgtctcatctaccctgttccctttccctagaggtaaccacttaaccatttttattattattttggttaatccttccattgtttctttttggaaaaaaaaaactaagtttatcttcttcacacacaaacaatgtcctcctttttacaaaaagatattaatagcgtagcatgttccttttttttttttttttttttggagacggagtttcactcttgtcacccaggcaggagagcaatggcacgatctcggctcacttcaacctccacctcctgggttcaaacgattctcttgcttcagcctcccgagtagctgtgattacaggtgtgtgccaccactcccagctaattttttgtatttttagtagagacggagtttcaccatgttggccaggctggtcttgaactcctaacctcaggtgatccacccgcttcggcctcccaaagtgctgggattacaggcgtgagccactgcgcctggccccttaatagcatgttctatgcatgttctgcacagttatctttttacttgctctgatttggagaggttccgtagtgtataaaaatatcttccacaatccttgtatagttatatggtactccatattttgaatgtaccgtaatttattcgaccactagcctgttggtgggtatttgggttattttcagtgttctgctataatagtttgtagcacatagccttgtacaaacttttttttctattttgccaaagtgtcttttgggatagattcctaggagtgggcttgctagatcagaagagtaaatgcatgaataactgctctggattttgccaaatgtttgtcttcagggccatcccgttttgcagtcgtgttgagtgcctgtctccccgttgccatagaagcagaatgtgttgcctctttggtttttttgtttgtttgtttgttttgagatagagtcttgctctgtcacccaagttggagtacagtggtgcgatcacagctcaccgcagcagcctcgacctcttgggctcaggtgatcctcccacctcagcctctcaagtagctggagctataggtgcactaatttttaaataattattattattttttgtagagacagggtctgtgttgctcaggctggccttgaactactggtctcaagtgatcctctcacctcagcctcccaagtagcttggaccacaggtgtgcaccaccacgcccagctattttttttttttttctaaatttgaggccgggtgtggtggctcacgcctgtaatcctagcactttgggaggccaaggcgggtggattgcctgagctcaggaggtcgagactagcctgggcaacatggtgaaacccgtctttactaaaatacaaaaattagctggatgtggtggcgggcgcctgtagtcccagctactcaggaggctgagacgggagaattgcttgaactggggaggcagaggttgcagtgagccgagattgtgccactgcactccagcctgggcgatagagtgagactccatctcaaaaaaaaaaaaaaaacttgtagagatggggcctcactgtgttgcctaggctggtctcaaactcctgggctcaagctatcctcccgcctcagcctcccgaagttctgggattacaggcgtgatccactgtgctcagccttgtttgttttttgtcagtctgatggtgcaaatagtattttcacttagttttgtttttctcttctgagctaggttgagcatcttttcctttgtttaagcgccttttgcatttttttctgtcaaatgttttcatattttttgcccctttttctaccagatttttagtctgttctcaatttttataatttctttaaagattagggatattagccctttgtagtattttgtaaaacttcctggcgaggtgtagtggcttatgcctgcaataagggaggccaaggcctgaggattgcctgagcaacatagtgagaccccgcctctacaaagcaaagcaaaacaaaacaaaacaagcgcacctgtagtcctagctacttgggaggctgagatgggaggatctcttgagcccaagaggtcaaggctgcggtgagctgtgattgagccactgtagcccagcctggttggcagtgtgagaacctgtttcaaaacaaaaacaaaacttcctgaggcactggcgtgattaagataaataaacccactgaacctgagggactgttggtctggggagggagacagcctcataatggatgttcatgtacttgcaaagcggtgatagctagttctgcctggggggaggtgatagctagttctgccttgggggagtctgggaagacttcccgaaggtggtggtatttgacttgggtctcaaagcttagtcatttcccagccaagagaagaggagctgaggatttccaggcggaggaaagagtatattcaaaaaagtggggaaataaaaggagttggttgtgtttgggtcaggtggttctgggaggggtgagagaggagcctctcagattgggaggagcccggtgggccacgtgaagccttcctagatgacaaggaaagcaaggagaggtttgggagtgggccctggctctgagactgtatgcttcttccagtcacctgggagtttttaacactgtggctccctgccccctcccacactgatgctcatcactggtggggtggggccagtggtcactgtttctcaaagcttgtcaggtaattgtagtggcagttgggatgaaatcctcccgttgagagaattgtggcagcaggttggaggaaggatggacagagaacaaacttggtgtgcttaggaaccacctgggctcttggcaaaaattcatatttccaaggctcaggaggttgggagtggagcagtaacttgctttttctttacttttttattttattttatttctatattattattttaataacctgtattttgtttttagagtagtccagtgaagtagtgagaatggggtagagaatagagcaaggagttcagtctgtaactgattgtgaaccatcgtttgagatagctcactgccttcaggccagcggtaacctgcatttttaacaaacgttccaggggttctgatgtggtggtctgggtcacacgttgagaggcactgaggcagagacaagaggcagaacaacttaagcctgaggtaggcggagctgaagaggaggggcagaatcttccattattttaacaaatacaatcaatgatcctaggtaggcaattagaaatggggagtgaaggaggaaaagagttgagcacctgctacttcttttagatttgatgatgctattaatattaactaaagaggaaacgtgggggtcagtgaacagtgagatgaggtacatttcagtgtggaggcctggcccctggggacgccagcctgcaagactaggttggattagcagtgatgctgacagagcgggagtgaactcagccaacccatcgttatcagacaggaatgcatttggctgtaggttgatgtcatcaggacccacactggctaccttgtggcctcagcatggctgctgcagcactaaatgttgtatgttcatttaaagcaaaggtggcactgagactacacgtgttcccatataccagccaagcacttgcctacctccccacccccaacagaactgcttaggtctccttgaccagtactggggcagtggggattagccctatgatgaaaggtcccccgcgaccaccacccccagttcagaaacaaggtcctgtgagcagtgaggatgtgtgtgtgtgtgtgtgggggggtgttaacaccacataccgcagcataccgcagtaagagaagcgtcctggctttaggaaagtgggtgtgaactccaaatgaggggcagacctggagccgctctcctgggggtttgggcatacacatcgttgccactttttggcttttttgggtttggtccttcctcacattagtgggggcaggaatgaggtgtctctcctcctgtcggtggaggctttggcataggagctttgggacatggtcgtttttaataatcctggtggcagtgcattgaaaaccagggtagtggcaatggggaaattggattctcttgatgggtaagggaaggatgactgtcctttttccatgagttggtgttttggagtcttcagaaaacctatgttgggttcctttctgtcagagttagcaccagactcagggcctggctctgcagagctgagcgggattctgcagtgcggcagttgcccggtgcgctctctcctgctggccgttggtgtcatgaagacgctgatgtggcacacactccgttgccaccttgggcgtgcacactccctcagcttctgccaggatgcggtaagatcagcttataggtagacaggtggtgggtaagttgcaggtagttcctgaatgaggatgaatctgtgggtagtgttttgagtagatacaggaatttacctttgcttaattgatttaaatccgttatcagcagacttttatgctgaagttttattttgccaacaagtattattgtctgggctctggtgtgtcattcattagccaagtggccttgggtgaattacttaatcctctggccctcagtttcgtaatgtgtaaagtgggaatattaccaccactttcaaaattggtgtgaagattaaaagatgaaaatggctcctacttgggtagtggctgtggtatgtgtgaagaagtgttggagataacctggaggtctttgaatatgttttgcatgccttacgttttgtgaacaaattattttctgattgcttcctatatgtgaatcatggtgcttgtaaactgcaaaccacagatgaagctttagagatagaattggagaggcctgggatttcttttgtgacctgtcattagttgttcaaccgggcaagttactcagtctctctgtttaccagttttcttatttgttaactggaatactagtttctgtctcatagaccagaagtgtttgttctgttaagaagacaagtaaatataaaaatactcatgaaaatttaaagtgatatgcaaattgggccaggtgcggtggctcacgcctgtgatcccagcactttgggaggccgaggtgggtggatcacccaaagtcaggagttcgagaccagcctggccaacatagtgaaaccctgtctctactaaaaatacaaaaaattaaccaggcatgtagtgcgcgcctgtaatcccagctactcgggagggtgaggcaggagaattgcttgaacctgggaggcggaggttgcagtgagccaagattgtggcactgcactccagcctgggcgacagagcaagactctgtctcagaaaacaaacaaacaaagagatatgcaaattgatagaaataagtttaccagcttctttccactgaaacatttgtatgttaattttttattccagtatttccacttttggggggctttgtgaatttgggtgatgttgcttaattaaccatagtcaggtttctgttttacctgcttttttgttgttgttgaaggaccggggaagtctaaaggacagataggtggctgaagtggacatttggctaattttctttcctttctgctactttttttttgtttccctccccagtttcccagctgtctgcctgcagcccctctgtccaggtcaccttgggcaggctgtggcttgctgccctcagcctctggacacgactcttggtcagtcccctccattttcttcacccccacgtggcagctgtttttcatttgtttgtcttttactgcgtaaatgtggaaatcctcactccttacatgctcaagacattaacactaatagtctgagattttacttctatccttatattgattaactatatttttccctttaccattttacatgcagaataatacatggagtatacacataagttgtgaagcacagtcacggactgtgcacacgtggacccacctgcgcggctgagtgccagggtgctcttctgtggcatcctccagggttaagcatcctttggggcttagtctccatttgacttactcttctggtaaatgccggttcacactttttacctattttctctttggtggtttttcttttttatcattccgtgggagtttctttttttctttctttctttctttttttttttttgagagggagtttcactcttgtcacccaggcgggagtgcagtggcatgatctcggcccactgcaacctccgtctgctgggttcaagcgattcttatgtcccagccaccgaagtagctgggattacaggtatccgccaccatgcccagctaatttttgtatttttagtagagacagggtttcgctgtgttgcccaggctggtctcgaactcctgacctcaggtgatccacctgcttcggccttccaaagtgctggaattacaggcatgagccaccgcgcccagcccgttccatgggagtttctgctatattctggttactggttactgactggctgtcagcagtagtgtacctttttttcccaccttggcttttcttttatctctttctgaggtgtctttgatgagcagaaattctcaattgcaatatagttgagtttagcagtcatagcttatatctaatatttttttctattacatttaagaaactcttcccaattccaaagtcattggaaattctctgtcgtctgctggacgttttgaagttcttctgccttttgctgtagcgcacccagagtctgccaggagctcacgcgtgtggtgtccttggctaacctgccatctcagcccctttgctgaagtccccctccctcccaaaccctggtttgcagtgctgcctgttacacatcaagcttccaaatctgcaagggtctgtttctgggctatctttggtccccaaattccgcttctcttaatttgctttaaggatagttgaggacataagcagatatttacttacgggaatatccactgaagttctgatgatagcattgagggaacgggaagcattctaaatgttccggcagtgggaagcaggtgaatgatggaggggagggtgtgtaggtgccgtgagatactctgtagccggtaaaaatgcatttgctgatgtggctatatggtgataatatacatgacaaaaaaatagcaaggtcacataacagtatgtacagtatggattccacgttcataaaaagaaagttgtaagttgaaaaaaacctgttatcttgctttctcctgtcctggtcacactcagggtgatttgatctggcttcgaccccatcaggccaccatgtccgctctggcaggtcctcggtgaccccctggtggctgcttcctttatcctcagctcagttctcatttatgacctcgctgctgcattggacatcactgatgcgatcttctcgacgtgctctctgctctcctccgcttctgcccactttcttcttgttctcctttctggctttccttccttggtattggtgtccctgggttcccatttccctgggcctccgtgtactccatgctttctcctttggggcccttggcaaggcatctcctgtgttaaaacttctacatcacagacctgcagagctggccgtcgccttacactgaactcccctgacgtcctcgaggcccgcagagtcagcacatccagaatgaaacccacatccccccactgagccacactctttggaggcatccaggatttctgtcctgtctcctccccttcgcctcggtcgattctcacatctttctgaacattcccatgcctgtgtccatctctcccctgccaccccagactcttgtcatcagctccccccttatgcgagtttctggagtgttctgccagcctccacatttcacccctcttctttcccacactgtggccacagtcagctttccagagtgtatttctgagccaccaccgggctctgtctgtagccccagggagcagctgccggcctctgcttgcccagcccctcctccctggcctgctcaggtacctgttgtctcaggcagctcccttatggggcattgctcactgccctgtgccccacatcccagagcactctggtgtgtacacatccgccttcctctggtctgagctcctggccatgcagccctcagagcccagtgtagtgaccagcatctggtgatgcagccacgtgtcagagagggggcaacctcaccctgtgcttgggcctgctagtgcctttcagacagagtccattctggactttccctgcctcctggtttgaagcccttttcaaggacattctcagagctgtcttactgttaagcaaggaccactggagacttgcgcttccccccaagcagctgcacgtggtagtcttggacctgtgggctgggcatatgtctgtcgggtcagtgggtggccgtggaccacactccagctcaggcccagtgctctcgccaacttcctctggggagcccagcactgggattggtgtcttgcctgtgtttgctggtgggcgcgtgttcactttccacctgctgctctctgactggagcttaagagttttctcggtgctgtgtgtgttgcaaatttgtctctgattggaataagggtatcttagatggcttgaacgacagttggcccttttgtttgtgcatagaacccaacaaagtgactctaagagcccggtggcccggcatggcccgagcgaactgtgcaggggcctggccctttcactcctgactctgctctagggggcaaggagaggcctcgtcagcctagcagcatttcctgtgggtgcctttcacagctgccacgtgcaaaatacagcacattattttggggtgttattttcttgaccacttttggttcattgcttttgactaaatgtttaaaaatattctgcagcatatctatagtactcacaagcagcgaatcaggagaagaaatgcagtttctgagaaggcttcaaagaaataatggtctttatcttttccccagccttttccgctgaaacccaccagtctttttctgagcactcttgttataaataaagcagcagctctccttgggcagcccaagatcgcagactctcatccgccctcagaaagattgtgcgtgtgcgtgtgtgtgcgtgtgtgtaagtatgtggtgcagtgagttgtgttttaattttgcttttcttttatgtatgagatgtgtagcaggagatgcaagaaaaaatactccagcatctgtcctttaaagataacttataacttttctgggttttgggttgttggttttgtcttttttttttttcccatttagggaagagatggaagtgattgctttccccacaaaggtaaggaagatgaatggggggccaggagagacgtcttcacagtgaggcctttgaggtcaacagagaaagggtctcgtggtatatgtttcaggcttccatggatggcattgttctgtgcagatgtatttgaaatgagtttcatccatgtgtacttggatgtgaaaaggatgtttggaaacaaataccatttcccagtccttcacactgaagactggtttatatcctcgctaccagaatcggggtgggactttctgtctgccttggatcacccttggtctgttttggacgggacctcagatgctaactgtatgctggggatccccgctgtctctaggggagggggtgggggtggggaggtcacttctggcaaacaagcgtcatcagaatgcttgatcgttggataatgttgggctcctctctttttccttcctggcactctttaattactggggagagggtgggtgccttcttcagaagtgtgaggtgaatgtataagccaagaatgagtcagtagattcttcagcagctctgccctgcgctgatcctctagagttggaaagggctgctgttgtgccactgggtcagtgccaaaagcagagttcaccatgattggcacatgctggtgagcaagaagctcttggaagtggtcgtgagtgcagccagttccccccaacccaggaagggcacagtgaggatggctggttgcgggataaggagaagagacccctaggcagtttgcattggcctgtgctgtccgggtgtggtcctggtgtccgtccacatgttgatggcgtgtcgggctgggggctttctgcagccttccctgttccactgtctctcctgttgtgaatgccggtggatggaacaggcagcgcagtgttctgcgcttgcattctggcataggtgggggacatgagcctcctgtgtcttgcttttgctggttttatcttagggagttttaagtgtttgtggatacttaagaactttgtacatgcactgtttgaaacatttacgtaaagtgcagagctatatgagattaggtagttaagcaaaagcttctctgaaccaatgtgcttgtctttgaacagaatttttaggaagcctccctccatttccatgctgaggctccttgtggactgggcatttccgtgaggtgggatgtaacatagtgtgcgaacgccgagagccaggttcttgtcttcatgcttgtcgtttattctttttgattgtgttaatggctccgagtacgtcaaaacatctcatgaccaagtagttagttacgcatttgatgttttggtggcatgggctgcgtaaggcgggagagcagctccgggagaagtagagcccccttcattcttggctttaattgagccaagatgagtggaccgtataatccatttctggattctcgtaagagaacgtcttgtgttggggtgaactcatcagcttttcgggttgagaggagttttagtgtctgtggccgaggcactttcctctcatggtgtgtgcagatgcacacgccaggcctgtgagtggtgggttgggctgagggcgcgggcctggagcttctgagccccagagccgctgacgtagacagctttggcagcagcatcctgagaaatggcagggggccagagaacacagagacagggccaagaatagctgaaaaataccaaatgctgaagttggagaatgcactggccccgcgtcccagtgtcctcccagctgctgtgtactgtggccctgtgagcctcagtgtcccttcttcatgtctgccagtgcgtccagggcacaccctgggcctcttgacacccccacccacacaggcacacattgccccttagaggacaggattggtgcaaccccccatgcccccggcagcgtgctgggcctgtgcataggtcaaggtctgttgagagtgtgagaaatattttctgttagagacacgaatatgtttcagccgcaacaggctgcgtttcagccggaagagtgaaagggcaccttgaaaacgcaagtttatgaatatgtttctgtactttcagaccatcatcaaagaggggatgctgaccaaacagaacaattcattccagcgatcaaaaaggagatactttaagcttcgagggcgaacgctttactatgccaaaacggcaaaggtgaggccccatgcaggaaagcacacgcgaggacatcacaggagccgtcccaggggaggaactgggggtgctgagtccttgtgtgggaaaagcttcaattctcagatctgttattgccagtgagttttgtaacactccacgctgtcaggttttacttgtctcaaggcatgttttatttcttatcaaaattaatttctgttcattttccttttctttaatgtcatcggtaatggggaaaaggaaaaaagggtcacagagacagccgcgttacagctggatatctctctctcagaaaggcggagggaatcacggggctatgaatttcatcttcttattattaaataatttttattctttaagtatattgaagttctttttttttttttttttttttttgagagggagtcttgctttgtcgtccaggctggagtgcagtggcgagatctcggctcattacaacctccgcctcctgggttcaagcaattctcctgcctcagcctcccaagtagctgggattacaggtgcctgcaaccacgcctggctaaaatttttatatttgagtagagatggggtttcactatgtaggtcaagctggtctcgaactcctgacctcaaatgatctgcctgcctctgcctcccaaagtgctgggattacaggcatgagccaccgtgcccggcctagagatggggtttcaccacattgcccaggctggtcttgaactcctgacctcaagtaatctgcccgccttggcctcccaaggtgctgggattacaggcatgagccactgtgcccagccaaagtagaaggagctgagcttcttgatgtgtgaacagaaatgggaaattctttatttttaggctttctagcaattaaccttgtttctgtgtgccctattgtaggtagatttaaagctagaagcaccaggtgggtgctgctggaggaggagcagccagtgaaagtcacagattactgccatgtttaagcggatgtggtgttagacattcagacaccagtgtgttggctgggattctgaatacctgtgttttttatcaggattggtgtcagtactaatattttggtatttaagaaatctggagtctgaataatttacattttgagacatatccctagaaagttactgcattaaaatttgaaatggaacaaagcagcttgtttagaaagggttctgaccacttccctcaattaaaaaaaaaaaaaaacacgacaaaataaccttttacagttagttctggtggtgcggggaggggaaaggttacttaaaagattgagtttcttttctgagttattagtttgattttctccagggttcctcatagagccatcgtagaatagaggggatggtataagggaaacaggaggcaggggctgtgccgggggaccctgtagggagtggagagggagacgggggaggtccccaggcctgactcccagccctgccctggagcatctttctctccaggaccaggatccttctgctctactcccttgtttcctttcacggccagaccctttccatttggacctgtctctcttctccagaagaatttgttttagccaggaccttccccctccatgtgctcgctggaggaacaagccaggaggacacggaatcctcagtccagaccccggccttccctcagctaaaacactgtgtgagaacatacttcacatgtaaaagtgaatactggtattgacagtagtaaatacagaaataccagcattgggttgtttgctttggttctctctctttcttccttcactaatgcaatgacaatgtttgtagatttttttaaaaaaatcatggcactatacctgtgagcccgagcttttggttagaagcaggtgggtgggttaatttggattggcttattgattggatgctacagtttcaaggtactggggcttctgtgggtgcttgttagggatcattggggtgtggtgggcagcgctggctagtgcttagggatgtacctgtctttatgtgccttagtccctgtgtttgtctctttctagtcaatcatatttgatgaggtggatctgacagatgccagcgtagctgaatccagtaccaaaaacgtcaacaacagttttacggtaagattcctcagtcatgcctttcttgattcttcactgaagttggctttcctttttgatctgaacatgtgtccaagcagttcaaacgttttcattcttttcttactgattggaatgattgctggtaaaatttgaatttaatgctgaaagtaatactgtggttggagaataaccaagaatttggcatgcataagcacaaaaggacaatagggaccaaatgaaaaatttttatatgtgttttggttcacgtctgttttgttttttttgagacggagtttggctcttgttgcccaggctggagtgcaatggcgtgatctccagctcacagcaacttccgcctcccgagttcaagcgattctcctgcctcagcctcccgagtagctgggattacaggcatgtgccaccacacctggctaattttgtatttttagtagagacagggtttctccgtgttggtcagggtggtctcgaactcccaacctcaggtgatccaccctccttggcctcccaaaatcctgggattacaggtgtgagccaccacgctttgctggttcacatcttactacctctgtacagagttttgttttttgtgattaatgtagaaaatttggaaaatgcagacaagtatgttaaagcaattaaaaagcagccataacagccacctcaaaaaacattgaatgttaatattttggtgtatttcttttttttttccttttttatgtttaaactttcttccttccaaatttataaaagttatgtaggactttctgcaaaagttctaaatgcacagaatcatgtgatctcaccacttggaagtggccagctgcttactctacagtgtttatctttatttctgtatatttatgtctttacctacatgtacccatgagatcatgctgaaccttttggtttacacctgtgtttttttccccccccaggacaatttatagtagagagttgctcatgtcagctgatctaaatgttcatgatattatttaatggctatagtagcattttcttgtaggattttataatttaggctttacgggctgactttagcgcctgcctgtgtaaggtttgactctaataacagcactagaacttttaaagctgtttttctttatgttattaggccatcccatgtagacaaaaagtgtgtaccctaattaaaaaaattattcttttataattcagtcaaggtgagtaattttcctcaagtttaggatctgatattttgggttagtgctagtttcaggtgctttcaagttttgttttattttatttattgatggattcattgttgatgttgccaatacaaatgggattttcctttctctgtctaaacctctgcttattttgtgttgattaactgctcttattttacttggagtatttgtagttttctctattaatttatttttaccagctgggaagagacatttttaaccacataaatagatttttctttgattcgtggtttttagagtctttaataggagtaggtgttgaatttctttggagtgttctgagcatcagttgattaattaatgaatttttttgagatgttgtctccctttgtcacccaggctgaagtgcggtggtgtgatctcggctcactgcaacctccgtctcccaggttcaagggatcctcatgcctcagcctccctagtagctgggattatagtcgtgcaccgttatgcccagataatcttcgtaattttagtagagatggggtttcaccatattggccaggctggtctcaaactcctggcctggagtgatctacccgcctgaaccttccaaagtactgggattacaggcatgagccactgtgcctggccctgggcattaatttagatgttcattttggtttcagttatttgcatatttcctaataaaaaaattattcttggtaatgttgaattttactcctttatcttgcaatttagaattttcccactggtatgtatgcatttgttttgggtgagaatgtagccttattgcagttttaaacaattgttttttctgtttttaattttaatggatacataatagttggacatactgtgttttgatttcagagttaaaccaaccccataaaattcatttagtaactttctatgagtttatgttttctgcaacattttatgtagctttgggattggttgtttcttaagttcgagagaatttattttaaattatttgtcaagaagactttttagggagataaggctgtaatagaaataaatcctaaaatatttatttcttgcattttgatcattttttgaaccttttcactttttgagtccacatctgtaatttactttcccacaaatttcacaccttcaaagttagtagcgtgtactgttgtgtagtttaaacacctgtgtctctggttgaatctcctttgcatttctaattttattagtttagtttgcttttcttgtcagatttcgtaaactctagcatttttgttttctttgtttttaaagagaactagttcttagattattgaacaattctccttttctgtttccttttttatttttttgagacggaatcttgctctgttgcccaggctggaaggctggagtgcaatgacgtgatcttggctcactgcaacctccacctcctgtgttcaagcgattcttctgcctcagcctcctgagtagctgggattgcaggcacctgccaccacgcccagctaatgtttttatattttcagttagagacggggtttcgccatgttggccaggctgttctcaaactcctgaccttgagtgatctgcctgcctcagcttcccaaagtgctgggattacaggtgtgagccaccacgcctggcctgtttccttttttttttttttttttttgagacagggtcttgctctgttgcccaggctgcagtatagtgctgtgatctcggctcatggcaacctcttcttcctgggttaaagtgattctcctgcttcagcctcctgagtagctgggattacaggtgtgtcccaccacgcctggctgatttttgtatttttagttagagatgggttttcgccatgttgtctaggctggtcttgacctcctgacctcaagtgatcctcctgcctcagccttccaaagtgctgggattacaggtgtaaggcaccatgctgggccctactttcctgttttctaattcagtgtctgtatttatgtgtattggtttttttttttttttttttagatggagtcttgctccgttgcccaggggggagtgtagtggtgtggtctcggctctctgcagcctccgcctcctgggttccagtgattctcctgcctcagccttgggtagctgggattacagacacatgccaccatgcccagctaatttttttatttttagtggagacagggtttcaccgtgttggctaggctggtctcgaactcctgacctcagtgcccaccttggccacccaaaatgctgggattacaggtgtgagccaccttgcccggctgtgtattagtttttatctgttgtaacttacgaaatatgttgttcaagtcctcttatgatcttgttttttatcgcttgagcttccataggctgttaatgaggagttagaatctctttcaggccagttacgtttaacactttgttcatgtatttctaacagttttcaccttctccattttgaagctttgttaagcgtgtaaatatttaaaaagataataccttcaatattgagtaatcatttgttaataaagattaataaagtagtagctttttttttcttctttcctagacaaggtcttgctctatcacctgggttggagtgaagtggcacaattatgactcactgcagccttaaactcctgggctccagtgatcctcctgcctcagcctcccagttagctgggactacaggtgcttgataccatgcctggctaatttttacatttttttgtagaagcaaggtctcgctatgttgctcaggctggtctcaaactcctggcatcaagtgatcctcctgccttggcctcccaaagtgctgggattaaagaagatctttttcgcaatgagtagtttgtgtcattaactgttctctcatgtatattagtatttctaagtcttcttttctttgttcagaatttacttgatatacataccccccacccttttccatcctaacttttatctttagttttccttattattttgaatttaattccctttttttttttttttttttttttttttttttttagagataggctcttgctgtgttgctcaggctggaatgcggtggtacagtgttagctcactgcagcctcaaactcctggtctcaagagatcttcctgcctcaccctccccagtagctggaaccacaggcattgtcaccacacccagctaattttttattttttgtagagatggggtctaactatgttgccttggctggtctctaacttctggccccaagtgatctgtcttggtgtcctaaagtgttggtattacaggcatgagccgatgtgccttgcctagatttaattcttgtaaacagtatgttgttagaatctgtcttattttagtcagaaaccctttgccttgtaaatattgtgcttcagccattttctgctgtcaggattcttgcatatctgatgcctgtgttttgtggctgaatgtattgtgctttcttgtttgtttgtttgtttatttatttatttttgagacaaggtcttgctctgtcacccaggctggagtacagtggtgcagtcatggctcactgcagcttcgacctcctaggctcaagtaatcttcccacttcagccttctgggtagctgggactccaggcacatgtgaccatacccagataatttttgtttttttgtagagaaggagtttcaccatgtcacctaggctattcttgaactttggggtgcaagtagtccacccaccttggccttctgaagtgctgaggttacaggcatgagccaccacacccagccatgctttcttattttaatggtctcttggtacctctcttctacttcccttctgtgttgtctcttaaacatttatagttcacagattttctttttcctttcttttcttttcttttttctcctcccctcccctcctctcctttcccctcccctccccgcttctctctttttctatcttcctttctttcctttttccttttttttttttaatttaaatttaagagacaggtcttactctgtcgcccgggctggagtgcagtggcatgatcaccatttaccgcagccttgaaatatcaggctcaagcgatccaccggcctcagcctcccaaaatgttcagattacaggcatgagccaccatgcctggccaagttcacaaattttattatgctagacctgtttgtagccagcccatatggtgacatcctttttttggtcaagctttgtgtattactgagggtttagtcacagagaacatgctactcaatgctttgtttcactagctcttattcgattcataccaaaccatgaaaatgaaaaaggactgaagaacatggaagaaaaataatgcaaaatggtctgttttccagaaaggaatcaaatacgatattttattagtgagctccgagaacatagtatttcccaatgttggtgttgcagggggttgtcgagagcaggctcgatgctgttgctgtctttgaaggcatttctgctcggagactcagagttgccttctctcttgtgcaatgcgggtttgctaactggttggtctgggatagagcaagcctgatttcttcctcactccagtttgggctttccagctttgaaaaactgttttttccttcttttctcttacacttgaaaaaacgaattctggttcatgtgctttgtcttgttctttgggaatttggctcgtttatttagtcattgttttggcaagcattttttttggggtctaccgtgggccacacaccatgctgagtgcggtgggtagaaatggagaggagccactctgcatcaagcttatattctcgtgggagatcagataagcacatacatagaaccttagttacaggctgagacaagctccgatggaagagcagtacatggtgcctgatatgtggaagaccccacctggccttggggaggggctgggcagtcttctcagaggaagtgaggtctcatagctgagacatgaagaatgatagtggtaaatccactgagggaagcatgagcctgagagggtatgtgtgtctgtgtgttggtgtgtgtctgtgtgtttctttgtgtgtgtctgtgtgtttcttgtgcaaataggcacctcggggatggggcaggtggagggaccagcagtgcgaagaccttgggatggggacaccacgtggagtgtgcaaagtggtggaagggccagggtggctgatggaggccagagcaagaggacaccagaggggaccagcgtggctggggggggccagagcgagaggacaccagaggggaccagggtggctggggggggcagagcgagaggactccagaggggaccagggtggctgggggggggggcgccagagtgagaggactccagaggggaccagggtggctggcagaggccagagtgagaggacaccagaggggagcagggtggctggcagaggccagagtgagaggacaccagaggggaccagggtggctgcggggggggccagagtgagaggactccagaggggaccagggtggctgggggggggggggtgccagagtgagaggactccagaggggaccagggtggctggcagaggccagagtgagaggactccagaggggaccagggtggctggggggggggccagagcgagaggacaccagaggggaccagggtggctgaggggggcagcagagtgagaggactccagaggggaccagggtggctggcagaggccagagtgagaggactccagaggggaccagggtggctggcagaggccagagtgagaggacaccagaggggagcagggtggctggcggggggccagagcgaggcgagaggacaccagaggggaccagggtggctggggggggggggcagagtgagaggacaccagaggggaccagagtggctggcagaggccagagtgagaggactccagaggggaccagggcagagcttgggacttactcctcaggacttgggctgctgttgaatagttttatttggtgaaattctcagatttgcaggtgtcagaaagttctactctggctgtagggtggagggtgaactggaaggggagggaggtttgtaggattgttaggagagagtggagtggagagtgcggaggtgtctagggggcagtgggcaggctagtgatcaggtcagaagggggtggagtagatgaaggtgtcagggcttctgctgagtacagcagcaggctggttaagtgagctcaggagtccagaagaggggctgtggggtggtgggggaggcttctttatcttccatgtctgtcacattctttagccttattttatttaatttgttggtttttttcctagttctagttatcaaagtttttatattgtttgttactacatttacttgcaacctcccctcccagctcccaccccccacccccgattttggcatactttgtatttatcctggcttattcttgtttgaaaggtaaaatttttttttttttgagatggagtctcgctctgttgcccaggctggagtgcagtggtgcgatcttggcttactgcaagctccgcctcccgggttcacgccattctcctgcctcagcctcctgagtggctgggagtacaggtgccgccaccacgcccgactaattttttttttgtatttttagtagagacggggtttcacagcgttagccaggatggtctcgatctcctgacctcgtgatccgccggcctcagcctcccaaagtgctgggattaaaggtgtgagccaccgcgcccggccaataggtaaaatattttttaaaagttttctgtttaacaaagtcattccctccagggaaagattttcctttgatcttctccattttctcttgggttttcacatgttttcattgacttaggatttctcccctgatttattaaactttgtgttatagtaattttagttgttgtcttcaagtcctacgcttgtttgctttttttgagacagtctcactgtgtcgcccaggctggagtgcagtgatgcgatctcagctcactgcaacttccaccttctgggttcaagtgattcttgtgcctcagccttccgagtagctgggattacaggctcccgccaccacacccggctaatttttgtatttttagtagagatgggtttcaccatgttggccaggctggtcttgaactcctgagctcaagtgatctgcccgcttcagcctcccaaagtgctaggattacaggtgtgagccaccatgcccagttttatcatcttcccttagcagcctagagctgtggaacactacaagactgtagggtccattcgagttttatgcttttatttacttatttctccaagtcagtgtttttcatcatttttaaacccatgttctcttttgatgaaggattaatttttattgcctcatttagtttttgaaatttcaaaatgcagcaaaaaggaatgaaagcagtgggctttattctcaccctccctgaccctcctggagagtcattcctacctgtattccatttggtcttatttatttataatatatgctacatgagagcaaggatttttgtctgttttgttcatggctttacaccaagttcccagcacacagtaggtgcacataactctttgttgaagagtggcttggtcacctccagttccagaatgatttgggccctgcccctcattgttcggctctgcaggaagcttcctgggaccagatgctgggcctggctgcaagatcaggtcttccttcctgcagggcacagtccatgtgcatcccagcagccacggcagggctggggaggaactgatgtgggttgcttctctgggcagggcatgggggttccctgcctgtggtgggggaagggggtacgtggctgtggggtggaagggatgtttcttgccagagggagtgggcgtgggaggtgcgctgggtgagcagcctctgaggcaggaagtgctttccaggctggggtgggtttgggcttttttgtcagagctgtgggaagccattaagattttaaagcagggtggtaaagttgggtttttgttagaagagtctgtctgctgctggaggcgagatctgcagggaagagttggctaggtggatgagaaggggtgcagaggggcctttcccccaacatgaggatgtggacagcctggatgtgcttatggaggtgagagatggggcctgaggagagccatgcactgcaggcgggcagggtccatgcttctgctgttgttggtacttttatttgttttgggtgactctgagaattaaatattaataacagtgttgaaggaacatactgtatcattggccatgatgcatgcctcctagaaagcagcgctgtacacagtgacatgatcacagcacccctgcaggactccagatgcacagtttcttctcctcactgagagtgttttggtattgctggcctttccagttctagaaatgtcccctttgagactgacttcatggtggctggtgtcagagtctgtgtcccttgtgaaggaggcagaatcagagctaaattcaatttagcaaagattttctagactaagtaggaagagggctcatcacccgaagtgggcgtgggtgctccccatagccaggctttgtctacaggacagcgggaggcagtcaaggcctgagccctggccaggtccctcggagggcagggagcctggagctaggagagagtggtgatgcagggtggccatttccactcccacagggccctttgcccttcacacccagtgcccactgccctgtctgagacgcctcatgctgtcctggcctgggcctccctggccacctgctggcatggcctctcccatttgtgggggtgccacttcctaactgcctctcctctcacggctctccttccgtgccccctaccttgggcaggatgtgggtgggatatagtttgagtccatctcgggtgctggttttatgaagcacacatttgactccctcagtgggtggtggagtgtgcagacctgagctccctgagctctctcgggtagccctggtcacctctcatgggcagggctgcttgcacagctggagggcaaggcctgagctgctgttcccggagagctagagctcgacaggcctggactgcccaggaggcccgtggaaaggctgatccttcctcagttgttgcagctgagtgtgtgtggcctcctgatgctacatgttcagttgccttttacttcctttatgagggaagttttatgctacgcggtatttccaaagtgtgagctccccagaggaatcagggactctgtctttgaatgtccagggtctgtgtatcctctaccagatagaagacccaaggcagcaggactgggctccttctcttcttttgatctctgaaagtacgggactctgcaaggtaacttcattctttaaggcaagccagagtgtgaatcctagctcagcttcttccaagcagatgactgggggcgagtcacaggacagctcgaagcctccattttctcatctgagaaatggggctagtaacctgccttgtggggtggtttggttgtaaggactaaatgagttaatgaatgtaggcatgatatatgtgtttgtgcctattaacactgtgattataggcacttactgattattcagtgaatgaactgaaagcaataaaccaaattcatttattatatcatttggtatgtggaaaattttcttctagtttggtgtacttaacgtttcatactttctctgtttactgaataataactttaattgaacaaaatcactactaattagtccagatttcactgggcttcagttagtctggctgtattattactactccctgggtcatggcaactgtagctgaggtgaaccttagagaggaaagacaagttttactggaatatgcctgaaatacagagccatttagaagggtcatattctgcccattgttaaaagcgctgtgaactaaggctgggcatggtggctaacacctgtaatcccagtgctttgggaagctgaggcggtggttcaactgaggacaggaattcaagaccagcctgaccaacatgatgaaaccccgtctctactaaaaatataaaaattagacagacatggtggcgggcgcctgtaatcccagctactcaggaggctgaggcacaagaatcacttgaacccgggaggcagaggttgcagtgagctgagatcgcatcatttcattccagcctgggcgacagagtgagactctgtctcaaaaaaaaaaaaaaaaaaaaaaaaaaaagcaagcactataaaccatcgaggggcccctcgtttcttacctaatgaagttcagggtctggtcctcatgtgccctcccagcctggcctctccccagccaagcccagtgcttcttagggagctccctgtgtgtacgggtcacctgctggccctggtctctgggggtctgtttccccaaattctccccaccgaccctgtccgtttcctcctcagggaagccttcctgtttacatggtgctcaggaaactgccatatgcttctgtgggactgtggttctcaaacttggccatgcccgagcaccttttggaactttccccagaagtttgcaagtgggtgctttttcaaagctttccaaaatcttagggtacaaccactttgggacccccttcttgagggtactttgtgtcactcatgtgatgctacattagcacaagctccctagtaatgtgtacttggccacaccttgagctcaaggccatggagtgtcttggcagcttagggtccccagtgctctgccctttggggtgactatgtgtatgaatatgagctggaagaagcaggttctgttgcttctttttgttagcacaacagagagaatgttgactcaccccttccttggcaagccccgctgaagaggtgctcactattgtggacccctctgtgggccaggctcccccttttacaatttcccagctcatgtccggccggcagcttggggacaaggttagcccctgtgctctgtgtgtgcgcttttagcgagtttgccagctggaaaacttgtttatcccagagaatggaggagtcatttgacaagtaaggcattaccctggccacctaatttcaaatcagttggaaaagatgcaagttttagaacttgttattccttatttgaactatcctgtatcacggcaaactgtctactgagtgcctgagggtgtacggggtaggtaagtgtgttccctactctgggagacttctaacagtatataaagaagtagttctagtgccctgtcataagtagagtggaagaaggtacaaagtacagttagagtggtggtggttagccttgggaggggaggtaagcttctctgaggagcggcatgagagctggatgtggggacgggtcccttttgcagagaggactggggaagagtcagggagtcggggacatccaggaaataggtggtaggagtgtctgttcatgtgacacactagcagtgcctgctttccaggtacaagtcctcctgtatggattcatttgttaacttagttcttaaagtgtttgaatcttagtaatgattttaaaggaaatttaaaatagggagaaaatgggctgggtgtgatggctcacacccgtaatcccagcactttgggaggccgaggcaggcggatcacctgaggtcaggagttcaagaccagcctagccaacatggtgaaaccctgtctctactaaaaatacaaaaattagctggatgtggtggtgggcgcctgtaatcccagctactcaggaggctgaggcagggagaattgcttcaacccaggaggtggaggttgcagtgagccaagatcgcaccgttgcactccagcctgggcgacagaacaagactccatctcaaaaataaaaataaaagtaaaatagggagaaaatgttcccacagtagctctgcagttgttttcttttttcatgtttctcttcagacttttttttttttagatggagtctcgctctgttgcccaggccggagtgtagtggcgcgatttaggctcattgcaacctctgcctcccgggttcaagcaattctcctgcctcagcctcctgagtagctgggattataggcgtgtgccaccacacccagctaatttttttgtatttttagtagagacggggtttcaccatgctggccaggccggtctcgaactcctgacctcgtgatccgcccaccttggattcccaaagtgctgggattacaggcgtgagccactgcgcccttcctcccttcagactttttaataggcacacattaaattttacatgtgttatatacatgtataattttgtgttttgtgttacaaagttaaattttgtgttttgtgttacaaaattacattttacatgtgttatatacatgtataattttgtgtttacatgtgttatatacatgtataatttacatgtgttatatacatgtataattttgtattttggctttatttgctgttttatcataagattccccatatcatgagtctctgtaatgatcgttttttatggtggcagatatttcattgtgtagatgtgtcatcactgatcagttaaactttatttgctcactcttgcagcattaggaactgagaatgtttcagtttttcctgttggagataatgctagaatgtgcatttcagatcacaggagggacatttagggaggtgagtttgttctcccctgcagagcagcttccatgctgagccctgtttgcccaggagagggtgcagtttgcccttcaggagctgctttggtttggtcttgggttcctttttgttacctgccctgagagttgagaagacaaaacttcctcctgctttgggtgattctagtttggttctggtttacagctttatttttgagtatttctgtatttcagcttctatttactttacaccattttagatagatcatcatttgaactttcagatatcctaagcctccagaatctctagaggattggcatgtcacataactttaaaaaagcaatatcaagaagaagttgggtttgttgaagggaagtggacagatcaggggactctggcttatatggctaagctggtggaggaagacatgtgagcagacattgggtgaacgtctgctgttccagtggcacatcctggaatgaggttgggtggagggtaggtagagagctgccccaggtatggaaggtggtagaagaagagttgagtacacacttgcatgagggatggggctggtttacaggaatggaaccagcttggaaagaagacagaaggtgagaagtgaatacttgttggtatcatgtaagaacagagtgaagaaaaaggacaggccggcccttggtttatttttaaatttcaggaaaatggattggccaaataatggggatcaaaaataaagggtgtttttattatgagccaagtgaaaattaaatttaagatatgtatgttgttatggtttgattgtgtcctccaaagttcatgtgttggaaactgaagcgccagtgcaacagtattgagaggtagaaactttaagaggtgatcagtgctgggtgcagtggctcacgcctgtaatcccagcactttgggaggccaaggcgggcagatcacctgaggtcgggagtttgagatcagcctgatcaacatggagaaaccctgtctctactaaaaatacaaaattagctgggtgtgttggcacatgcctgtaatcccagctactcaggaggctgaggcaggagaatcacttgaacccaggaggcggaggttgcagtgagccgagattgtgccattgcactccagcctgggcaacaagagtgaaactctgtctaaaaaaaaaaaaaagaaagaaaaaaaaagaggtgatcaggccaggagggctctgctctggggatggattaatgctgttattgtaggggtcagttcctaataaagggatgagttcatctcctcccccttgttctcactgtcacctttgacgcagcatgaagcccctcaccagatgccgcaccatgctcttagactttcgaactatgaggcaaataaacttctgttcatttaaaattatctagtctgtggtattctgttacagcagcgcaaaacagactaagacacatgtctagagggctgcttatgtgtaatagctatataatactgcatatataaagggcagtttatatttaatgctggtagaatatcatgaaggtagtgtatgttagagttaggtttagctactgtattagtttctcatggcttccatagcaaattatcagataacatgaaacagaagaaatgtaattctatcacattcctggaggccagacatctgaaatcatggtgttggcagggctggggtcctaggagagactctgtgacttgcttttcccagctcctggtaattccaggcattccctggcttgtggctgcatcgcttcaagatctgcctctgtctccacatggccttttcttccttcttctgtgtcttctcctctgttttcttaaacagacacctgtccttggatttagggcccactcagataatccaggatgatctcatctcaagatccttaacttgattacatctgcaaagactgtttttctaaataaggtcacattcacaggttccagagattagaacatggacataccttttggaggccatcattcgatgccctatagctacaaataagaatggtgtgaacaggcaaggttttattctttcacaccaaagaaagtagtccttggtgagtatggtcattctgcaaggtcgaccgagcccttccagaatgtgagtcttctagtctaagaggctatgaggtgctagtcaccactgtgtctcctgttgttggacggggagacgaggagaggagaaagtgtgttgcctggtaggagttcataaccaggattcatggccccctcaaagcggtctgtggatatgactatattgtattaaaattggtttccactgtaatcataagtattttatttttggcacttagagaaattctgagaaggagttcataggcctcaccagactgccagaaggggtccatggcacagaacagacgaggagctcttgtatgacttctccaaagtgtgacatggcacttctgcggacatcctcccggttgatctttagttatgtgctcataccgtatagctctcaggatgcttgccctgaaataatcatatcagaataaccatgttatgcagagagaagggtgatttttcatgtctgtatttatgacttccttttccccaagtaatatttttgaatagtttatggtatcaagaagtttgatgaagtatatcataaagaaggtcttccttgttagctgtgtgacctagggcagatacttcatctttctgagactcaattttctcatctgtgaaatgggataatactggactgtatctcaaaggtcattggattggcacagaagtgcgttctgaatgtttcctagtttctaatctccaccaccagtcatctctactagtaggaaagtaatagggtttaacttgctaacatgtaacagttattctgatttataggagtttcaaaggatttcaaacgaggccaactttacagatatattaaaaatagcttttgtagcagaagagtagatatccggaaaaagttatccttaaaagttttcaaggtataatcaatacaaacaggaaaaataaaagttaagggaaaaccaagtataatttaacatataagatgcctttaattggtagctaaataaaaaggaagctatgtaatggatcagagtattgcgtttaaatcttgtcatggcagagcacggtggctcatgcctgtaatcccagcattttgggagaccaaggcaggagaatcacttgaggctaggagtttaagaccagcctgggcagcataacaagatcctgtctctacaaaaaataaaaaaaattatccaggtacggaggcatgcacctgtagtcccagctacttgggaggctgaggcgggaggatcacttgagcccaggagttctaggttgcagtgagctgtgattgcaccactgcactccagcctgggcaacagagagagatcgtgtctcaaaacataaaataaatcttgtccatgtggcattcatatttgttgggtgaatgaaagttccctagtaggcctacctagcgtgaaactgtggctgagtttctcagctgtttctaacagacatcagcccagaggatggttaggactgcttcttgggtgaggaaccgtgatctttatccagatttcatcatcagttttcctttttagcatgtttggatttcagatattttctgggcaaaattcctaagccagttaactttggctcggagagaggaaaaactgtttttttttttttttttcagatgagtctcactctgttgcccaggctggagtgccgtgctgcgctctcagctcactgcaacctccgcctcccgggttcacgcagttctcctgcctcagcctcccaagtagctgggactacaggcatgtaccactacacctggcaaactttgtatttttagtagagacagggtttcaccatgttggccaggctggtctcgaactcctgacctcaggtgatccacccatctcggcctcatgggattacaggcgtgagccactgcgcccatccagagaaactgtatataattggcaaatgtctctgcataaaagactcttcctaattgctgcaactgctggcccaggtctgggacagggagaattgtatttgtgggtcccaaaagtcctcttgagtgtgaagtgtctttgctcttcctgttgggaagccccacgttcgttagcagctcctgccccctgggctcacttctgcaaagcaagcctgcctctatttctgctcaagtgcagtgttccaggagaacctgactgcatgtcccagctctgccagctctcagtggtgggttcttggccacctgtagcttcattctcccatctgccaatgagggtggtcctacctagcacagcaatggtggggcagtcgagcaccgggcagagtaggtgctcagtgaatgaaatactgtaattattaacacatgccatggacagcagtgcaggcctgcgggatcaggtgcagaaggaagttaacccagtgaattccacacctggtaatccacactgtgttctcaggttaaagaagcaggaggaagcaggcattgagtcaaattggtggctgtttgctaagtgtggggttttactgaaggcagcacctgcttctgcagcacagctggtctgaaaagccaggttgctccttgtgagggcttaggggtcggttttaacagtcactccaagcaggcacagggagaagatgctgtcctcttctggcagcctggctggtgagcagtggaaccaattgtggtgtctcttctttagagtttggggtgggagaagacgcagttactcgtctgggctgtttgtttagattatcagtggggtttgcatttgtgaaatctaagccattttcaccttatgattgtatgtgtttgaaaaagtatttgtgttgttaacacttgttatacttgttaatttttatgaacaagtgtagcgtacttgttaattgtctttatttacaaatggcagagaaaacaaagtggatagttgagagactgtcattggattatagtaatttagtaagggaaagagttctttgagaaaagacctggggggaagatacatggatttgattgaattttttcctagggtgcctaggcagtgaatactttttagccatctttactcagtatgcttttaaatgtgtcacggtgtgattgagccaagttccgtctgtctggtttttttttttccttgaaagttacaaaaatggtatcattctctaggaaatcatgttaaaaaaaaatcccacgttcccgtcccagaataacctggtgtttcacagtacatagtggtaggatctttttatttccttgaaacaacttgttatcaaattaagataatttcctgctctgtggtagggagactgctgtttattgacccagtccttcctcctcaccacacaattgaagaacctggtttgaagtgtaaacctaaaaaacatgtgatccccccataccgtttttttttttttttttttttttttttttaagacaggaggaggactgtgggagtggttatcagtagatctgtgcagaagggttggccctgcagactgggtctggtgtagaatgtgccctgtgggagctgcctccaggcctgtggctgggtgtgttaatcagtgctggacttcatacagaaaagtcgatgctgttttcttttctttttcttttttttaaatttggtagagatatgatctcaccatgttgtccaggctggtcaacatgatccaatcctcctgccttggcctcccaaagtgctgggattacaggtgtgagccactgtgcctggccaatgctgttttctttgtagctgaattgttcattggctgcaaagctatagagggtgggtcaagataattagatgtttggaaaatagttaagagggggattggcttccaccccattctttgattttttttctctttgaagaaagagggggggctcaagggacactgaccttggaggcaggagccttggggtttgtcctgtgcccgtcattgaccgggatcgcttccttttctgtaaatcaaggtcatgggcgcagctgacttgccaaggctgttgccagctctgcgctgccttctgaggaacttgatggtttgcttcctgtgaaaacttgatggtttgctttaaggtatcactagataccttggggtgatatctaatcacaccaatgaagagattgggtatttgtttttcccaaatccctaagtgctgatttctccagggcagtacacaacctcttatctttagcactcactttgacttgcataagtttcctggcttggatgataagctatatggtcaccctgcttattcagagaaaggttcatagtgttctttaatgactattctaatacatgaaaaccattttttgtgacttgagacataattgatgtacaataaactgcagtatttaaggtgtacagtttgatagtttttatacacacacactttctctctctctctctcataattacactgaagctgtcaccatagtcaggataacatttccatcaccctgagaatttccttgtaatccttccttctctgcctcttcacaggcaaacatggatggatttgttttctgtcattgtagattactctgcattttaaaaagaatgctatataaattgagtaatgcagcatgtactacttttttttttaatgtctggcttctttcactcagcataatggttttgagatttttcatgttacgaatatcagtagtccattgtatgcatattccagcatttgtctattctattggtgggcatttaggtagtttctagttttgggttattactaataaaactatgaacatttgtatacaagtcttttgtgtggacatattttcatttctcttgggtaaacaccttgaagtggaatcgctggatcatatagtaggtatatgtttaacttcttaagaggctgctaaactgttttctgaagtggtgatccaattttatattcccaccagcagtgtatagagagttccagttgctccacatcctcaccaacacttggtgtgatcagtctttttaattttatgtgtcctaatagttatgtagtgttaccccattgtggctttaatttccatttccctgatgactaatgatgtcaacatcttttcatgtgtttgttggtcatttgtatgtcttttgtgaaatgtgtgctaggacatttatccatttttttaattgggttcttattgagttgtaagacttctttatgtattttggatgtaagtcctttgtctgatacatgtgttgtgaatgtttttctcagtctgtggcttgtgttttctttaatgacacttttagaacagaagtctttctttttggtgaaattcaacttatcagttttttaaatggctcattcttctagtattctatccagaaaacccttgtctacctcggcttgcaaagattttcttctataagttttgtagttttaggttttacagttgggattattattgatgttcttcccccgacccccatatggatattcagtttttgaggcagcgtttattgaagatacattccattcctcatttaattacctttgctgccttttttcaaaagtcaattaaccttttatttttgagtctctttccagattttctattttgttttattgaactatattatgtctgcctttactgaaataattctacactttgttgattactgtagttttataggaagtgttgaaattagagtcatctttgttcttttctaacatagctttattctaagtacttagcattttcatataaattttaatattagtttgtcaatttctataagtgaggcctgctagaattttgtttgagattgtgttaaatctgtagatcaatttggggagaattgctatcttaataacattgaatctttaatgatgttgagttttccagtacattaacacgatctctctctctttatttaggtgctttaaatttatctcagcagtgctttgtagttttcagtgtagatgtctttaacgtcttttgttagattcatttcaatgtaatttatgtttttatttttattaactaaatggaatttataaacattttatatctgtttgctgctaatatataagaatacagtggattttgtgaccttgcaaaatactgcttgtttaattctagtagtcattgtgtagattccctagaaagttctatataaagttgtatcatttgcaaatagggacagctttacttcttcctttctgactcacatgccttttatttatttttcttgcttcattgcaaaggctaagattccagtacagtgttgaataggagtagcgaaggcaggaatccttccaccttttccagtcttaacatgaaacagttcggttttcatcattaaatgtgatgttagctgtaggctttttgtaggtatcctttatcagtttgaggatgttctttacttgatcgctgacagttttaattattaatgggtgttgaattttgtcaaatgcttttctgcatttattgaagtgaacacatggtttttttctcctttatattattaaaagggcaaattaaattggttgattttcaaatttaagacaacttttcattcttgggttaaaccctatttgctcataatatgttttttatttattgttggattcaatttgccattattttgttaaggattgttgcaccaatattcatgaaggtattgatctgtaatttatttctctccctttcttccctcatttcttcctttctgcctttgtcaggttttggtactttaaaaaatagagagtcaggccagatgtggtggctcacgtccgtaatccctgcattttgggaggccgaagcaggtggatcacttgaggctaggagttcaagactggcctggccaacatggtgaaacctcatccctactaaaaatacatatatatgtagtgagtcagtgttaccccgcctctgttttctgataaagtttgtgtaagcttggtgttctttctgaaatatttgctagagtttaccagtgaaatgatgtaggtatgcagtttttttggggtaaagtttttgataataccctgtgattttttttttttaatgttcagattttttgtttcttgtgtctgcagtgacattttctgcattctcttccttttccctctgatttatgtctgttggatggagaagtagaaactttatgagagaagggatatcatggggcttgttgatctgttttcatcccagcgcccccgaaccatgcctggcaccaaatagccacactgtaaatgcctgtggggttaattgatttgttgttgctgtatctctattccttggcacctctgggaagcatttttgtctccccccgtccacatgggaccgtgtcgtcactgtgctgtgacgggagctggctgagtcaggctggcaggctgtggctgccctgcatgccgtgccctcccacggtggctcttcaaattcttggctatgtgcccagcactggtacacagaccctctgagtcagggcttgccaatggaaaaaatattttcaaccttttttggtcttttaaaatattaaaacctatagttggaattacttcttttcatttttacaatgtacttgaagtatcagaggaataaggaaagccattgtaagcttggttagtggaaagggataaaccacctctgagcatccaaataaaattaggaagcgggggttctagatgagggaggacaattccaggaggctcttgaccttgtatatgattccctgactgggaatgtggtctgagatgccctttcctggacagattacaaatgacagcccctggagcaaacacatgaatcagccagggagttaaaaaagaacagggtagtttggactgggcctctctctttcaggacatgactgctgtggctacagactgcattcaggtccccagcatctggaaggagtctgtgcccacttatcctttgcatcctaaggggactgggtctttgtgcaccagcagcagccgtagaggttgggcttgggaatcaggggctcccttatcaaagctgggaaacttagaacaacagctgtgccgctcatggacctgtagtctctcctgttaagcagagtgctgagttcatgtgatagcaaacacagctctgccagaccacagggtcaccaggcaggcactccatccctccctccagggggagaccacggcatgccttggatgaggtgacttggccaactgtcttgtggccccagctcctgacattacaatgtgatgactgtgacacttggaagagaaatgtctcaggtatcgtggtcctgggtcctgtggtacaggaccttgtctctgcggtcctgtacttttgcttcacaattagaagaattgaaagcttcaggttgtttcaggtatgttttttcaagaagtgcaatagtagtgtgtttatagatgttttccttagagttagttttgggggagagaagatgactgcccttccatcctgcaggtggattggctggggaatgaggccatctcttttcagagtgagcagtgaaccatttttgtctgtacactgacctggggctgatttggcatcctgaccttccagtctgagggagttggtaaggggctggaagggcccattctttgtgtgtgtgggtattttttagagacggggtcttgctgtgttgcctgggccggtctggagatcctgagttcaagcaatcctcttgccttggccttccgagtagctgagactacaggtacatgctggacccacactttggactctgtccctgctggcctagttctttgccaagagcaaaacttgagagcaccctcacacaggtaacagttagaccttgtcaggagacatggctgttttcccagacagctgagctttcagactaaagcacagaaaagttggaggacatgggactccttagcccacaaaagaaactctattttaattttccatgtgaaataggagtagggtacgttagggtagggcatcttggttatgagatgcctgcagcaagtgccatcagggtggctgccagctgagtcatctccctcaaagagctttcctggaaccactctccccggtgatgtcagctccttcacctccattgctgtctctagctgcaggggtggttggagacccagtattttagctaggccctgccagaggccattgggatagcaggtcaatggatgaaggaggttgtataggcaaatgggagtaattatctctgatcttgatttttgtaggaaataggcgtagattaaggcatagataaatttgaaaaggcatagatacattaattaattaattagagatgaggtttcactctgtcgccctgtctgaagtgcaatggcgtgatcaaggttcattgcagctttgacctcctgggctcaagtgattcccgcaccttagcctactgagtagctgggaccacaggcaggcaccaccattcccagctaatttataaattttttttgtagaaacagggtctcactgtgttgcccaggctggtcttgaacacctgggctcaagggatcctcctgctttggcctcccaaagcactgattggcaggcatgagctgctgcgcccaaccaggcatagataaatttaaagacaccttttactgtagacaatttggaaaatagagaaaaccagagggaaaagaaaaaaaagaatctctcagtcctaccacttgatgtgtgaacctccagttttcccggctgcttgtgtcctgccttttttaaacacaatacgatgacatcagtatgtccccctttccctcatttatgttttattgtggtagaatactgttttattgtggtagaatacacataacataaaatttagcatcttaaccatttttaagagtacagtataaatatgcccttttataaattacttgtttttccctcctcgtgtggctttgttttctgtgtggtagccattctgtggtttacttaaccactctaagtattgaacacacaaacaggcttgaatcaattcatttgaaaaggtgtggacaagactttgtcctaagggtgacacctggcccagccagcagatgtgattgttctgccttggccaccttgctctgggaaattgtattgcttagtcaggttgaccttcagtgaccaaaaaagtggatggtagtgtcaagggcttcgggtagcttatgaaactctttttccttctcatcttgttactttcctcttgatacttacttgttaactacagtgttactatagacgcctttgggtatatgcagatttaccattagttaatcccagagaaaaatggataaattatgacagcgtggtggctgtcagacttaagaatgccaaagcattcccgtttctctccctccaccccatcccttccagacttactaccagggacctttggtttgcctttccttgtcaccaggactccgaggtctttcagctccttgtttcttctgttcagtagctgaaggatgcaggtactctgccctcctgctgtggtttgtttctctagcgagaagtccagcagcccagctactgaaagccaaggtcactaacgcaggatgcagtcagcccaggaggagcacagccctggacatgaagcttctggtcttacttctcccaccttcctgctacggtgtgcattgcagccgcaagctctgccttggaattgcttactgtgtcttagttcctgtgtgcatttttttattttttatttttttgagacagtcttgctctgtcatccaggctggagtgcagttgtgcgatcacagctcattgcaacctctgcctcctgggttcaactgattctccctcctcagcctcctgagtagctgggactagaggcacccgccaccacgcctggctaatttttgtatttttagtagagatgggatttcaccatgttggccagactggtcttgaactcctgatctcaggtgatttgcccacctcagcctcccagagggctgggattacagtcatgagcccctgcgcctagccccccttgtgcattttttaaaaggtgcagttctgtatttactgtagtgtttatgtggtaaaatttgttcatttaaaaacatttaatattgctgttgttcccttgatgcttggttacaaatttgcataagttctcagtggcctgccccagcttacctattcccatgggacttctttttacttttattgtgcccttttgtagagtatgagggtttttaggaactcaaaaattgcattatggcaaaaatacctggaaggttttcctgatgctaagattctttttaattccccttttaatacaaataacatgtatcattatagataattaagtgcagataacccaaacaaacaaaaaccactcaaaagtcttatcactgagattctagattaaacactattatatagacctgcgattctcaaacatgggtagggataaggcagtgggggaggtgagattggcctgaagaggacatttggggactccacactggtttgtcacagttgtgggtatggagagcaggggtacgtgctgctgacacctagttggtaaagtccagggaagctgctcagtgtccccagaggcacaacagtgttgtgcgacagcctcacaacaaagaattatttggctcaaaatgtcaatagtgctgaggttgagaaaccctgatatggacagatagttatggggcctttttctgtgaatattattaaatacactttagttttacaaaaatttggattatttatacagactagtttatgacctgcttttaaaacttattacttcatgaacatctttctgtgtccatgactatgggcctgtgacataccattgtgtgagcatgttggagcttacttcaccagccccctgtctggagactgaggtgctgccagcgttttgctattgaaaccacatttgtttgtattttgccttctgcatgctggttgactatggccagcccatgttggggcaccagctctacatctggggtgcctttcatgggtaataatattcccttcctgccagaggcccccccgccaaccatggcagtccccaatctctagttttctcacagttgaacataactcaagcttaatgaagtactgttgaaatagtgaataggtaagtaacacaatatttctgtcacgtttcatttttaagtagaactttcactttttgcttcattttactttatgggtttctaaaaaaataaataaattaaaacaacctatcttctggtaggttacatgtgactttaacttcttgccaagttggctttgctccatacctgggcttcctgagttcctggggaggcaggagtgggtcagatggaggatgccttgctctgactgtgctgtgggtggcacctgtcagttgtcatgctggggaccccctccttccccccaaagctgctctgaggctgcaggtgagatgcagcccaggagaggaagtgcatgacagctgtttgggcccacgttcccttttaggttgcagacagggcagcgtgcagagctggtgggctgggcggggtctgacacagtgctgtgcggagctcacccggacctgggcactcaggctctttctatatggggaactccaagagcttgtttgtgtggtggtgtctatttttgtgttttgtgtggtgctctgtgaggaagtctgttgtctacgcacatcccagctgctttgaatggtctgtctctgggggcttccaggtagggaattgtgtacggggaatccaggattcgggcagcatcggaacagcaggatgtgagtaacaggaagtgacagaaatgacccagggcgccagatgcttattctcggccacctttccaagcgctgcagcccaggagctatatttagcagagtgtttccgagtgcctcatcctgcccccagcaccgtccctttgcccctcttttggttggtggctgattgcacggtactgatttgctgctccagcgttcctgctctacttcgtaatctgtaggctcttgcccattgactttaacacccagtttttgtttgtgctgggtcacttcaattttgatacacgtggagcagctggaaactgttctgagcaggaagggcagcaggtaagagccccaggggacagtgtgccatcatactgggaggctgttgggtggtgagttcaaggtcagggtttggaattaagcggaaggaattgagcttccttgtaagatgctccagagggttgcttcttggcttgtatgtcttagaaatggaaggctggaatttttaaggtataggctttgtggtgtgactttactcatgtgctagaaacattctgtggttctcacctggccagacagaaagctgcaggtggaagaggcttgtgtgtggtgaattcctacagtctgagctttgtcacgggaaaatttccctccagtcccccaaagcaagcactacagagcccagatttgttctgctttgggtgtgggtggattttcaccttgtctgtcgacggtgcaggacctgtccctgtgtgctttgaggtttctagggtgtgatgttggtttgtggtttgtggaggggtgtgtgttgggagggaaggtgtttttgctgttctcctctaaaagctcccttctgagtggtcccgccaggacctccctttcctcccttcatgaagcatccaccttgttttcagacactcgagctatttgggattcaggaattgactctgggatgagaaatttgagagacaaattaggaacagttgtgtctgccatgagacgcgtggcagtcggcaggggcctggtggggtgtataaaagccctgggaaccctgcataaaggggttgggatggtaaaggagtgaattccaggctcaggcgctcaggagattcccctcccccagttccctcagcagagtctggctactggcatggtttcaggctgacctgttaaccttccgtatggctaaactacaaatatagggcatggctatattgtgtgtgtctctagttctggcttgggcatgttagcatatttttgtgccaaaacatttaaaacattcaaaaagtaacacatgaacccagctatgactgcttccagcctgagaaataaacataatagatataacagaggcacttggaattctctttcctatcctcgtttcttcctgctcccccttccctgggggcatcctaactttggtgtttgtcatttgttttcatgtttatatacttttttgataagtgtgtgtaggcataaacagtatatagcattgttgaactggttctgaaatgtcgaataaatgttatcagactggacagccacagcattacgcttcctggatttatccctgtggctacatctagctttagttaaatggttcaaggtttaatacaactgattcctgattcctggagttaaatcagaatttctggggaacgaggcatgaaccgcagagctcctgacaggcgcggcctgagttgaggcccacgatgctggttttcgtggcctctgtagtgttccagtacctaagacgtcctgttgtggacgtacactttcccagattccctgtgatcagtagtgctgctgtgaatatgcttatcttcgtcttcttggcacatgggcaagagtttctctagaatgtgtttctaaggatagaattgccaggtgtgtgcatcttcagcttgactggtgatcgtcaaattacctccagaactatcagcagcagtggtcacgtatgagtgatctcatttctatagtgtctttaagtttttcttttttaacataccaaactgagggcaagatgaagacctcatgagtgagataagacattggacattgctgagactttaatcgacaccgtgccctcagcatgtccacacggacctgctggccctgccgccaccccagctgtaaagcttgcttccacccacagtgtccccttcctgggatgggagcagcacccagccagctgctcggaggtcactgtggactcctctctgtctcaccctgtcccgtctgctgtcctcagagcacatccagagcctgcccactctcctcaccatcatctcgtgatggggttactgaggagcctcccaaaaggtttcctgccttctttcctgcatcttactgtcagctttcaataaagcaaccagaatgatgctttcaaaacttgagcttgcatggcttcttattttacgtggagtaaaagccaaagttcttacacctgcatggccctctgtggtcctgatgcttgcaggttggcccctggcccccttcctgatgccagccccagccacgcaccacgcgcctgcttctgctcagcccttcccacctccttccttgcttccttccagtctctggctccttcctcgcctcctccccgtttttgctgtggagtcccctggcccccagacctctcttttctggtctcccgtttttccatagggcttgtcaccagctactactctccatgctgtgtaattcacttctttaataagtctttaatttactgcctgcattcaaatgtaacttccgcaggagcaggaatcttttctgtttgctcaagtgaaagactgcctgaatttatttctgaggaagaaagaaagaatttggagcccaatgatgaagatagcacaggagagaggaggtgaagttgagggagcagtttctgacttgggaggttggggggatgggacaattactggtctctgggaggcagtggcagaaggaccttgaggccccctaagtgtgtagtaggacccccgaggggcatggccagtgggctgtggggctgcagaggcagcttcttttggggccttgtcttggcaccatctcggccactcccagagcatacattggtattgccgtagtgggtgctgggctggcccgccccacccaggaagtgcactactgtttgagggcaggagcctgcgattctgacatcctctcttcatggctgagctcctcaggttacatagctccactgattcctcaagcactgttgtgtttagaaatgaaaccttccatttccagggccctgccttgtgcaggctcaagtacccaggccacgtgtcagagcccatagcaaaatgagcagctcaaccggagggcgtggtccatgacactcctgcgtgtgcttggactcaggcgcagggacaggcggggcagctggcatttctacccacccctcctgacatagaggacctggtccttttctttgagaatgtgtaccaaaggtgtgtcggctgtgtccacataatattttcttggcgtcagatgtttcatgggttgcactaactacaaatacaggactttagataagattacacttttaacttgcgctgcccacatacgcccttgtccttaagaaacacagcattgttctggagttactccttggttttcccagtttaaacttaaatattgttgatggtggttacttatttttaattaaagcttttattttgagattctttgtaccctttacccagttgcatgcagtggtaacctcttgcacaactccagtacaatgtcacacccaggatactaacctcgttacagtggagatgggtagcctccaagccgcagagattttccttgtgcccttttacagcctcacacatgtccctctgtaacccctggcaaacactcatctggtctccatttctataatttggtcttttcaagatgtgatataaatggaatcttatagtatgtaacctttggggttggatttttcactcagcgtaattccctggagcctcattgaggttgatgagtcttatcagtggttgttcctttttattactgagtagtattccacgggtgtaccacagtttgttaatcatttaccccctgaagggcatccgaatagtttccagcttttggtgatcatgaataaagctgctgtaaacattcctgggtaggtttcggtgcaaacatgaatctccatttctctgggataaatgctgaagagtgtaattgctgggtcatatgctagtcacatgcttggttttttaagaaactgccaaaccgttttgcagagtggccgtaatgttttacatcccacccaacagtaagatccactttctccatattctctccagcaggtggtgttggcactagtttctgttgtagccatcgtgataggtgcgtagggctctctggttgtggtttcagtgtgtttctctgatggctaaggatgttgagtatcttctgtgtgcttatttgccgcttgcatatcctcttgtgctgtcgggggtgaggactcatttccaggtggtataggagacatcccggctctcagcttggcctcctctggatactctgttaggtgagtgctggagtgcctagctgcggcctgggagtggggtgggcatggttttttcttgtggcgctggctggagtaaggtgggtgttactgccgttgtcagtttctgtcttgtctgactgcccccttcctggatccttggcctggaagagcaggcttttgttggggctttccacccacccccccagtatccatcactgttttcggctgctgcttctttagctccaagtctagggtataccaggtaaaaagaaaacccagagggccaccacagtgtcatccctttggacaagacccttgtcaggctgccatcttctctctacctttcagggtctttttgtgttgattttctgatgcccatggttttcagttctcagtgagaggagtggggaaaagtacctccctgtcatctgaatttggacccgtgaaaagtgaagagggggtccattcagaatgttgtgcctctacccatccctgctcgctcgtcatgaccgttggaccgttgtggtccccgggcctcacattaattactcttaggcccttttggtttggcctgtggtttcagcgtgacacagtttgctggactttgatcttttttgtcatttaaagtgtcatttatgaatgagatccacgtccagatccctgcatgtccaaattcatggttagaaatggttggacaggacatagccatttgggtgctgtgattcagcctgatgtcaatcagtgaactgcctttgtcattatcctccagatcttatttctccaccttctattttgaactcttgggaaacctggtcagagtgggagggacaactagtcagatgacttaatgagatgttggtatcgtccttgtgctgatcctccaagccagtcaccctgccaaaacggaaatgaaatgtgccagacaccgcttgtactgagtgagcttgggagagctcgtggtgagtgccagttgcttccctgcctccggcccactggccctggtgtgaggcaccacccagatgaggagaggctgcgggatggaggtccagggctccgcctggagcccccctgcctggtgtcctggccacatcagctcatttgctgtgggactgtgagcaggcccctcagccgggttcgtcaggttgtggagaagctgaatggagcagataacctggaaaacacgcggtggattgccgagaccttctttgtgcctcgcccatattagccaaactgtcccttgttctatcagctgccatgtgtgtgtaagccagagtccaccctcttttccatttgagaaatcacgtctgcatgtctccagtatgtctcctttttcaccatgatttctcagagatcactccctgcggtttaataaccccctgggctaattcttcccaggacatgggaggacattttgtctggcttggcaactcatttagagtagcaaggtattttctcatttctcttggaaaatcatgtacttgaatcaagaatagaagccaaaattgttctttcaaatagaattttaaagcttttttttttaatccttaacatataaacgtaagactttatttttatttatttatttatttttaagatggagtcacaccctgtcgcccaggctggagtgcagtggcgtaatcttggctcactgcaaattccacctgccgggttcacgccattctcctgcctcagcctcctgagtagctgggaccacaggcgcccgccaccacgcctggctaatttttttgtatttttaatagagacagggtttcactgtgttagccaggatggtctcgatctcctgacctcgtgatttgcccgcctcagcctcccaaagtgctgggattacaggtgtgagccactgtgcccggccgactttattcttttttaatagctcatttttggattggcaacacatgcaagtggtacagaaatcttaaggctaaaaagatataaagtgtttcccagccactcagaggtcctctcagttagaggtgactaatattagtgttttctctgtacccatactcttcctgcaattggcttttatctattaacagtgtgtcttagaggttgttccatataagaacatgtagagtagcttcaggggttttagtggctgcatagttttctgttatatgaatgtactgtcattactgtagccagtctctaccagccttatattgatcactatttgtttggtttcaaatattttgtctttatagtgaatgccgccacaaataaccttgtatatacagtatgtgatttctcatgaagatacaggagaggataaatttatagaagcatggttgttgagacacaggtgtatattttcaagtctgacagattttaccaaatggtttccatagaggttgtattaatttttgccccagtgtatgagaatcagtagaccatattataaaacatttgatctctgtgaatctggtaggttaaaaaatgggatctcctaattttaacttgcatttgccttataagacagcgttttttcataaacgttgaaaatccatttctaacactgttttaacatagtgctgccagactctcatattcatgcttcatatttcatattcatattcatgtttccacctttctctccctgtctcttgtacagttattttctaaccagattttatgcaggagtctgggcagctctgcacacttttcttttgagttatgtggttatgtgtttttgagaaatcccaagttctgtatcctttttgactgaggtgcagcattcacatggaggagtgtactcattacagacgcacagcttgatgcatgttcccgaccacggagaacactgcagcccccggaatccctcctgtgtgcccctcctgtcaaagcagctgctaggagaagctagcatctaataccatagattagttatgtctgtttttttaactttatgtaatgcataaggaaattacacagagtatatgtcgtcttgtgtcaggcttatttctttcgctgttgtaagattcattacattattgcttgtctcccaatgtatgagtatactacagtgtattcactgtaggcctgtttagagtagtgatgctatgaacattctcgtatgctttgatgaggaaggtatgcgtttgcatttctgtgggatgcgtgggtggaattgctgagtcacagggtatatacaagttcagctgttttctgaagtagttgcaccaaattgcactgtcaccagcacttgatactgtctgttacagctcagccattgtgagagatgcatcaccctgtagctttaatttgtacttccctgatgactaatcaaattgagcaccgggtcatgtgctttattggccatttgtgaaatagctattcaagtctttcgtccattttactattagtttgtctgctcttactgatttttaagttctgttaccctcaagagaattccagcaggtgtgtaaaaattcacatctgtctatggctgttctagcctgcctcaggattctgtgagaaatgcatccaccattttatccactcctcctctgtgacatcacgtttctttctccagtcatcaagcatcaagatctgaggatattttctctctccagtgtgtaggtttccatgcagtcacctctgatgcagttctgctccttctcttggtgggacgtcctgcagcctggccttttgaatccctgggatgtcattcatttgtcctgttgagttcagtttattgccctgctttttttttttttttttttttgagacagggtctcactctgtcacccaggctggagtgcagtggtgcaatcttggctcactgcaacctccgcctcccaggttcaagtgatcctcccaactcagcctcccaagtagctgggattacaggtacatgccaccacgtccagctattttttgtatttttagttagagatggagttttaccatgttggccaggctggtctcgaactcctaacctcaagtgatctacctgcctcggcctcccaaagtgctgagattataggcgtaagccactgcgcccagccttattgccctgcttctgatttgcaattatcttttaagttgattcaggggtgtgaactgtttcttatttaatacatttgcttgaaaaatatgagccatcttttagtctccaaagacttttctttgtgaaggctggattttggagatagtttcagcttttttacaccattccttggttgccagtagttatgatactggctgcagtccagacatagggatgctcttagtattccttagagcatctccctgcaccctgccacctgccctggtgggcagggtgagcagccaggaaggcatagcctgagggcctgtatctagcccctgctttctcgcctgggtccttcctacccatgctgtctcccaaatcaagggattgaataggaagtgctgctcagaacatcccccagaatcagcctcccgaagagactcaccctcccctaccagaggttgggctgtggctggtgttaggggaacaggagtaggaggggagccagaggaggaggaggtgggcccttgcctaaggggtgcctgctggttggtgtgggggctggagctcgccaggaggggtgtgctgagaagatggaggcatggcatggaagtgtgagtcatggcaaatctcctgtgtgcagctggggaccgacatagagaaggcaggcccagttgtgtcccctctgtgggcagctaagaaggatggattctgacttatttggtgggactctcctgtgacatttcttgtggtttgggagagtggaccactgataccagagcagtcttaagaaagatgctcacatgggaaaggggtctcagcagtgtcaaatgatgacatcaaagctgagggcttcgaccccaaggtagcaccgatagtgacagtgcccagaacattatcaggttgcaccaactggcacctcacaacaacaaggctaggatgcgacactgctcttaatagctccggttttcagatggggcagtggaggcacagggcggagaagcacctgctctaagttacacagctagcaagggcttcagactcagggaatgtgccaggccctgtgcacatttggtcctgttcagtcccaccacagccctgcaggttgcttctagcatcacttttcttgacgagaagcaaagagggtctgcccccatttcgcaaatttatcagtggccaggtaggattcagatctgggtctctctcaggcttcttcacaacagaacaggcacaaataagaggtttttttttgttgttgttgttgttgttctgttttttccttagaagccaaaacccaggttctctgacatttatctgttgctcagtgtttattgtctgcaaacaacagcacaggtgaaggcaatgatgccattggtcacttgtatcttaactcactgtctttaaacctaatgcttttgtctataatttgctgtctagtagtgcccaatacccacaaagcaattctagtacaccctctccttcagtgtgtgggtcaggtgggcccaaagatccatcttctcaaacgctgaggctgagttctggagcaaagttggcacttcagctcgtaaaggctgccgtgggagtagtagactcaggacctaaaacatctccttgttgtcttctataaatatcctgttgcatgactcctaatataatccccgagttatgcacagtaaggtatattatctttctcttactatatttactatgctgacaaaagtgttcaaatattaaaactcacccagggtgaacagttcgggacgtgtgctcagacttgataggtagacagggacggtgccgatgacatgcacccactcggccttggcagctcccagtctcccatgaccgtccctcagtggctgtccagagactccctgagtcccactctcagggcccactttgtcgtcttcatggctgagtcagtgtgggaaatagttatctgcctgcctctccacgctgtgagttctgtgaggggaggaactttgctcaccatgttgttagaatccccagtctagaggagacacctagccagcatctgctgagccggggggtgtcctctggagggagaggggctgtttgtggtgctctcaagcttgaacagcagcagggcagaaggcagacggcccctccgggcctgcctttgccgtctctccttcgccctcactctctcccagctctgctgcttcccacgcccagcccggccccaggtgttcttctcccaccaacccaggatatgtggaagaagaagcgaaccatgcagtggcgacccagttccatttatcccctctgcggtgaaacttagtcactggagaatctccctgtaaagcactttctatggtttctgagccagaaacatggtcatttaataatttaaattgggtattcctaaattgggtcttcttaatgtaaattaaagctatgagatgtgccgaaatctaaaagttaaataacatattttgtttttgaatccatggggaagcaagcattttcctaacactgttggtgagaatgcaaaatggtacaacccctgtgggaataatttggcaatagctagcaaaattacatgtgcatttactctttgtcagggcaattctacttctaggaatttaccccagagatacactggtaaaaacaggaaaagatgcttgtaaagataattcacggcaacactatgagaaatcgcagaagaattttaaacagcacaaaattcccatccatagggcgctggctgagtcctatacagtggagtactgtgccactgttgaaagaatgaggaagccctggatattgctaaggagtgatggccgggatatgtaattaaatggaaaggcaaaggtggagaaaagtgtccatgctactgttgacaaaagggacaatgtgatatacatgtttgcatgtatcttaaaaatggaaggagaaaccttactttctctctctcttttttggtaaagcagcctatgggaaccaagataggggagagatataaaagctagatttctaaatctaccttgtttgtagatttgactttg
